United States Patent 7,365,185 (GENOMIC PLANT SEQUENCES AND USES THEREOF) - sequence listing, part 72

SEQ ID NO: 74716 - DNA, 28631 bp, Oryza sativa
aaacgacatatcaagacaaagtctagtatgtatgtgtgtacagctggactactatactattttaaagaaatactccctccgtcctctagtataagggattttgacattttgcttacactgtttgaccattcatcttattcaaaaaattatggaattattttttttacttactttattatccaaagtattttaagcacaacttttcgttttttatatttgcacaaatttttttaataagacgagttgtcaaacagtgcaagcaaaatatcgaaatctatattatagtacgaagggggtttaggttttagagtttagggtatagtactcacggtaagtttaaatcttccgtcgttttgtccaaccaatttattgacacgtttttcaataaccataccactatgatatcattgtacataaatcattgacatggcaactgctagtactaaccaaaagttgtcaggatagctacacctgagagaatgttagacgaaataagggagggaaaaagggtggcaagtccattttgagagtgcaattagaaagctgagtacattgcaaatcgacagcaaaggaccatcattatggacaagttctaggttgtgaacgtaaaaaggcctaatcaccaactccgcccatcaatgctttccaggggtgtaaatgatatactaaaccgcataaaaccacaaatcttttggattttttttctcatttcctcgaggccttattcgattaatttttatgagggagggattagagagaatttattccacacctattgtggtgtggaattattcctcccgtctttaatcctatctaaaccgaacaaggccctattgtggtgtggaattattcttccacagtcccctccaatatttttcaatccccttcaaaccgaacaagctctcacggctgccactcagccactcacatcttctaagggtgcgtttggtttacggtcaaggttagataggatatggcggtccataatttgctggatttgacgatccagttttttgtttggtggagtgagtatattgatccagttttttatttggttctagggatgaaggtggatttggtgatccaattttttgtttggttagagggagtaggatggatgaatggctgcaatcaccccttcattagagagggtgagtataccccttcaaaatcaccaaacccacaaaattatcaatctatatattaaaaaaatatagagaaataaaaaaatcataaacaaataaaagggggaaaataaaaaaaatagtcctcttctcgttggtcgtcggcttgctcttctcgccagctgccgccccgtcttctcgctcgccagccgctgtctcgtctcttcgctcctctcgccggccgccaccccgtcccctcattaggcggtgacaacgacgacgatgccggccgtctcaccggatccgccgcctccagatcccggcgaggaggagcctgggaaactacaatggttgccgctttcagatccggtcatcgtcatctacttccataccaccgcctcttcccactcgccaccgccccatcttcttgctgtcgtcgccttcggcctccagtctcgcggcaccctcttcccgccgccaccgcgcttgtgtcccgtgccagccgttgcgctcccgtcccgcaccggcctccgagctcgcctctcttgctggctgcgtgcttgctgcctcgctcgcaggggcgtgcctaggttatactacccggtgtcacaggacaccgggtagattattcaaatcctatataaattacactatattaattaatatattagtcaataattagataattagtatgtattggacccccggtaacttttattctaggttcgccactgctcgctcaagtcattgcggtcacgtggtgacggatgacacgagtcgagcgaccagcttgctcgctcgtccgccctcgcccgggcgctcgggcggctacttctaaggggaatattctcctccgggccgccctattctattttcgcccaccaaccaaacacaaaaaaaaaagggggccgccatatcctatccacccaaaacccaccatccaaacacaccctaagaaaatccactcgctctaatcccggccgtatattcccaatccaggcgaatcggccactgtaaccggaaaaaaacagttctatccgtcagatgccgatcggaaggccagcatcagcgctatacggtataggctcccgataaagaagacggccgcggctacgaggccgcatgattggatcggaccgcggcgagctggcgtcgccagtggcgtcaggcgcacgacctgccacctcgcacgcgccccgtgggacccccgcggtctcggcgtcgtctcggcgtcagggctcgcgctggccgacaagcgggctggtgttcacgtgggcccggctgaaaggggggctcctgcagctgggggcccacctgggcggtgtccgttggaagcatcccgttggtggatgccccgtgggcccgcggcggctgaggtcctcgggaagggtgacggtatccgtgggcgccaggcgctgggagcctgggattgggcggggtgtggggccacggcacttgcacggggtttgactgacggtgtggccgcgtgggaggcgatggatggattgttccgccaccacgcgagccgccgtgacgcggctgcagtgctctgctctcgcgtggttggcactcaccacctcacctcatattttgctgcttgcatgattggtttggaacagcgacactggcacactgctcccctgaatccctgaaccctgataggttttgctgagaaaaatatcactgatgctgaattgaggcttccatccgatggtccaataaaccgaagaataaaccaaattttaaattttcaaacttaattttaagtttgattttgagatattttcaacgtatatttttttcagcattggcttttaaattaaaaaaaaacacatatataaaagttttacctataaatttatttttattttctaataagccgttttggtttattagaaaaaaaagccaatcgattggggcctgacatgggcaaggcagtggtggtggtgctccggtgccaacccaaacgggaaagatccggatcaattttttttgctcgcgggagagttgcggtaatatgctctcggtaatgacagcgatcgcaatcgatccatccatactcgacgagttcacatactccatggctccatacttcagggttcacaccgagtgacatcacgcccgctcgtgcttcatgaccttcttagcattatcgtcttgcgcttgacgattcacgaccttgccttgcacgcaggcttgtcacttgtggcttgtgcgtagtggctctccttttcgtatagacttccaggcttccagcttcatgagacgaatgcagaagactatacgattgttttcttgtaaagtcgtgtttcagagaaataacactcagcacatgttggagcatgtagaggacagatactaaccatttgtaaattaaagtttcgtttggaaggctgtgtttagttcaccctaaaattgtaagtttggttgaaattagatgatgtgacggaaaagttggaagtttgtgtgtaggaatgttttgatgtgatggaaaagttagaagtttgaagaataactttgaaactaaacacggcggaagtgtgtttcgactgaaaatttcggtgacacattaaaagaaacaagcattttgtgtatgattaattaaatattaattattataaattttaaaaatacatttaattaatttagaaagaaacttctatatttatgatttttgccgcaccatttaacggattgtaaagcggtatagaatgtagcccaagttgaaataccaaaattttcccacccaagcatgtaacttgtatttcgttgggtgtttgtatgaatgttaatagccgccaaatcaatagtccattaatgttatattctattatctaaaaacattgtccattgatagcgcgagaacttacccaagacctaagttcccaatatgttagtagggtggagaaacaaaatagccataaatttgtttcttttgcccttttatataaagacacgtactatttaggttgtgtttagttccacgctaaaattagaagtttgaagaaattagaacgacgtgatgaaaaatttgaagtttgtgtgtgtagaaaagttcgatgtgacgaaaaagttgaaagtttgaagaaaaaagttggaacctaaacagggccttaatgtattcttttcaaatagtacacgtttgtatcctcatcagtttgtcaagagctgattatatatcaaaacgacttattagctataaaaaataatttatgaataaatattgacaaaaaaaactacattgaaaatactctaaaattaacttaaaattatgttttaaatttgaattttgacatcagctgattcattgtaggataaatcatgaggctcttgctaggggataaattaagcacatattctacacatgtcatattcagattgcggattccacttcaacatcttacgtgtactccaccttgataaaaagaacgtgcttcacgagcctacaactcacaaaaaggataaaaagaggcaaatactttattttacaggagtgtgacaagactaaaattacctaaaacgaagctgccataaactcagtgcgtgtccattccacgtacttttgaagaaaaagatacatctcttttttttaaccgggaaaaacacattcgctgcgaagtgtgtgtagtttaacttcttggaattaacacgggagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaatgcattcatccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtgaacgtctagatttccgtgtgtttctcaaggaaaaaaaaggggaaaaagcattagtttcacataacaccatagcatcatgtaacagaggaatgggctgaagtggatgtgcagttttgtactagtcaacaaaagccggaataagttcactttaggtcactcaatttattgcctagtttgaaattcattcctgatccacaatacaaaatatgacgcacctctcaactctcaaaaccagttcaagtaagatcccaatatgttttgaacaacagtttcaactaatgtggcatctacgtggtgttgacaaagtcaaataaaaccatgggacccacacgttagtgagtattcggttaaaaataaataaattgaagtgagacccatgtacagggtggagtgagatctgcaaggtgtctggagggaggtggtggagtgcaacgtcgtgtcttgttgcttctcatttgccgtggtggggcttatcgttgtccgcggcgttgccgacgccaatgctacaacaccgggaggaaggagatggacgagctccacgcccagggtacgggcctgcgggccctcgcccagtacacgtgcacacatcgggtcggtgaaggtgcgctggtctgtgagtgatggctgaggtgtctttgcggtgaagaacattgaggcggggcaacaaaaatagcacatcctctacagtccacaacagttgactcaaatctcttagcaccaattttctctccttcctcccttggctaacatgcacaagttcattgggaagagaaaagacaaaacaaagagagtagataccagcacggggctacccacatacgacaagaaggaagcaaccgtagggcggcgacatgttggcggcgttggggaccccgacaccggcggttgcaggcattgaaggaagcaggagcaggacccgaccgacggtaacggccatagcagaggctgaaggaggaccccaacgggtagagtcggcgattgcgccacgggaggcacgaggaggggcctactcccttggtcggcgacaaggcaggcggagcactgatgtagattgagagactcgcatcgaccacagcgataaccaatgcaactagttggagtcagcgttgacgagctgggcgacgactagtactcgagggtgacgacccaaatctagatcccgtcgagggagaagcgactaagagcaagtataatagtaggctacaagccggctaaatgctgaggtggaggagagaagagaggagagagaggagaagcggactgtaaacttacagccgacttggacacaagaaccaagaaactctatgagagaaataagtgggccctatattaattgtaaagagctaactattatatgggtaagctaagagaagactacacagaaccttctagctaacaggtcggctgtattactagccttgctctaagggaatgcactcaaggcatgtcggtcacggtaagtagggggactcagggtgcgtgtggagggcgacgaatgtgctatttttgctgactcaaatctctcagttcacatgtggccgctaacatgtgggggccacgtgggtcccactcgccacgtaagccaaaaccgatcactatactgctaagagaccaaagttgacattgcattatgagttgggggatgagttatatctgatatttcagttcaggcatgaattttagacttggtgacaaattaaaagacctaaaggaacttatccaacaaagccatcccttaactcttaaaggcctggtacgagtctatccagtgggcccatttcccaacctttcggcctaggaataagttcatccaacttccctctatttacaccgaatccgatttttgtcgttgaaccccaaaaccagatacaaccaatttatgaactgtcaaaacctgtgcaaacgaggtccctcggcggttttaaaagcggttttggctgacgtgacgtctacgtggcgatgacgtggcaattatatatcagaaaaataataaaaaacataggcccacatgtcagccacacaaaaaaaatcttaaaaaaggtggggcccacatgccagctaaaaataaataaatatggtgggccccacatgtcatctccctctccccactcggctctctctcttcttcctcgtcacgccgcagcatgccgccgccgccgacggcagccgaagcatgccgacggagcggcagctgcagcaggccgcgggcgaaggggcccacgaggagcggaggggcgagcggagtggcgacagcggcagggcgtgggcggagcgcctcctgcctcctcccgttcctccaggggctccccaacctcccgccgctccgcgtctccagcagcgcgcccgtcacgccgccgctctcgtcgccgacggcgtcgcaggcacccaagatcaggaagccggactagaacgtcgaccccttccggcaccccttcttcgcggtctccgcgccggcgagcccgacccgcggccgccgccttgagcacccgaacacgataccggagtgcgacaagtccgacgtctcgacggtggactccggccggtggttcagcttccagatggccaccacaacgctgacgtcccgcacctacaacctcgtcaacccggcctggtggattgggaaatttcagggtgaagtcttcgattcgagtccttcctgtgcatgcaagaaagggcgctgtgccgtgaggagatcctcagctttgagcatccatggggttcctcaaccttgtgggcaactcctttgggtgctcggcttccggcgagcggctcgtctcggcggccagggacggcgacctgcaggaggcgcgcgcgctgctcgagtacaacccgcggctcgcctggtactccactttcggcggccgcaactcgccgctgcactacaccgccgcgcagggtcaccatgaggtgatgccatttgtttgccaaactagctgaagtatcagtgtttctgtatagatgggtaaaagaactgcaatactgcattcacattttctgttgcttgcatgttcaaattgtttctctgttgctcgaatccgacgtcaagatcaacctcaggaattacaggggccaggtaaaccaagatttctggtacatttaattgtttaagtttcgacaaggggtgggtgatgccatgggagggcgagaggaggcggcgtggactggggcgaaggacggcggccgcacaggaggacatgtggggagagggagatgacttgtggggccggatgtaggtggcgacatcggtgtcggagtggccatcaaaaacggcgaagaggccgacctcgttgtcatcctaatctaggtggcgaaactcgggggcgacctcctcctcctctgggcaccgccgccgccgccgcccgcgccctgccgccgccgccgccgccgccactccgcccgcccctccgctcctcgtgggctccttcgcccgcggcctgccgcagccgccgctccgtcggtatgcttcggccgctgtcgtcgtcgtcggcatgctgcggcgtgatgagcaagaagagggagagccgagtggggagagggagatgacatgtggggcccacgggcctcaccatattatttttgtagctaacatatgggccccatcatttttagattttttttgtgtggttgatatgtgggcccatgatttttattatttttctgagatataattgccacggtcatcgccacatcaatgtcacgtgggacggagacctagtcaaatggcgccatatcagctaaaaccgccttcaaaaccgccaagggcaccggttttgacagattggggaccggttgtatctggttttggggtttaaggacgaaaatcggatttgttgtaaaattaagggacctcggatgaacttattccttcggcctatgattctatggaagcccgtcatgaccaagcccacaaaaccagagccttcccattcccacaaaacctacgcacagttcggatccgaccactccacgtctccacccggccgagctcaacctccgcgccgcaccggacggtcgcacccgcgtctcccacctccccggcggcggctcccctcatctccgccggtcgcctcctccaagcctccgcgacgcgcacggcagagatgtaccgcatcgccgggagccacttgcgctctctcaaggtaccgcaccctcccatcccgatccttcccgctgcaaaaccccccatccgattcgcccgacgcggggggcgttccgtgtaggaattgatggtgattgtggctaatccttgtttacttagtcagatgttgaaacgggagatagattgtttgttgtcccacgatgagaagaagaaacctgcatcccgatacatttagcggtcactgattctctctagcacttaccgttttcctgttaaatttattcagataacgcagctgaagtcctgtaaatcctttaaccaacatttttcgtgacggtgcgggatgctatgttgaatgcacggacgccacattttcttttgcctattgcattatattattttgactttttaagctgttttctttgcttgtctgatctgtctagaagtgttgggttgatgagttatcgctaactcaatacacatagtgcttatatcatcttttcagattgataatgttaatacgatattttgagtttttttgggtaaggttcacctgaatgtttaaaacaactattttaatgtaactattatactgcaatttgattccaaagggaaagggtgatgtatgacagtataagttaagctgcaaagtttacttctcggagatttcttttcgcaatatgatcttgctagtttggtttttcagtgaccactgcctccagtattttctgtaatttgtatagaatttttttcatgtgcaagtttttcagtttgagtaccttcttacttctaagtaatttcacctcatgttgtttctgccacattatttgttttcctttatttccataaaaccatatcatgtatcataaagacgcatctcttttgcttatgtggttgcagagatacagttatagtaggtttgctagtacaagtgttgtgaagcagtcttcaggtggtttgtttagctggcttcttggggagaagtcaagccaattgcctcctcttgatgtccctctcccgggtattacccttcctccaccactgccagactttgttgaaccgtctaagacaaaagtcaccactctcccgaatggcatcaagattgcttcagaaacgtcagtggtatgatggtatcactatatgccttcaggtgttttaatagattctcttttttctgcatcagcatgaaaagtaaattttttaggacttatctgcagagtccagcagcatctgtgggactgtatattgactgtggttcaatatatgaaacacctgcttcatctggagcatcacatctgttggagagaatggcgttcaagagcactacaaacaggagtcatttgcggctagtacgtgaagtagaagccattggagggaatgtctctgcatcagcctctcgtgaacaaatgtgctatacctatgatgcattcaaggcctatgtacctgagatggttgaagtgcttattgatagtgtgaggaacccagccttttttaactgggagattaaagagcaggtattctgtcattccgaaattagcatttttgatattctgtatatgttggcattataataatgatgtcttgttccccctacagctggagaagatcaaggctgaaatagctgaagtttctgataatcctcaaggtttacttctagaggcactccattctgctggctattctggggcactggcgaagcccctaatggcacctcagtccgctattcataggttggacagtagtatccttgaggaattcattgctgtaagattcatcaacttgccatttatattgtttttttgttagaaagtgcgtgctttgacatatgcttgcattgatgaattcaggaaaattacacagcacctaggatggtccttgcggcatctggagttgaacatgatgaactagtttcaattgctgagccacttctgtcggatcttcccagtgtgaagcgtccagaagagccaaaatcagtttatgtgggaggagactatcgttgtcaagcggactctgacgtgagcttttgctgctttacgctgtttgttgatgaggatgtgtatatgtacttataatcctggcttccttttcatgaacagaagacacatattgctcttgcttttgaagtaccaggtggatggtttgaagagaaaactgccatcattgttactgttcttcaggtattgttggcaaacatcaaatttaaccattattcagagacaaaactcaactatggtataccttttatgtagtttactgtctagtagactgccttatatgttcaccatttctttatacgcaatatggatggtcttgttattttgcagatgctcatgggaggaggtggttctttctctgctggtggtcctgggaagggcatgcattctcgattgtgtatgttgaattccacattcttgtcaatgtttcaaaaaattaagttgacttcttgtgccaatttcttaacattagcgtgatgctttatttacagatctccggatattaaacaactaccatcagatcgagtcattctctgcattcaacagtatctacaaccattctggtctttttggaattcatgcaacaactgtgagccccttatcagacatggatgatcctgcttttttttttgccaaattcaagaagtaaatgtagtttagtgtctgtctttttataccaaatggaatagcctactctagtagttattataatgtccattatgtgtatatctggtcagtggtgaacccagaacaaaaattgccgggggtccaatacattattacttaattattgactgatttaatagtttaggacataatttggttaggattgaataatctatctggggtcctgtgaccctgggaagctcaacataggcactccattgtatttggtagttgatttgtgtgcacaaccaacctggtctcttttatcctttctgcttctgggatttacacaccatcttacgcatggaataacttgattgcatgaggcctgtgatgaaaccgggcaaagcagccagtgacctttgtaaccaaaatagagaggtcaaaagttccttaagtaggtgaagagggagaattttagtgcctttattacggatataatagaagctagaagcaaccaatacttttgtgggatgtgtggaaagcatccatctggaactgtgagaagtattgtttgcatacttctctgtttagcagggtatatggcaaatgggcacatcgcctgctctactcatttgttttgagatgtttgttatgcattctaccttcactccatatctcctatcactatattgtacaacaatttgtaccatttttttcctctttctagttttccttggaaatgaaactgtgcaaagggagtgagaagattgactaaagccttgtagagacatcaatttgcatccatttctttcttttcattttgttgtgttcattgtgctattaaatgatagaatcacttgtcagtaacactttttgctactcctttcatgatatataattgacacagctttatgtcttgcaatcagagcccaaattttgcttccaaggctgtggatttggcagcaggagagcttcttgaggttgcaactcctggaaaaggtttgcttcttatttgacatattggatatttataaggaccatgcccatatatattttcctcatggctgtattttttgtgtagttacacaagaacagcttgatcgagctaaacaggcaaccaagtctgcagttttgatgaacttggaatccagagtatgcatttctaaccactacttgaatcctttgtgcttatcttttgtttcctgttgtatccttgacactttgttttcttcactgcaggtcgtagcatctgaagacatagggaggcagattttgacgtatggggaaaggtatggttgcaccagcattggtaacatagcaacaaaagtcacctcacatggttcttaaacctttatgtgcactagccatgcattcactatcatttatgagctatgattgtgcaatcatgctgtgtcctgacaattttaagaacgggaactttagcatgtcattaaaatcatagtgaaacctacaaatatatgttgtctattgagatgtcaccttcagtatttacacaagcatagagctttgatccttcaactgtgaatgaactacaacagtttgctttttgtgtagtgttcgttttttgttgtgaacatacatgctaagttcattctagttttaacatgcattactattgacatttctctatatactactatgaagagggagtatgtccgtttacttggaactcggaaaatccagtttgaataaactaatctgtatagccgcctgtgcaccgccttgctgatgtaatgacatcctgccaatgtatagcactccgagcaattgaacaagatgattcctctccttagcccctctcaatgtcgatcttctataattactacaatagtaatgtatgttttatatcccattgaatggcatggggctgggcaatacaaatagaccgccggatgtctatataaccgtagttgcatcaactattgcggaatgaggattgccaacaattttctgttagctagtcagtggtcatcactattatggcaatagaccgtcgttcagctttttacccttagttgtgaatctctaactattcagctttgttgggatcgcaggaaacccattgagcatttcttgaaagatcttgaagcaatcaccttgaatgacatttcttctactgccaagaagatcatttcatcaccccttacactggcatcatggggtgacggtatgttctaacttaatcttcatcaaagtatttccttgtgaggattatgtaatactccctccagttttttttatatgacgttggctagttcaaatttgaactagtcagcgttatacatataaagatggaggcagtactaccttttataaactaataattttggacttgtgattcactagaatgctttcttgcagttattcatgtcccgagctatgaatctgttagccagaagtttttctcaaagtaagcaagcctatcgcatggcttgcccccgacttctaaagttgcagacgtgtaactctactggtccttggccctaaccgctggaattcacaataataaattgtctagacttatttttcttagatattttaattttaagcaaataatagttactcaaacggcgatgatgctgactgtcctttttattcttttcctttattatattgatccataattttgcgtcaggctggaactatttttagttccgcggtggtgttgttgttttttgttttgttttttttttgtcgtgctgagcttagcacagctgagctgttgcgtatgtgtcgtgacttcaagtctatgcatgctgaaatcgtcttgatgatttttccattcatggtgagccgttcttcaatattttaactgagttccccaatgccattacgtattattgtcgcattttctccaaggctgaagcctgaaatacagttcttttcctttttacttgaaatctcttccctcgtttcgcatctgaccttctagtcttctagagcatacatgagccattcttccgtatcctcgtgtaattttctctgtgatctagagtagtttgtattaagatgtgactttatactttggtgtgtttgctggtatatgttggctgcgcgggtttcaatagctgacagtgtgtacgcttctacggttccattcgatggctgcattggtacggggtactctatctgtctcataaaaaaataaatttaatatagaatgtaacatatttagtactacgaatatatgtatagaggctgtattatgaatttaaacatattcttgtttagatttataataggaaaaaatacgaattaccctaaactatgacggtcgactgaattacccccctcaacaacaaaaccagacatttaacatctttaattttctaaaccggataaataaccccccttggtgctgtacaaggtggttttagtcctatatgatatccacgtggcaatgtattaatccagtcagcaacatctcaataaaatgaatattctaaaattaggtggtcccacacgtcatgctcttcccgtcttccactttcccctctcttcgtctcgtgcagcgcagacagaaagcgacggcggcagtggcgctctccagggcgggcgggggaagcggcggcgtccagggcggcgaccgcgccctccagggcggatgggggaagcgacagcttccagggcgggcgggggaagcggtggcggtgacggcgccctccaagtcggacgggggcagcggcggtggcggcggcggcgccctgcatggcgggcgggggaagcggcagcggcgacggagccctctaggacaggtgggcaaagcggcaggggcaacggcggcggtcgctgacgccgtcgcggtcttcttccccctcgtcggaaagctcacgtacgtcccctctaccggcgacgtcgtcgttgactgctcgccatctgccgttggggacggggcgacagcgacgcgcgggcgctgtcagccgccgagaggcacgatgtcccggcgttcttgcggctcgtgcccagcctggaggcccccgagctccccgcgccattgctcgccgtgcaggtgacgcggttcgtcggcggcggggacgggggcggcgttgccgtgcaacacgccgtgccggacggccagagcttctggcggttcatggacgcgtggtctgcgccggccctcggccggccatctgccccggcgccggtgtttgaccggtcggcgatcgtgcaccccatggccgctgccatggctcagcgcatcctccggaaagtgacaccagagctaccactggtaatctcatttttgtatgtgcgcatgtgcattttttatgaaaattcattaagtcatctgatttttagcgtgttctacagattttcatcgaaatttgtagctcctcactgcgaatttgttgaggcgaacatggcaacaccacgacacgactacgctagagctcgagcgccaccgcatcgccgacatcaagaacctcatcgtggagctcgacgaggccaccacatcccccgggcgggtgcggggagcagcggcggcggccgcagcgacagatcggcggcgtccccccgattccccctcccatccgcgcccaccgtcggccagagccaccaagccgtgcccgcagctgctcgcccattgacgcctaacaccaacgtcagagaagtgacagagaacaaggggttaatatgacatgtgggccctatattattttattttattttattttgctgattggatttccacgtcgacgccacgtgtatgccacgtagaaccaaaaccgttccggattgagtcagggtaattcgtccggtttcaatagtttgaggtttaatatgtctggttttgtggttcgggggggtggaggggggggcaattcatactgtcgtaaaagttcaggggtgtaattcgtatttttttctttataatactaagatgtgttatataacataatagatttgttttttatggaatgagagagtatgcgttatgccgcacaaattgtatatttccgctgcagtgattcccttcttttcttagcagtattgaatttgtcaatatgtccattcgttgaatcagaagtagtacttaatcaatgaatcaccgaaatgagcctttattctggttcccccaagtttttttgaaacgtccaatatatggtcctctccttgccttgagtttgcgacgtgacgacggcgcattgggcagaaagccgtcggctgcttaggacaagtactatgggtattcaagcacaagcctcaatatgccatataggactaaatagtaaggtggaggagagaagaaggatgagagagaaatagtcacctctcatgcaaggggcagcccctatacaaactttaataaacatgtgagagtgttagaaatattggggattgtgtggtagaggcaacctaggccctgtttggttccatgggctaaacattagccctcaccttttagccctgaattagccctcaaggatataaacaggtgggctattttttggctaaagtgaattagccccgctcaaaacattagcccctccaaggggtgctaatagggtaattttatgtggggaccataaaaagcagctctctctctccttctctctcctctctttcttctctctctcaactttttagtcttgaattagcccatggatccaaacatgccaccctaggctaatgcttagcctagcaattcatgactaaacattagctctcaaaattagacatgggctaatcttccaaacaggcccctattatacatatcacctcttaaattaattatatatgtcatgcatgaaattagatacggtagttacctctactataaaaattgcccttacgggagcagacccttttagcctttcttgttatctgtgggcgacgctacctggatttgaataagacggacggactgttagtataatactctgttaggatctaggatctattatattcgctctctttaccgatgtctagaaggatatgcttccgcgttctattcttgcgactcatcttctactacacctgaagtcttgattccagatggtggggttggcaccctattcctctgcttctcgacggtcctttgcttttcctgaacggagcgcgtgaaatggacttggctggtctgaactctgaactctacacgagcctgtgttgccccgtttaccccatccatgatgcgccaaaccgtcgaggcccaaggatgcacctcaaaacctactgcgattcataggtccaaacgtgtgaaatcacacatactatgggctaatagtaaaacacaagttttgagcttttctgaaagacagtgaggtgctgcggtaaccagccagtcggtgggcgctcatgtggcgagatgcgctgaggcgagagggacgcagccaccaatgaccaatccacgcgccccgctcgtgagctccactccagcgccgccaagtgctcgcgatgggcgcggcatctcacacctgtcgacaccaggttgggagttcgagttgggaaaacgcccggtggcccgaggagcagcgattccgcgaggacgcgcacacgctttgcatccgagagcagtgttgccatgacacgcgcgcgcgaatcaccaatgcgaatgaagaaccgtggcgtgggcgaccgtcacgttgttccctttggacagatgagcgctgatttgctgaccgtctcatctcattgccttctatgtagacaaatatatttggatgagctgatccaccatgacccttttaaccacacgacaatgcatacgcgattgtttgctttcgaacagcgtagacaatttttttttactggaggaacaacaatgtgtacaaatttgggctccttttattttaagtgttgaatctagagaacgtgatagagatcaaatgactcattttggtcatattatatggtcaaaactcaaaatcccacaattaaccatgacgaacacctgtcaatttcgatgtgagaatatcctcctgagctcaaattagccacccactattcacaggttgctactctgtgtcctaaacctgacacgaataagcgcctcataagagcatctccagcagagaccctaaatacaattcttaaacagtttttaggtgctaaggacaaaaaataaactccagcaaagcccttactatatgccctaaaataggaaggacctcaaatacccctccgcagcccttaggcctgggggctgtagaccgaggccctatcgccgtttttctacgcgggaggaaatttcctggcgtgtggtgtctgtcatccctcccgcggaatcgctgccacggcgccgatcttcgccagctcgctggttccgccgctcgtggccgacggtgcgaccatccagtacctccaccggccactgcttgtcgtccgcgtgcccgcttgcttgttttttcatggtccttgatcagttcgcacactgatgcactatatggtaaacaagaatgttctgaaattcatgaccatcagaaacatgttctaaacaatcctgctctcgattggtttatggctaactgtggttctaaatgatcatggcataaaaaatattgttctgttcctttaaagtttgtggtgcttggtaggttgagacaattaggctgcttgcaattatgcagtagttccttcaaagattattctgcagtgttgttcttttgtgtcagttgtgagttgaagtttaacttcaaggttttttttttctaggaggatttaagctctttctgaagtttctcagatagattagattggaaaaggtatagagttaattttatctattgattatacttcttatttaattgaactacgtagtgtcttgaatacttgccggtaggatttcactcccatgtttgagaattttgaatttgaattatgatatttaaaattatggatttgaatacaattgaattctatgcattagaaatatttgtatttgaattattactatgttaaactaggtgtaagcatagagtataatcagaaatacaagagaaaaagaaatgggggctaagaaatagggtctgctagtagagttggagataatttttgaattcttagtaaatggggacagccctcatttaacctttgatgactctaaaatagtgactactgatggagatgctctaagtcataacccagccatctcatcgttaatctctcggcggccggctggcagcagaaaccaccataccagaaaccgctcttctttccccttctccacgcttcgcttcgcttctctcctctcttcgccgagaaatatttaaaccgctccccaccggccacctcgtcggtttcgtccggtaagagaaaaccgtttcttttttttggcgaatcgcattcgcgcactaccaaacaccaacgcgagctcggaaagctactgatggcgtctcacatcattctgccgaaggaggaggaggcggcgctgggcgtggcggtggaggaggaccacgactcgccggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcctacgccaagctcgaggagggcgactacggctacctcctcgatgacgtcccgcacttcacggactacctctccgatctccccgtgagcgccgacacccctcctcttcccactcatccttgtctcgcgctggttgttccgctgccagattcgacgcctgcggtgaaaaaaattgcagtatgcagtgctgcttgagattttgatggttcttttggagacgcggatctcgtgaaagctttagatttagttctgccatttgtgtgaggtggagctttatttggatggttcctttatttttggtgtttttggcgtgtcatgccggggatgggttctggaatgagatccatttcggttgttctcagttcattagctggatatttatcaaacagaaaaagtcgcattagtgtaggacaagtacagctttggcgattcgtacctgcaattgaggttgtggcgtggatctcttaattacttgtgcttgtaggtatctggatggaggtttgatctggtagaaatagaatagaacatagcttcactttggaagtaacttctgttaattggctggctggctgccttccctggctcctataaatcagctacatgtgcatcctttgaacgtggaatacgcaacaactcatttgtttgccttcaattatattctgaaatgttgttttcaaggtgatgtcatgggggttaagctaataattttctcgtttactgtccctggcagacttttcctaatccactgcaagatcatccagcctattcgaccgtcaagtaaggcttctctttcggtttgactttgctatcccctttggtcaacctcgtcatatttattgtgaaatgttttaagctaaatgttctctttgtacatttaccaggcagtattttgtcaatgcagatgatactgtacctgaaaaggtgaaaaaaaaaagtctccactgatgttttgatgtgtagacgtaattctgaatgatactcaccctgatgttttgccatcacaggtggttgttcagaaggacagtcccagaggagttcacttccgtcgtgctgggcctcgtcagagggtaggatgccttggatatatgcctattatcatttaggggcatgcattacccacatttaggctgacacaaattctcaaatcttatcaggtgtacttcgagtcagaagatgtcaaagcatgcattgtaacctgcggaggcctttgccctgggctaaatacggtcattagagagttggtgtgcggcttgtcccacatgtacaatgtcaatgatatcttcggcatacaggtttgaaatatttccagctgacctaaataccaaaatgtattatgtggaatatcacttagtaggaattttgaatggcgtgttctgctgacctataatgaggaaatgatttcaattgtattatactcaaatagttgcaagtgcgatctgtgaattgtattatatttttgtgcaaacgactaatgtgaaatttgtgccagctagtagttttgccatgagagtaaaagactgtagcatgcacattggtgatgccaattttttaactgcacctttcctcttatttctaacatgctataagtaattctgtagaatggatacaagggattctattcgagtaattatcttcctatgacacctaaaagtgtcaatgatatccacaaaagaggtggcacagttctgggaacatcacggggtggtcatgacaccaaaaaaattgttgacaacattcaagatcgtggtattaatcaggtaggtgttgtaactatttttcttagtataataatccttattttgaattttgggtaaaatatgcctgtgtactttgtctaggtatacatcattggaggggatggaactcagaagggagcatatgaaatatataaggtaatcactatcatgagtaacttccatatcttgtagagacctccagacattgtcaaacttcttcatctgttcatgtgcactctggcagcaggaatttgttgagtggtgtgcatttggcttaaaaattgttgtatgtgcagtgtgcatatcattagaaactgagggaaaatattgttggagttttgtttttcagaactgatttttaatttgatttttccctttttcaattggcaggaaattcgtagacgtggtctaaaagttgctgttgctggtgttcccaagacaattgataatgatatagcggtaatttatgattacaagcgtttatttttgcctgcaaagaagcattacaactcttttgatactgcacaatttttctattaaagaagtactgattttttctgtacattaaaactcaggttatagacaagtcctttggttttgatagtgctgtagaagaggcccagcgtgccattgatgcagctcatgttgaggcttcaagtgctgagaatggaataggcttagttaaactgatgggtcgctatagtggttagttttctatatcagccccatatacgtctttgctgcagctgcattcttacatttctctgctcccttgtttctttaatgctttaattggataaatatgcacgtaaaactaagagaactatattttgcttatatactctaattcaagagaactgttcatgaaatgtttattttctgcctacagaatggaattcacatattcctcatgtgaatccatgatgaatttctaacttttttgttttagttatttcattatactgtccttattccttttctatggtaccttgcagggtttattgcaatgtatgctactcttgcaagcagagacgtggtaagttaatgctttatatctatgtcgttctttagtttcttcgagtcaaatattctgtgtattcatgttctgggtgcagtaatgcattggaccacctagcattcttcttctccacgaatggtacctcctattcattgggtttctctgtcttctataggactgctgcttaattcctgagtcaccattttatttggaaggggagggtggactgtttgagtacatagagaagaggttgaaagagaacaaccacatggttattgttgtagctgagggagcaggacaggatcttattgccaaaagtatagctgcagcagatcaaatagatgcatctggaaataagctacttcttgatgttggtctttggctgactcacaagattaaggtatgcactgtctatttacttgagtttgcatgggactgatccagttcgattttgcattttgttgatagtgttgcttcacatgcgctttatgcattcatcttttaaatttccactaaaactgcaagaatgcttgctgaacaccaatgcatgtggtatttgcttttgggtttggaaatataccataggaaaggtagaaattcatacctaagagcagcattacattaaacaattttaactataaaagccatactttttatatgttcgcctgttaaaagcgatgctttttatatgctcacctgttaatcaatagaagtaagtgtaggttgaggtttacgttttgtcagttcgatgttcaatcacagttaacatatttagccagctgtatctttatgtgagtgtggtcctgttcacggattgcattcatctcttgtatgtatgttctgtaattcataatagattaggtgcatgcgtatgtaaagcttacatggctctgtgctcagtgggtcagctgcctcggtgttgagccatacattgattttgtacagtgttagtatctcagtgacccattatgtttgtagttgctatttttagtatcttatggatttccaggatatcataaccaattaattaattacaagtttccttgaagatttctctgagattttttttttgcatgaattccttccaggattactgcaagaacaaaaagatggagatgactattaagtatataggtaaagatcttgtttttatgttcaattctcgatgcacatgcggagtgctagtttgaagtactactttttatatgtatctgagtatctccctatggaatgttgcaataacagcctgttatttctaatggcagatccaacctacatgatccgtgcaattccaagcaatgcatcagacaatgtctactgcacactgctggcgcacagtgccattcatggggcaatggctggatatagcttcacagttggaatggtcaatggcaggcatgcatacattccatttcacgtgagtacaaatttttgtattaccttaattttctccggttcccagattcaaacatattaccctcaacaattatcatgaattaaatattaccctttaacagttcgcatgacatcaatttttgtgttctgacaaacagagggtaacatcaacaagaaacaaggttaagataaccgacaggatgtgggcaaggctgttgtcctcgaccaaccagcccagcttcctgagccagaaggacatcgatgccgcaagagaggctgataagctagccagcaaatcgcctgtgccagttaacaccaaggagcacggagagaatgtaaagaagccggcaaatggtgagaaatagcatgcctttgatgattctttacctgtacagtagctacgctattcggctgaggccatgaaccgatcctactcaatttttgttttcgcggttcatctccgatgcgttgcaatggatacacgcgaaaaggatcttgatcgtctacgtaataaaaaacaccacctcatatttttgtatcagagaacatgtgtgtagcactacgcactttgcaagagttctgcctattatttcggtaagagaacttcttgatttttgtgttctgcaaccattactttttctctgaagctaagtttgttttccttaaaaaaggaaagtaaacaaagataagaatagaagagaagcttgccatgtttttttcaaatggccgtttaattgaagatggtcgtgggctcgtggccaactcggcaactacttcccagctgttgcatttgttcatcggaaaattgttgatgatccaaccatgagcctggcacgtcaaactttggccgttgacggaaatctgctcccgcctcccatagaaaccacggatgcctcctcgcgcgcggcgcgaaatcacgagttcacgactacacgagggccttgtggtcaccgtcgccggccaccgcgcgcgcgatctctcttttttccagccgccgtccatgcttctcctcgcgccgttgcttcttcagccgaagaagcgtcacgattcttacttctgcgcagttgatatgcagtagtttggccctcacatgctctatctttctcatttcctcgatcgctcacgctgttactcttttccatgcatgcgtgcgaccaggagaaggctccagcgacgccgtcgtccaagagccgttcgccaccacgcctacttcgccggctgccctcgccgccggcgccgtgtcgaatccggcgctaacaccagcagcagtgtccatgtccttctacgacgtgaacgctggcgagcagccgagccgagaggacgaagccccggaggaggtggtagaggccgctgtggcgaacggagcaccgacggccgtggagaagcataataagctgtactctcccgcagaaacgccggcggggagtgggacgcggccgcacccaaccgcggacgccgtcgccgagacggcgggggcggcgcccgatgacgtcgacgggtgcacgacgccgccgccgcggccggtgcacgactcggaggggtccgacacgcagagcgcggacgatcacggcagcccacagagggagaagccaaggacgacatcgacggccgggggcgtgaagcgggacgtggctccctcctggtcgtcgaggctgctcgcgttccggtcgttctcgcgggacaagaaggcgaaggcaaccgtggacgcgcggccgccggcgcacggcaaggcgcgggatgagggcgatgagcacaaggagaagggcaaggagaggcggaaacggttttggaagtgaaggtggcattgatgcatgcacagttgattttctttgattgatttgtttgcactccatgaaataagtgagggctgtgatagtgtaattgtgatattacagagtactaatatataatcattctttgatgcaatccgtgttttgtaatcctaagcctttttccactggtttggttgcagctatgttactctttgaacacatgtctggcggaataccagaacgaatcatgaacacggcattctagacgaatatatcgcagtgaaactcggagaattgctcttgccttctcgctagaggtgagtaccgagtagaacggtcgattcgtggaagcgctatcccgcgtaacagcgccaatgaccagcgtgtgtcgtccttcgctttcacttttcctttcccctccccagcatacatgtgtagtgctcgatcaggtcgccagcgaccagcctgatcaaggctgcaggatatgaaggtcactcgtcgctggacaagatgacagtatagaatttctacttttcatgatggtgcagggggtagtagaattaatctccgaacctcgccagccaagagcgcggctaactgaaagtctgaaaatcaatcaagcctcagagtcacactggcaccccaccccacgccgtgatgactaccttcccgtccccaccacctcctcctactccggcgaagcggctgcgcgacagcgcgaggagaacccgtccgccggcacggcacgcgcgctcgctcaccgggagcgtggcggatcgaagcggaagcgtgctgccatgatgtggtgggtgtcagcggcacaaaaacggtatgggcatttgcaaatttgccacctgttttttcaatattgcaaggataccactcgaatgataattctagtggtatttttataattttctagtggcagttttgtaataacgatttgtagtaaatttgcaattgcctatggtatttgacgatgggttgggggttcagggaattgaactccgaccccacaagattgatttactacgagtacatgttaaggatggttgggtgttgggggaaacttcgacccccactatgttatgagaatagggcatgattgatttgatttgatttactctaatttgatgcaattctttcatgttaagatggttgggattggggaatcaaacttcgactaggttgtgacatgcattgtgcacaattgattttctctgctttgatgcaatcctattatgttaaggatggttggtttgatttgacaattcatttgagactaatcgcaataaaatttgtgttaggaccaatcgaccaagtatagcctgatcaattacagtggcatattgttcaaatatatcttacattaaacagctaaaacatataaaacccttctccagcaggcgaaggctagcccccctcccccccaaaaaaaaaaagaagagagagagagagagagccagggccacgccatgaagggcgagaaaccaacacttatcaagccaataagttggaactccgttactttgatccatacttggtggacaacgttagctagtacctcagagatgcctaggaaaagagtctcctccgtgttgcttaggagatatggaaatatttgatccatacttggtggacaatgttggctagtacctcaaagatgactaggaaaagagtctccaccgtgttgcttaggagatatggaaagaaagatatgacaacgttggccagtaccttagagatgactaagaaaagagtctccaccgtccgtgttgcttaggagatatggaaagaaaggaatcagagtgtttcaacattttttttaaaagtttttttacccgacttctatatccaaccagatatattcagtttttttttaaaaaaataggaacttagttacggagatttgaactcaggaccttggggtgccttttttttttttttaagttaagaacgatttgaactcagaaccttcggatgctacttaagtcactgcaaccactaggctacatgctctttcacagagtgtttcacaa

SEQ ID NO: 74717 - DNA, 139468 bp, Oryza sativa
caccaaatgtctattcacccaggaacagcagaaccagaacaacaaaatcttttatcagatggatgtgagttgtattatgaaggatttcagcagtagcttcatttcgctgctagtttttggatgaaaaatactctatctgggacatagtagtagtgcagcaatgctatttttgtcaaataaatacttaaatattttataagacatatactattgttcaggtatttgaatagcttcttagtataacagaagcttgctttgctgtagtattttgctctgctctgctctgcttctgtcagttgatccatttcttggcgccaaaaagcatgagctttccctctgctctatttttgttctcgcgcgctttgcccctgagattctatttgctgattttctttgaaagagaaataagtgattctgctgattagtagtccctaattaatcacaaatggtgggaccactgcatgcatccgttgataaaaagatgtgtggcagggatgaatgtaacggcaatgtttgccgtcagccaaaacggcagacgatgtgaacccacttcggatcggttagcgtctggttttctggagatctgatctacagaagtttccttggaatgtttacgggggagaaaaggactcggttgaaaaaaatcctttataaggatcgatttgctaaggttttgatagcgttgcagaagatccaatccaaggagagggagatgcccgagttagcctacattgtcagagaggttgcagacttgctttctggaaaaagggagattttgctttggaaaattcattgtagccaaaatcttgttagtcatacgctagccattaagggccgctgtgagtccctttctagattttgtttagaaaatgattattcttttatttctcatcttgtaagcgaggactattatcctgagtaatatattccttttcctcgcaaaaaagaaaaactaatttccaggtttagatactattcaaagaaatgttcttctccgaatcataaatatttgatttttagtactatatctgaacaaacttttgaaactttaacaatcagtaattttttaaatatatagtttaaaacaaaaaagctatatgagtaaatcgcattggcggtacacgaacttatcaggtatgtgtaatctagtgcactaacttataaaacaattatttgagtaaagtgcattagcggtccttagacttgtagggttgtgtcatataggtccctaaactctcaaaatacatatcaggtcctaaaacttgtcaaagtgtatcatttaggtcccaaatcgatacatcccctctagaatcctacgtggtgctgatgtggcataccacatggacgtgacgtgtcctttttattttttttcttcttttatttttctttttcgttttcttctcattcttctttttttttcctttcttttgctcgggtcacagagaaaggagacgaaagggaaaaagaaaaagaaaaaaaatttaaatgggtcctatttgtcagtcaaaatgatgccacggcatgtccatgtggtatgccacatcaacgccacatagaatgctgaaggggttgtggcgatttgggacctatatgacacactatgacaagttctaggacttggatatgcattttgagagtttagggacctagatgacacacccctacaagtttaaggaccgcccgtatactttactccgattattttgttgtacgatcttacctagggtgcacgaaccaagattagaaggacattattacatggctaatcttatagattttataggtgttgattaggatactatgcaaatatatactcactctgtctcataataaaaaggattttggtggatgtgacatatcttagtacaataaaactggacagatagtctgttcagatttattatatcacatctatccaaaatcccttatattatgggacaaagggagtatctaaaaagtttgccttttaggtcctgttcgtttcttctaccatcataggattaaattttggatacttgtggcgcgcttttcaaactgctaaatggtacatttcgtgcgaaaattttctatatgaaagttgctctaaaatatcagattaatccattttccaagtttgtaataattaaaactcaattaatcacacgttattaccacctcgttatatgtgaaacacttaatctttatctttatcttcatcttcatcttctggagatttaaacaccaccttagacatgcatatattcagtaaaaagacaaaatgaggcgtagtgattatatagaactagacaaagatatgaaaaaccgagctatgatacatgggttagaaacatatgaaattcatagtttcaacgatgaaggaaagtagagatgtttataattatagcttgtcttatgcatactcactgtatgtgtgtacgtcacatcctaattaacatcaacttgataaaattaacattaccaagccattttggtccttgttcacacgaattagacaatttcgtgtatcaaagcgagcgttctataagttaggttaatgtactaaattacattcacataacaaggttatgtatcaccactacaatttactcaaactatatcataataccatcaactcatttttataaacctgtcttactataaaatcagtgcccaaagtatcaaaatttgaccataatttatcctaaatgtaaaaaatatctacgatcgattggagaatacatataccatggcaaaaggttcgagattcagatagacaaagaggcaattgcaaatttaccactattttgaatcgttattgcaaaactgtcattagaaaattacaaaaataccactagaactattattcgagtggcatccttacaatattgaaaaaaccagtagcaaatttgcaaatgcccccttagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaatgggcaactcactgatcactactgacgatataaaagagcccgaaaatctgcgaatcggagaagagatcccgcacggacacggtgggccggagcaaaacacagaccgttggatacgaaatggacggcccgaacgagacccaggatataatacgcagcgcagaagaaaatcaaacggaccaacacgaaaaccctcctcctccgcccaaccccattccttctcacccactctcttctcccgccgccgccgccggaggaggcggctcctcgtcgtcggcctcgacgaccatggcacggatcgtgtcgcgcgccctcccgttcgcctcgcgctcgccgcagctcggcgcggcgctgatacgctcggcgccgatgcgctgcccgcccctccccgccgcggcgcccaccgcctcgctgctctcctggcgcgggttcacgccctcctcagagccctcgcgctcggcgccgccgccaccgccgctgccgatgccgcccttcgcggggttcctcgccggcatccgaagcttccgcaggggtaggcgcggccagtcggcggcgaggcgtgcgcagccccaggaccccatcccttcaccccctcccgcgccgaaggagagcgagatcgagctctacgcgcgaatcggcatcgacgatgacacgcccgaagaccccgaagtgctggtacgtacgctactcgtggaacttctgtgccaataatatgtggctgttttagatgaagtcaccggaatcacagattgaaatgttcacaagctatagcgcggcattctctggtttactggatgatttatgctcaatcgttgttgtactatttctaatcaatgtagaaagtcctgacttttactcttgtgatttctgctccagtccttgtatgctaatttatggttagcatatcgtaactgttgtcccgaattggttgtgtttgccattcgctaaaacgaattgcacccttcaggcagctgagcatacactttctttgatctagaggtaaacaagtgggcaatgtagtcagaaatcttcgtttcaaaggaagaaaggtagtcagaacctaagttagcaggtattttattatgacgtgatgcagttttgaaattggtttaggcttaggcatttgggtatcggattatgtcgttttgttgtttgattttattcatcaagttatagtggaattccttggttgattttggtttagtagtttatatccctccgagcaatctgttgcatattttgccaataaaatggtgtgctagaaatgttgcattttcaatttgtgacgttttttgtttacttatgcttctggtaatgtgaatgcagaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagaggtgaagacagctgtattgaaatgctctcaatgtcacaatacattcctgatcttgatgttcctattgtaaggaaaaaaaatcctttatttgaatgctgttcttttagacatgccatcttgttgtattttctgaatttattttctcgcagctaatgttaggtgatattgtaatctcagttgagacagctgcaaggcaggctgaggagcgaggtcatacacttcttgatgaagtgcggatactagcggtatgctcacttgcttattgactgtcattagccccctaccgtttagaggtttgaatacacatgttatctttttcttggtgaatatccaacttccttttaccaaatcacttaatcctatgttattctacacatactaaaacacagataatatggtacaaaattgactgtttacttactctgtattaggttcgtggaattctacgtcttctgggttttgatcaccaaacaagtcatgagtctgcagttgaaatggagaaggaggagcagctcattttgaagagtctaaggtggaaagggaaaaatcttgctaagagtgttcttgattcgggcaagcgtcatacagaaacatcggatggtgtgcttttttgagatttctgtagttataatcctttccattattttgatcttgaaaaggtgctttcacacacatgatgataatgtagctattgctgcctaagaatgtttacagggcaagtgacaagtggtctaaaaagagctggaagcctaagattttatagaccaaaattcaaatatatcttctgtgatatggatggtatatcatttgctctttgcatatatcactactctagacatgtgtttatatttaccagtgatattttttaatttaaaaaggtacactgctcaacagtaaaagtcaagttacagcaaggaatgcagaagctctgagggaagcaaggtcaaggggagtaaacatagttattgccacagggaaggtactacaagttcttcatttctgtaataacttaactgtcccttgccagcccaggccagatcttctggatcaccctgtttccaccattgctgcatccttttccaagccaagccagattcaagtctcaattataaaacttgcattacgctaatcttggtagaatatgttaataaaaatcctctatgaggacacttgatgtttattgttttcattttatgagctgaaaggaaaaaattactacaagtagacaatcaagaataccctctgttctgccagcctatttacgtttggccctgtcatatttcagtaactcaaaatgctgataattgtttctcatacatgttcattttggaaataggcacggccggctgtcattgatgctctcaatatggttgacttgtctggaagaactggaattgtctcagaatcatctcctggcatatttcttcaggttggtggaaagtattcatggacaacacaatatttcaagaaataactttaggatacagtggtgaaaatgcggcatctttacacttcctggtagcatataatctaataggttgcaaatatgctaatggagatccttgtatcatatttttgactgaagagtgcatgccacttgcattgtgacctttatggcaccgtacttaaatctgtgtaaaatgaacaaaattattgaatgttttttcttttactcttaatttacgcccttttttcttgaattgagttaaagcgtgaaatttggttaagtgacagggcaatcattcttacccccctgcattttaatatctgttgaatgcatgttgcttgcaatacatccttttggtgccctaaataaacttttgatgaaatgaaatatagttgaaggtttatttccttttgcattttaattctttgcctttttcttgtatttgttgagtgaagtgcaaatgttagtcatgagataagtcaattattcttacctccctggtttcaaaagctggctatactgtgttcatagaacagaaaggccgctgctgatgttgcctgtgcagccttgctaattcgaagcttacattctacattttatggaaaagaacaaaaaaaagcatgacagcatcctttgatcaggccctagtggtctgtgcttctgctcagtcctataatgtgctaccctaagtcaatgttaccttgtattcagtatattaatatgcgctatgcctttattttccgagctcagtcaatattaccttgtaacatcctttgatcaggccctggtggtctgtgcttctgctcagtcctataatgtgctaccctaagtcaatgttaccttgtattctgtaatattaatatgtgctatgcctttattttccgagctcactgtttcaagactaccgcgttgttcctatccagtagataagtgaaacagtttattgttcatgtgtgcatgattcccattctcatcagattgatgctttcatctgtagggcctcttggtttatggtttgcaaggaagagaaatttataaaaggaatttagatcaagaagtatgcagagaggtaagctacatttttcttccttataggcattgagaccataaatgtgcatacaagaataatttagatccaaaaggctacactttcagggtttgcctacttaatgatatatcacctgggatgtatctctccagctaatggactaatttagatgccctcttatgtccatttaatatatagatgttagctggacaatgtagagtctatctttctactccatccgttccaacatataagaatttctgcgtgttttccaaaatgaatctggtgggagggatgcccggatacattttgaaaaactcgcagaaatgcttatattttggaatggaggtagtaatagataattttattatcttagtatccatcattaccaatttaagttagcgcttgcactgtgtagtgacactattggcttattgcaggcattgttatattctttggagcagaaggtaccattagtagcatttagccaggaccgatgcttctctatgtatgatgatcctttggttgattctctccattatgtgtatcatgaacctaaggtgtttgctggtccttggtcaagtaaattttagctgtcatattcctattaatttgactgtagttgtgactcttgttgcaggctgaaatagtctcgtctattgatcagcttttaggaacagctgagatacaggttctgtgctctcttaacaatttttagaacactttcatgattagttcagcatgaatcattttaatgttcctttgcttaaatactaagagcatccgtctagatgacattctggttggtgattcattttctcaaaatttgttccaagtggttggttcataaaataagaaactactggtttagttactataaaaatacgggctttcttttggacagggtgggggagggggtgtcctagtcctaccatgtattttacttaaccataaaataaattaggttaatatatcttatacaattggaaccctttaaatgcagttattactcttctcataaaaccacatcgtctcgattgtttctagcctttggatgattgatctaaggtgcagactacacagagcaataaagcgagtcttctagctacaaactataaatccaccttgcatctcatgtctatcgtttcgtcatgcacgtttctggcagcaatgttgtatattacaatctcaaccatttggataatcaaagattaatgttcattgaagcaacttgaaggcaaaaagatctgcttcgcttaattactcaatagatgtgcaaggcttatagaaatgcgcaaacagccactatatgaaccacttccaattgaataacaaattgtgatttgtgctgctgtcaacggcttccgtgatcgaatgccactagtcaatttctcaatatgaaattcgtaatagaaaccaatttatgcaacaaacaagttgctcattttgactgtggctgacattttcatatatggggattactctattagcaatttgacgatgctaagatgtgtagctgtctagctgactgcattataattttcatgttcagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtattagtactttagttctctattacatcttattgcatgacggaatacaattgatgtcatcacctatctagttctttcaattatgaaaaaccgtcatttaaatcttggtcatacatatgccacaaaataaaatatttgaagtctgcactgagttttccaaaccaattgcccagtgatctagcggtataagtagatttaaaatggatattagacctctgatcttccatcaaaccattgaaagcccacctgcaatccttctaacttcaactttatttttttcttttgcaaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccagtgccctggattcaccatataacaagacttgatcaccatctatccacaagataatactgggatgtgatctgaagccctgttggagtcaaaacattttgaactattaggcttcggttcattttttggtttggcaaacattcatgaccagccatgctacaatttgtgtgtctggaatatttatagaattgaattccttttgttttcatctttgatgaccaaaggactcccttaacgttaagctgttcttcttcttcttttaaccaaggcaattggatgtactgcagacatatgctttaaatttcgacagaaggctgttcatcatccccaggcagtccaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactgttcctactgatgatatccgcttttgtttacaggaattgggggaggcctatagagcatgcttttggtgttattcctggccatcagatttgcgcaagaacttccagacttcttggctattgatgtgctgtttgcgccaggtatatgacaagcttcctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttacaacgtccggtggggagggtgggtgtatatatagctccagctgaaatgggataacgctaagctgccttctttcaaacactgcacagtgccctttgactaatataatcttacgcaatttgcatccatgacatcacctatttgttgtgtttacatggactagttaggtcttttccagaacactgacatggacccatgagcatggctgcttgtgtgcctttgtcccagtttttgccgaaataaaagaaagtaatgaaaaaagagcgtgaaagttggttggccacttccacatgctttcccggattctgctgctggtacccctgatctgatcttatcttcttagtttgttgaatgggacccagatttgttcttatatccctttggcaagttggttttctgagactgacttgtaggccatggcatgttatggtgaggatgatgcctcatcatgttaattcttttttgtggggagctgagcgaggacacgaggcgcgctactgttggcttatgattctcgttgcaggctgagtcggtggccgaggtagaacgcaactagatctttcaggataaaccttttcattacttaacccggagtattttggggaaatcacgctaatagtagaactttggtgccttcaattttttactataacaacctgttgtttttctactttctgaacagttcgaaatggtgagatttctaagtagtattaattccgttacgtcgacgagggaattacggctcttttagtccttgataactgccagaaaatactcttgtgcctcctaattcgggacaaatttcagcatacgaacagtgtgagtggagcactagctgcacaaggggtcctgtaagttaactgttaatttacgtaatctcgaacagtcttagctttcaaaacagagacctttttcctcatttccttcaggatcactgctcactggttccccacatactcatgtttctcgtttcagcaatgggtaaattgagattccatggacccccaatcagagttcggtgagtaacacgtgtatggttttccgcatgacaactgtgattgcacttcgctgtgttacttagcctccattacacgcaattttgcgagagaaaacgagaggcaactaacatacgtccagcgctcgaaataaagttgtattgcatcgcatcattggtaacagtgctaatgcctgtccattagaactcactagatgctgctcaacttgagctgtgtttagttcagtgtaaagtttagattttggttgaaattggagatgatgtgactgaaaaattatgtgtatataacaggttgatgtgatggaaaatgactgaaatttagatctaaactttggatccaaactttagatctaaacacagccttagagaagccgatacacgttcctgcggtaggatactgtcgatcttagccacattgtcatgtatctggggtttctttaagacttgagaacttaatcaagtattttgatgtagatagtataatctacaaacgcatatataattcgacacgactaggacctaacccaacgcgacgtggtgagctgttcaaaaccggacacctgtcgcgcgatccgtgtacgcgccaaggtgcatgttcggtgggcgaaaccaacaacagcacctcgcacgtctgccattaacacgaactcctgataataatctaaaaaatgcttttataaaccgacgagacagaatgccctgggtacacatggcacggacagcatttccggggacatggccacaggtttgattagtggaccaacaaaaccggcgacatgctaatctcttactcgtcatctcgtgtccgcgtgttgctctgcacgaaggctgtctgtccacgttctagagatgcaaattgtgttgcagatcaaagcccagaaatgcgctcctgctgtctttgcacttttgatcgcttttttcattttgttctcgagccaattgcatgtcctaatccgtgccattaacctcagatttgtagtcaagggatggctgcttagaatctgtactatggatattgatgcccccttatccttaatcctccttatccaggcgtggactgcttcaagcttcgcgtggtgggcaagatgaaaatatcatcccaagtagtgttccatgacgtctcactcccgtagcgaatttttgacttgtttacatagggtgagtttgaggaggaggagattgagaagattaggaagatatgcaaaatgagatgaaccattagcgcatgattaattgagtattaactattttaaattttaaaaaataaattaatatgattttttaaagtaactttcctatagaaaatttttataaaaaatataccgtttagtagtttgggaagcgtgcgcgtgaaaatcgaaacaaactcactcactttcttccgctgccgaacgcagccatattgtgctcgtggttggggaacggagcttctcttccggaaacattcaaacacgagcttgctacaagtattattgagctcgacgtacacgtacgagccttcctcccggctgcatctatctcctgtcaggtctgaatttttcctcatctagctaacctttttgttgcgacttaagactattcccaggtagaaataggatttttcctctagaaccttttcgtgcgttcaaaacgcgtcgaccctggatagagcgcaagccaaccaaccgcgctctgaccggcttggctcgcgcgcgcggaagattatcattggatttggaacaacacatgtttattccgctcactaaacatgaccggtggcctgggcgagagccatccatcatcgatcacccaaaagacgcgtttggctcgtagtcgtcttataatcccaagcgataagggttcgcggatcgtgccgggatccggcgaaagcgaccgagcgcagtagcatcgcgcggcgcgctgaaatcatgtggcacgaggccggagggagcctgcgatttttgcgtggaccacggctgtactacctgtccaggccgcgcgccagccgccgggaacgtggtctgcgcgcgctcggacgaaacgcgcgcatgtggatagctcgcggggatgggatcggctcggcgccgcgtcgctgttcgcccgatttttattttcgatctcttcggcggatctctcgcctgttccgtgcgaatccggacgggcgggctgaaccgcctgtgcacaagccaggcttgcaaattgcaaaccccgagacgcgtccgcgtctccgcctctcacgcgcgcacgtccggacgcgccgcgcggaacctgacgattttttttttgtttccttttccgtatccgaggggcgagggcggccaagccaagccggcggccgcgcgcgcgcgcaggcgacggcgtctccactcgtcgtgggcggtcgactcgcctactataatcggtgagcgatccatccagcacaggaaaagccggaaacccgggtcgtctctcctacagcgcgcgtggagagatgtaccgcggctcgtgtagggctcgtgcttggtcggagtctgcatgcgggatgttcctcttgggttgggtgccgtggccgtcatgggagcggactccggtgctccactgtagtggatgggcgaaccggaataaccaaaaagacgagaaggacgtgaaggctttgatgggcgcgagcccagtaagagcaacgtcaatagccaactattgactcaaaacatctaaagccaatctaataactcattcatacaataattaattataaaaatatgctacaccattaatatctggtctcacctctcatacacacgtaacatcttggagtccgtgttgcagctggctacaaatctgtagcccgctttcttctctcttctcttttcttctcgatatatggttatagccggcttatagcctgctattgtacatgctctaacagtggatgccttagggcacccacaatggttatctataagctctctacaacagatccatgtcagcatattttcctacttagaagagattaaatgaagagatagagcaaagctatctactaacatggaaatagtttatagagaaaaacaaggcaatggattagagagctatagatacccatgtagacataccattgaagtggtttattattaatttagtctattgctgagatgtacatattttatagatagcacattactttaccattgcgggtgctcttatgtattccgttgagacattgcaacggattcattcatgccgcgtgcgaatcctgcacactgtataactgcatgcgaatcatgtgtgctaggcatgtaacatactccgtatttctttgtttcagatagttgcgtacagggttcgctaaaccgttcaagatgagcttatcatatcacacggtttaacggatattacggtaaacacggttaccacaaaaccgtacggttattacgagatatacagtggtttaaaaaactttaaacgttattacacgtgataatcgcacaattttataaaccctaccatccctagggaaaaagtacatttgataaaacaacctagagtaagtgatataccagatgtggctatcaccttcaattttatccatatcattcaaacaaaaaataagaggcaacatatacaatatgtcacctctaatacacaaataccaatatctctaatactctcataatttttttaaatttgtgtggaggttgactcttgatttaggctcaaagtaggtttatagtagactataagtcaactgtaaacttacgtggaggagaaagaatttttaaaaaataaagaggattgtctccaatgcaatagctagttattcacatatttcaaatatattaaaggcatagggagagataaagagagagaagaaaaatagagataaaattatagctttttctactataatatgagctcatagttggctttagtattgaacttgctctcatcatctctctccccacttctctcctccaactcatcgctcaattatatgtgatatttttaggggcaatacatgaatcattataacacttgctcttagagcaggtacaatagcaggctataagccagctacaaacatattttaaggagataaatcagaagagagaagagcagcgggctacagatttataaccagcggtagcacgtactctaagatgcaatgtgtgtatgacaggtgggaccagatattaatagtgtagtatgtaactattgtatgaatgggctattagattgaccatatatgagttgaagctactatttggctatactattaaacttgctcatatgagattctatctttttaaggaaaaaagagctaaaggatgtgttcgttactccagttttttatcttttactttctcattttatttaaatgtgcttccgaacaaataaacaatgtgtttttcaaaaaaaaaagaaagttatagagttgcttaaaaaccatattaatctttttttctaagtttttatgaataatacttaattaatcgtgcagagcaatattattttccgtgtgaaaggaaagattcgatgctgtgtaatgccgaacgcacccaagcctctcgtcgaagcttatctaccgtagttaaattttaaaatttaaatgttaatctgagaatagaatttggtgttattttcaccgtggtccatttcttagcatttattttaagccgctaataatatactctctttgtttcacattgtaataagttaatctaggtttgtcatacgtcaaaaaaaaaattaaactcaaccaatttaacagaaaattacaaaaacatttctgacataaaataaatatactataaaatatattgattgatggattcaataaaaatactttagtgttatggatgctaatatattttttctataaacacccaaagtaacttataatatgaaacgaacagaacagagtagatgtgtgaaagtttttgctataaattattttggttatctttttgcatggcttatcagtcgtacctcaaaagatcaaactatatgcctttcaagatgaaccttaaggcactgttgcacacccgttaacgatggatttactgtaaaaaaaacagagaaaaaccacaacatataacccgcacaattaaaaaaaatcaagatccgttacaaatagatcgaataacatgtggatactttttttatatcatgacaaaatattggcaatgttgaagtctagatggaattggcatcaccaatattttagcaaactatttgtttgatggcatatttttttaagcaaaccaaacatttgcaaagtactactacgtccctcatataagttgttttagttttgttcttagttaaaattctctaactttgattggttttagattattttttaaaataatatttttaaaagaaaacttcaaatgttatagatattggtatattttatttttataaatttggtcaaagtccaacttataacataacttaagcaccttacatcggagataataggtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgaggcgagcgattcgatcggatgggcggatcgattgggttgggttgcattggattggattaggcgcgggaatcaggtggcgacggacgggtggaagttaggacggcagcgcagctgcaagttggccggtttctttttgtatttctctggcgtggtcggctggttcagctagccggtcagatgcatggagcggatagagtcgatttctcttgtacgagtagatcacggaaggaatgatgatatttttcgtacataggcctagagaatttttagggcgtttcgtagtggatgggtcaatgtatggagcactgtgttttaataagacgggaaagctggaatccaagtagaaactcctggagacaccgccgcgccggggggacaagcatcgtgatcggtaggaaggcgatgagcgggagaacaacgatacttgcttaggtcgagtacgttagatcttccgcgttcttttcggcaattcggcccactgaacacggctggtcttgcggcccacagtagcggttggcaatgtcagtttattgacttcctgagctcaagctacgcctctctgaccatggaatcgtttttttttttctttctcgaaacaaaaatacaaacataaagctcgtgtacatacttcccattcgaaacttgagacaggtgaaaattaagcaagggcacgtaaaataaaaaaaatattaacgcatgattaattaagttttaattattataaatttaaaaatagatttatttgatattttagagcaactttttatataaggttttcacacaaaacatatcgtttttcagattaggaaaacatactaacgaaaataaagtacaatctgcatcttaaaaaaaagacctcacttttataagggcccctttgatttggaggaagatcatataaattttggataatttcaatcctatagtaaaatttcatatgaaaacctttgaaacaaaagattgaattatatgttatcttttgaaattcctatggaatgaacaatcctataaagattttggaggaaatttagtaagagctacaacctcttggaaatatccctttgagtctatcttgctcgtccgattcctatgtatttcctggagtccaatcaaatgatcatttttgtatttttcctatattttgcaattctctgttttgcacttatatttctattagaatcctatatttttcctattgctctatttttgtgtacctatgatataattataaaggggtcccgaaggaacacacgcacgctacctctacgtgcatttatgagatattgtactagcacatcttttgattaacaaaatcattataaacatctagctatcgaaggatacatcacctgtgatagaaataaatgaacgtatcgtgtaggatatgtttggttcgatacgatttaaaaaatgtagttttgaattttataaaattttgatagttaccaatccaaacatacgttaaggctcgattctgtttatctgattagatgatagacgatatatcattaggttttgtgatatttacaaacgaatgaactaattattataactattataaagttgaagtgtttttaaatactatcaaacttgtacataaaaaagttctgcaaaaatcgtacgttttactagtaattttgtagcttaacaagcttattcatcatgataatttatcctgtgaaaggaaaataccctacgttacctatcccaacttcccaagtcgtgtaattctgtaaattctctcacctaacaccacacaaaagtgacgaggctttaaacttaaaacactttcgcatgcttgaacgtgccagcttcaaagcaaacagaccctgtgttttgaagggagaaattgcaacatatggtgaaatgaacgacggacgacggactgtgcaatggcccattatctcactgggcccggtcgtgtgctgtttaaccgcagatagaggatgatgaatcttgttaggaagaagattattttacctccctcaagtaagagctgagatataatcgaaaccctcatccacaaaaccgggtcaacttatcgtctactgtaagacacggtttggacattggtttcgtcatacataacggaaaacacaagaataataaaaaataatggacctcgcgtgttagtgttagtaggttagaaaaattaaaacaagttatgtgacacccacatgtcaggagtactttctcctagcttgactcatccactcagtctctatgcatcctatcttggtggagaggagaagtgtaggaagagctcgccggtggtgcatgtagagaaggcggcgatactcaatggagaaagaggagatagagctcgtggccgaggtagtgcttggcattggaaataactagaggctcaacacctttccgaggacttcctcctgttgttccaagactgcctttatcttgggtatgctgtagcccctatgccatcatcgggcctagccgcgcacttgttagatcgatagtacggaagctactcacatcgtgcccgtcagttgccgctgctcgatggactagcacgattgggggcggcgaagggtggcaaggcctagatcgtgagaccatcgttgctgtgcttcccgatagctaccgcctgcgtctaccatcccaaaagatctcccgacgacgacgagtttattttccacctcttctttcctctatctccatctgccaccatggtcgatcttgtgcccgtggcccactcatcgagtactcgattttgccactgttagcgccttgctctttggcggcggcggcctgctcgctttcctccgtcgtagattgacgagtaactatgaactaggacaatgtgccatgtaggagtggataacgagccagctcgcctcggctcattaaccttaacaggctaaaagcctagctcagcttggctcgagagttggctcgttaaactcattaatatatatttaccaacttcacaatttcaattttacaagtttaccatgtataaatataataataaacactactatctccatcacagtattagtgcatccagaatataatgtgatatatcttagaactacgagtcttggatgcacttaagttaggacggagagactatctaataatgaattcactaaatacaaatagtctggatataattaaatgactaaacactacttaagaagcactaagtatacatgaagatatgacgatctcttatattaaaaatgcgtttgaacaaaacaagatagctataagcgcatgattaattaagttttaattattacaaacttgaaaaaaagatatatttgatattttcaaacaactttcatatagaaagttttcgcataaaacacgttgtttattagtttgaaaccaaggtaaaatcttcatttttttttgagaaaagaacatgacctaagtctctccataaaaaattcttaagcatatgttattttctagctttttaaaagagaatgatatatttgtagtcttcatatatccaagacttaaatgaagatgttgttttttggttttgtaattctaggttaaattgataatcagaaccgaaacaaccattttaatattcatttttttacatgtatacgtataattgccttttttacgtagtacttacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgttcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcctcggaggcaaggttggcatctgctacggccgcaacgccgatgacctgccggcgccggacaaggtggtgcagctcatccagcagcagtcgctcaagtacgtgcgcatctacgacaccaacatcgacgtcatcaaggccttcgccaacaccggcgtcgagctcatggtcggcgtccccaactccgacctcctccccttcgcgcagtaccagtccaacgtcgatacctggctcaagaacagcatcctcccctactacccggccaccatgatcacctacatcaccgtcggcgccgaggtcaccgagagccccgtcaacgtgtccgccctcgtcgtgcctgccatgcgcaatgtgcatactgccctcaagaaggccggcctgcacaagaagatcaccatctcgagcacgcactcgctcgggatactgtcccggtcgtttccgccgtccgcgggggcgttcaacagcagctacgcctacttcctgaagccgatgctggagttcctcgtggagaaccaggcaccgttcatggtggatttgtacccctactatgcgtaccagaactcaccaagcaatgtctcgctgaactacgcgctgttctcgccgcagtctcaggatgtgattgaccccaacaccggactggtttacacaaacatgttcgatgcgcagatcgattccattttctttgcactgatggctctgaactttaagactctgaagatcatggtcaccgagacagggtggccaaacaaaggggcagctaaggagaccggagcaacacctgacaatgctcagacctacaacactaatctcattcgtcatgttgttaatgacagcggcacacctgcaaaacctggggaagaaattgatgtgtacattttttcattgttcaatgagaacaggaaaccaggaattgagtctgagaggaactgggggctgttcttccctgaccaaagctctatatacagtctagattggactggcagaggcaatgtggacatcatgactggaggaaacattacaaatgcaaatggtacttggtgtgttgcttctgctaatgcgtctgagacagatctacagaatggtttaaattgggcatgtggaccaggcaatgttgattgctctgctattcaaccgagtcagccctgctaccagcctgatacattggcatcacatgcttcatatgccttcaacagctattatcagcaaaatggagctaacgatgtagcttgtgactttggcggtactggagtgcggacaactaaagatccaagtaagttgccaccattcgtatgaaatctatatcggttatagtaccattttacaattcctatgtactacctactagtggatgttttggtgaggtctgcatcatagtgttgtagctcaatgaaagcatataactggaactagcatgtgctgattatgacctgtttatgatggtaagtggtaacataggtccttgaccgaaattgtagtgatagctgatagataagctggtaatagatgctgcaatactggctaaatttctgacttgaactaatattcaaatgtttatggtttttggtgacatggataatacatatgtaagtatgtaactgtaataacatgcttgttgtcaatttgagttgtccgttatatttttctggttcgctgttctcttgtgcattgctttgtcttgcattatctcttgggagtttgctaagtgttgataagtattgttgatttggcatgtatggtattcatgctctgctctatttcactagttaatagtattctcaatgttccaactctgttgatcttgtggtgagaacactaataatgttcgtaggaaattcctagcccttgtgcatggatcagcacatgcttttgtaaatcatggatatcaaaatttgatgatggatattgtgtattaatatgggttaccgatgggtaggttgctggtccttagaccttagtccttcaaaatgctatgtggaagtggaacaaccttcaagaccaaactaaaattataaagatattgatggttacatccatgccaattattgttacaatggagattttgcatacgctcgattgtttagtactactagaatataagatgaaggtatattgaaatgtgatgatgaattgttttgcttgcgtgcaggttatgacacttgtgtttatatggctgccgggtatggaaaagctttctcatatctttgttcaatttttttgaagcattttttcaccaactcctttgagaaatagttctgctgactattgttttttcctcccttgaaggagtaagatgagcacaacaaattcatccaaccttccagttcaaagtgggttcagcccatcgcgattcgacaaaaacttctacctgttgttctccatgctacccattatgattgctgcatgcattgtgtgatatgttcggagagagatcttgcagaagccttttgccatggaggatggaacggtaatcgcctgatactggaaaccagtactggtttgtttgtcatagttagcggagtgttgtagtatgactatgtagtaggaaactaggaattctcttgccttgcgcggacagcatatatgagttagcattatgaactaggaacattgcagatgatgtctcttggtagttataatcctattatgctcgctggatttttcagtgccactaattctttgctgctacctttttttggggacatgtttgctgctattcttcacatgatctgatcatcacatataataggggggctaatgggcgattgaccgatcggtttgccccccccccctccccctatactcctccctcttctcccccttcctcctccccttcttctctttctactacagtacaccacacaattttttttaaaaaacaaaagttagaaaaatttatgtatagaaatactatatataaaaaaattgaatttaaattcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcaccgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatggccggcgtcggagaggatggagatggatttcaggagattgatttcccattgtgattatcgatggcctgcattgctccatcgattctacagtgaggacggagccgagcatcggggaggcggccgtggggagggtcgcgcaggggaccaaagtcctggccgagggcggtcacgatagaatattccggtatgtgttcagcgcgccgcccgacgagcagctccgcaggtcctacgcatgctacctctccacctccgctggcccacgactgttcctcatccgccgggctgccgccgtgcttccccactgcggcggccgcggccgccggccgccgtcgcggcgccgccatcctcctctcctgcctcgccccgtcgacgcccgcgccgtccgcgcacgtccgtgcctccccgtcgacgcccgcgccgttctcgcctcgctaccgcctgccacttccccgagcccatctttggccgtcgcggaactccgctgggctgccgccgccgccggccgccgtcgcggcgccgccctcctcctctcccgccttgcctcgccgagtcgccgactggcctagagagagagagagaggaggaaccgaggaagagaagagagggagagagatgattcagcctgacaatgtggggcctatatggtcccatgctgactcagccgccacgtaggacaaaaccagggtcaaaaccaccgaacgacatgttgtgaccggttttgactggttaagcgatgctatggttttgcggttagaggacgattttgtaactcgatgacaagttgagggacctttggtgtactttttcctagcccaggatgtgtgtcggacaggctacgtttaagcccacagtcctatatatggactggcccaagccttgaaatgttagacccacgtggtccctttttacagggccgagacatataaagcccaaaggagcttctagtcggacattggcccttcgagatagagttggagttaatgcacgtaatacgagagagacagtaacacataataataaattaagttttaattatgtacaaacttagaatataaattttatattttaaagaaattctcatatataattttttcgtacgatacacaatgtttagcagtttaaaaaagtgcgaacaaaaactatggcaaaatctacattttaatgaaaactaaggtactctctccatccacaaaagttacacatattacatattactttttgacataaagaccaagaaaaaattaaatcaccttggatgttacaaaatcaagaagtgaatataagcatgcaaccaataaacatttagatgactccttgggttctaataaaatatttaatttctctttttatttaagttttgaatgtataaagactacaaataggaacaacttatttggaaaaactcaaatgtgtaatatgtgtaatttttgtggatggaggaagtaaaatttactggttgcaagtttcaacatggtgtagtataatcaaggtaaccagtttaacatactggttgcaacttgaaagcccgaaacacaggagagtacttatctatttcactgttactgtttgccaagtgtatattattatgactttttttttactcaaagtgtgctgatcattttttggaggggaagggatgacactgcgttgaagacttctagtagtaccaagttgttccttgtttagtgccacaaaacgaaggttgttccttgtttaaactgtgccacggcgtgcaagtggcttggtgatactttttacagtgattttcggattgattagtacaaatggtagtcgagttgcagagctttgtgcacatgcatggtttgcagcagaagatcacaggaaggcaagtggcatccaagctttgatccgctgccggtggttgccgcaagactgcattgtacgccagcaacctcggcggatccggcgcgcatcctctgatgctctgatcaccagaacatgtatggcggttgcagtggcagttaaggaggcctcagctcagctgctccatcattcattagcaagttctcgaaccatcttctataaacaaatagtattgctaaatgaaatggtctggaagctttttgcttagtctggacaataggtactcgagcaagattgtttttttttttggaaaaaaaaacaatattcagaggaaaggatgtccttccgaatatttttgtaagaagaaaatgcaaatgtattgaggtttgaacactgaactttaaggttgaaattatatatcccttaatactgcactatcaagtgcatctcaagattgcaagtttgcaaccgttccagctaagggcacccgtaatggttatctatatgctctctacaagagatccatgtcagcatatttttctatttgaaagagattaaatggagagagagagagcaaagctatctactaacctggagatagtttatagagaaaaacgagacaatgtattagatagctatagatacccatgtaaacatactattgaggtggtttactattatctagtctattgctgagatgtacatgttttacagagaacaccttagagcacccacaatggtaaagtaaggtgctctctataaaacatgtacatctcaacaatagactagattaatagtaaaccacctcaatagtatgtctatatgggtatctatagctctctaatccattgcctcgtttttctctatagactatctctaggttagtagatagctttgctctctctctccatttaatctcttccatgtaagaaaacatgttgacatggatctcttgtagatagcctataaataaccattgcgggtgtccttactggtgctctaacaaagacacattatatgataacagcactaacaaatatgttcatgaatgcaacttagaactggctgattagatcggttccagaactacaaagcggcagccgcatccacagccaatctgcgaccggtcagccacgacaatcgccggatcgggctggagggttgcacgtacgcacgctctctcaagtctcacacaaccttccaccattgatcgagcgaagcatttgttgggaaacgcagccgtccaccgagcatcacgatccgaccggcccagaacgtttcggatcacgcaaatcgatcgtacatccggcgcccgatcgcgaacgaccaccacccatgcatgcatggccctccgcatgcacctcggtctcgaaccgatgtaaccaccaccacaggtccaagcgcgcggcggatggggcgccccaatccagtggcgctaccaacctcggtcaaaccggcggccaaccgaccggaggcgggccagccatcgccgggcacatgcgctgcgtgtaccgctgtgcgcgaggcgttgcacgcacctaacgcgcgcacccacatgcgccgatgcgccgttcgctcggtcgagaggcgagcgaacccggcctatctcgtccgagcgagcgatcgatctagcggaggggccccggacccggcggatcggagtagcagatcgacatgcgtatctcgctgcggattacggtgcctcggctgccgtcgcgcacgagctgcaagcacgccattggatgcttatataaaactttccgatcgaggcgcgcgcatcgtgatgccgcgcgccgctgcgtcggattggtagtgtcactcaccaccacgcaccggtggcgtgcgtgcggtgtgtcggccggcatgcagggccgttaaaaccgttgcaagttgcacgcagaatactgtgggatcagtgtttacccaggctctgattttgttttaggattccggagctccccgatcggtttcaccgtgttctaggattctgtccaagtcgctggcacgttggttggtttactgctggtgggttgacattgatctacaccgccaccccgctccaatatatacatggatgtggagtactagactggagtatttcagagactatttacctctattctctgccttagccaatcaaattactcctcttggcttgctcatgccttaacaaatgaatgaataagaagaattgggaatactcctactagtaggatgtgtttagttcacactaaaattaaaagtttggttaaaatttaaacgatgtgacggaaaaattgaaagtttatatgtgtagaaaagttttgatgtaatgaaaaagttagaagcttaaagaaaaattttagaactaaactcgaccgtagcatactgatctcttaacttacctactcctagaggggttttttttttaagaggtactcctagagtatatagagaggatttgattggtcagagcaattcatgcattttcatttagaggttcatgtcagtccaagggctgccagatagcacctgtccgcatccaaggaggactgttttatgtccagacaaaagacagagatcggattgggttccaatagcgatattcccatgtgccggccatctcgcactgtcacctcatcacattgctcatgactgtgcatgcggatatgttgctcgctagtacagagtagcacagtcaattactatccctccgtcttaacaaaactcacttttaagggcctgttttagtttaaaaattttttttcataaaaaacatcacatcgaatctttaacacatgtatgaagcattaaatataaataaaaatactaattacacagtttgcatgtaaatcgcgagacgaatctttagagcctaattagtctatgattagcaataagtgctacagtagcccacatgtgctaatgacggattaattaggctcaaaaaatcgtctcgtggtttccagacgaattataaaattagttttttcattcgtgtccaaaaaccccttccgacatccggtcaaacgttcgacgtgacactcaaaaattttcatttcaccaactaaacagaccctaaatttaaatcaaactcacttttaaatttaaatctagacataggctacgtacatgtctaaaaaaactcaacctagaaggaggtctgaaccatcccagtataacgaatctgaatagagagttattcagatttattgtattaagagagggtcacgttcttttctagatttttttttggacggaataagcatgagtgattttgttttggagggatggtatactagtatctcctagtgtggcgtatatgctaccgtatcaagggggcatacaattaatactaataagtaatctaaacgatatttctctatacatgccatgcatggatatattcccctagaaattgagcacatataatatatcgggatcgatttgagtgggtaaaataaacaatgtgttgtctccatttttcgtctcatactccattactacccccatgtttcgacatgaactaattgactcgtacgtactagtacaaaatgacgaagcttgggagactgtttaagcacgtacagtactacatgcacattatacggtgaggcccagttaagcataaattaacgccgaccggccaatataggtgaaacgttggcgtcatggcccgatcgatgcatgcatcttcgtacaacgtatggggggcagctgggacagcaaatggtgaaactatcggcgtactcgtcggtccgcgcgcccccttttgcccacacagccacacgccacgccacaccgatcggtagatcggcgggtccgcgcgcgcgaaaacacgaaatgcatgtggtgttcctatgcgtgccggataaagtccaagaatatattttagataatttctggtatcaatacaataataagagggaagaaaaaggctatatgctatcaatattaaacagtcttgctgaatatttccatctaatgaatgatataatgccaacatcagaaaataatgaagtaataccacaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgacaaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacatttgactgttaaaaatactgtggagaatattgctttcggcggaaaagaaaggcgcaggtacagaggtgtctccaccttggccaattcaaggacaaagtaaagccaaaaagaagataagcatctccatggtgcgagccagctcgtgaaaatacagtatctagaagataagcttgaagcatagtcgagcctcccgagctcctataaaaggaggggtttgctcagctgagaagaacaacgaagacaccattcagagcaaagctttcaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttattctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatagagagagagagagagagagagagagagagacttacttttttttgttaattgaccatttagttgaccgtaaaaaatttagttttaccctcggatttcgatcgtccagcgcgcggtcgcggcggaggcatggagatcggagaggccacggcccagcgcaacacagcggcgaacgcgacgtggagcaacgcctcatgattattcgttatgtgcatacgcatgacactattctggtttctgtagcagccgtcgagcacgtaagcaaccaagctatcacacattcgtaccggtctactacaactctacaatagcgaaagcaattggtccaaaccttttttgtggttgacatgcatatgcatgattcaatatctatctattatattatcaacaccacgttcgctgtggcggctagaaattctcacattaatcggagaaaaagagaaaactttacaccattagatcttagttgtctaaattttaagggctgagatttaatagcatagaagttttaatatggtaatcagatacagatacgtgtattatagaaattggccagcagcagttagacttttcttaccaaactagcactaggaaacaaaaattgtaataggaatctagggaaaaaagctatgtccgtgtatgattttgtgtccgattgctatggtggctagctaccaaaaaaaaaaagatactacaaagcaatcacagcacgtacagtttcccatctgccgtctccaacaaaataacgaagaaataggagccagagaaagagaaggtacgaccagtacacgagagaaatagatgtatttgatggctggtccatttattcaattacctcggctaactctttgtactctactcctgttatgagggatagaaattcccacattaacccaaaaaataattttcaagtaaaaatacaatttaaaagtaactaaaattcggaattaaaaataaacaatattgaaaggagagtctatatatataagaatccaatatgagattaattaaaatttaaaatataaataaaataaaatccgaatttttttttaacaaaaagaagatttcaagtagtaaaataactaaaattcgaaattaaaaaaataagcaatgttgaaagaagagtccaaataaaaacccaacacaagagtaattgaaattcaaaataaaaaaatgagaatacaaaaataaaaatgagagtggaatacattatataaataactaaaatttgcaataaaaaagaactattgaaagaagagaccgtatatagagagattaattaaaattcggaataacaaataaaataaattctgaaaatagaaaaatatttataagagttcatataggaatataatttatctccaaataagaacccgacatgagagtaattgaaattcaaaataaaaaaacacaaaaatacaaaaataaaaatgagaatggaatacattatacaaataactaaaattcgtaataaaaaagaattattgaaagaagagaccatatagagagattaattaaaattcggtataacaaataaaataaattatgaaaatagaaaaataattataagagttgaattaggaatataatttataaataaaaaatatcggaatgaaaaatatggaattttcaaaacaaaaaggtccatttagaacactacgatgacaaatacaataaagaggggagaaacaatgagcccgtaaagaaatagagtggtggtggttgatgggacatctaaaaactataaacaaaacccgaaatagaatcaaatgacaattaagaggagggacgacaggcataccattaagcaacacggttatgacagttggcgagacttataaaaagtaaaaccccgatgataattatgttcgattttaaatatctctatgggcgggccatagaggagtacagtggcgaagccgttaatgttttggtgggacttctagaaagtaaaaaagaacacaaacaataattatgttcaattttttaaatcctaatgataaaaaagagaggatgcggtggatgggccgtagtggagtacattgacgacgtttgacgggacttctaaaaattataaaaacgaaacccaacgagacaatcaaatctgaaaactataagttctaatttttgaagttctaaagaggatgaatagaagtaatgatagatcaagcaatcaaataaaggtgtagcagaggagcaagggtagcgactaacgtgacttttaaaaactttaaattagaaacatgggaatgataaattttaaataaaatcatatgtaaaaacaataattttatacgggtactagccgcgcaattgcgcgggctacccaattataagagttaaagtaggaatatattttataaataaaaaaatatcggaatgaaaaatatacgggttctaaagaggatgaatagaaatagtgatagaatcgagcaatcaaataaaggggtgacagaggagtaagggtagctattgacgtgacttttaaaaactttaaaattagaaacgctagaatggtaaattttaaataaaatcatatgtaaaaggcaaataattttatacaggtgctagctgtgcaattgcgcgggccacccataagagttaaagtaggaatatattttctaaataaaaaaaatatcggaatgaaagttatggaattttcaaacaaaaaattcatctagaaaacagatgacaaatgataataaagatgggagaagcaacatgcctgtaaaggagtagagtggtaacggttgatgggacatctcaaaactattgataaagcctcaaatagaatcccattgatgattgaaagtaggaacaacggaaaggtcgttaagcaacacggtcacgacatttggcaggacatccaaaaaataaaaaataaagagggaaggcagcggcgagccgtagaggagcacagtggcaaagccaatgatgattggcgggacttctagaaagtaaaaaaaagaacacaaacgataattatgttcgatttaaatctcaatgacaataaagagatgagacagcggacgggtcgtaaaggagtatagtggcagtgtttgatgagacttccaaaaataatagaattgaaacccaatgaagataataaactctaaaaactataaggtccaatttttaaatgttccaaagagaatgaatagaagcagttgtaacgattgatgagacatctaaaaactattaacaaaaccccaaatataatccaatgacgattaaaagcaaggacgatggataggctattaagcaacacggtcatgaaaaaaaataaaaaataaaccccaatgataatcatgattgattttaaaatctcaaggacaataaagagggcaggtagcgggcgaaccgtagagaagtacagtggcaaagccagtgatggtttggtgggacttctagaaagtaaaaaatgaatctaaacgataatcatgtttgatttttaaaatcccaggcaacggatgggtcgtagaggagtacagtgacaacatttgatgggacttcaaaaaaaatataaaaatgaaactcaacgatgataataaactatatctaaataatgtctactacatccgtcctaaaatatagcaacttttagctatgaatctagacatatagttgtctagattcaaagctaaaaatgcttatattttgggacggagggagtaatttttaaagattcaaagagagagaatagaagtagtggttgatcgagcaagcaaataaggaaggaggtgacgaagaagtaaggagtaacaactggtatggctttaaactataaaattagaatcacggggataataaggtttggtcctttaaagttttaaaacaacgagatagctatttaataaattttaagtaaaatcattttagaaaatatataattttaaatgggtgctagccgcgcaatcgcgcgggccatccagctagttccttcgtatggtagcagtgctagtctgctagacaggctcttaattttgctcaggataagaaagtagaaacacgcctagatcattacgcgcccccacctcgcaggtgttatctcgatccagtactgccgcgattaatatggaaataaaagcgaaccgacgccagcccatgctcggtcgcaggccgcggtgtctttccaactcggtcgatcagcactccagtatctggtcggcacagcatttgcgtaggcaaccacatctccacacatacaagcagcacgtacagcggtacactatacgtagtcacgtagcaattttcgtaccgctagctgcagctagcgttgctcagtgctgttcccacgtatatctaatgacacccattctccgtttctcctgctgtcctgcatatacgagtccaagcttaataattctgccaccttcagaacaacattatgtggactcacaaaatctgcgaatcgatatattagcatgatttttttttacaactgtaacccgctgacacagatcatggagcattacaggggagaggaattgaagagcacaagagattaactagcaaagataaccagagtctaaaaaacaagaaggaaaaaaaggagagagtttgtgactaagcgccaagaaaaactcctaaggaactaggcaacaccgcaacccgaatcttctcttatgcggttaaccatcatctctaccgtgaaaagtgtcccctcaaagcacaagcatttctttccaaccataggtgtcatgtaataaggatgacgaggagagtcaaacctatttttgttgtgatcccacaaccactggcgagaagactcccactaaaccggaagcaaagattgttggcagggtgatagggaggccaatgtaacctaatcctggacaataacttgtgccaaacttgtcgcgtgaagacacactgcaccaagatatggtgatcattttcagctcttactcacacttgatcaacagctcaacaccacagtcgaagcgcaagccaaaggaaaagtttgcccttcacaggaccagtgttgcgtcaaagaaacacgacataggggaaggagattgatcccttatagaatgcgtttgttggtcgaggcggcgttatactcactgcccatccagtgctagatgaactcatcttggacgaagtcttgcagtgggcagttttgtattctatcccaaagcgcaaggaattgggagaggacgcgcatagtcagggcacccgtgatgttagagatccaagttttgccaaccaggccaggaaccatcgaagtggagttctggcgacgggtggggacgacaaggaacatatatggggcaatcaattgaactgattgcccgttgatccagctgtccaactagaatagcgagcatcatccgtctcctatgacgaccacgacagccgctcggaacatctctgacacacactgctcttgcggtagtttgaaaccaacccaatgctagagctagggtcaccacatctgcagggcctagcccatggtttggagggaagcggttcctctgacgtgaactgtcacatgacgtagtcactgacaggtgggcctgcgagcggtagggcccacatgttagccaccacgtctctctaacttcacgtcagatgatcccaatccggttcgaaggtccgtgatttctagaccctcacatttccttgggtcggtacaccttgggccaagcgacaaggcaattccggctgtagaccaagtttgaccacttccaaaggaaagctttcaaggtccaatccggcaagcccgatggcaagggagaggtgcaccgaggtggaggagaggacgagttgcaccaaggtcatcatgtccatcatagtcaagagcctctcctttcaagtagacatccagtcttggacaaaatccacaagcggttgtaggatgctcttcagaagattcgtgacggagaggggactacctaggtatttacatgggaactccacaatcgcgcaaggcaggatacgagagactactaccatatcatcttccgagcacctgattggagtggtggagcactcatcgaagttggtaataaacagcctcgaagctggagtggtggagtggtgaagcgtggcctaggtacgccattgaactggacacacgaggaagataatcgaaggataacattgtggagaggggctgggatcgccattgacgtacgccattcagggcagtcccaacccataacactaaacatggtttccataaactccacatcatcaagaaactagtactagacattactcttccaatgcaaacaccactattccatactttaatttaatgctacttatctcacatgatgtcttggatattgtgtagaaaccatgtctcatgcaagacatggttttcttctctttcctcatttattcacttgccacatcattttttgtcctacgtggcaacttatttaatgatatgaacaccatcctaatcattgggttgggaatgccctcagaacaactaatcttgcaagatttcaatatacgaatcagttaaattcccgtataaaacggcactaaacaaaaccaaagctggtaattggattgtctatttgtcttcgtcctggcggccggtcgatcgattgatcgtcgcctctcgtcgacggggactgcccatgcgtctgcgtgccacactacatttattcgagctgttaacatccagcatactcgcatgtgaggcacagctgggcaccagctgctacctgggccccgctgcgcgacaggccacgccggctgcatatatcatacaacgccccatcttatggatgcaacagcaacctagcttgatcgaattaattcgtagcgaatgccatgcatcatcatattaaaccgattgttgttagggctcataaagtcataatctcgtccacctgtcgtgtcgatccatgtcgttactggttactggttaccaacccgtgatcgatgattctgattcattctcctcgtcttttagtttctttaattttgggtgattagttgtatggcctacccatcataggccatttgtacatcttatatccacagacagtgtcagtgtaatgttggcaaacattggacaggggactcacacagcggtccttttctctgagagtctgaattagcatctggttgtttcaggctcaagtcaaaatacagtaacatggctatcttcgtgctagagatcaagactccattataaaaacttcctagggcaagtacacaagattaaggggttgtttggttgatgtctaagcttgtcataactaagcttaggcaagttgtggcatgtggcaaaagtatggctaagaaatagttagccacaagtgtggcaatattagctctaattatctgagtatgatatgtagtacctaagggtaggaaagtgtggcatgacataactgtggcattgaaacaaacacacgactaaaaactgtggcatgactgaagtgtgacgtggtaaagtgaagcaatcaaccaaacacctcctaatttcaaaaagaagaagaagaagaagatgaattcagcctacttactttgagtgggtgttgatatgaactgagcttattaaatgatgaaaatgaaacgagcagagagttgatcaatccgtgtcgagtcaatatcggccatgctgtgatacagtggtagcatctgcagccagctacgagatgattgcaccgattgtttcctctggcctcgagccaaggatgtaattacagtacgtaattggtgctattcaggccagtttttttaagcttagattaagttgcgcggcgggccagggagcggccgtagagtatttgttttagtaatttagggtttagctaggcatgcacgagccaacgtggagaagatatcgttcatgtgcaaaacggcaaatctcttcccttcctacgtactactactactagcgtcgtccaaaatttgccgaccgaatccaaactcccatctgcgcaggcgcagcgacccaaaccgggccgcacgcggctacaccaccactacatataacacgcgcgaggggagcagcagcagcaacggccgcgataacacctgcgacaaaccgggccggggtgatcgagcgcagctagcgcgcggcgccatggacccctgcgcgttcgtccgcctcaccgtggaccagctcctcctcaagctgccctccgtgccgcgcccgagctccggcgccgccggcgtccacccttccacctccccatgcttctgcacgctccacctccaggaccacccctccgccggctcccactcccgcaccgcgcagctgccgctcgcgtcatccgagtccccgggccccgtcgccgccggggagcccgtggtgataagcctcgacgccgccgcggtgcagaggctctcggcgcgccccgccgccgagctcgtcgtgtccgtgcacgccgggcagaaggggaacgccggctgcggcatgagcgccggccgcgcgctgggcagggtgcgggtgcccgtcgacgtggcgcgcgccgcggccggggagaccgtcgtcgcgcgcgacgggtgggtggacgtgggcaagccggccgcggcggcggcgtcccacggccacgcgcgcgcgcagatccacatggtcgtgcgggccgagcccgacccacggtacgtcttccagttcggcggcgagccggagtgcgggccggtcgtctaccaggtgcccgggggcgccgccggcggtggccagcggcagccggtgttcacctgccggttcagcgctgggcggagggcaaccaggaccaggttggtgacttggtgtgcggtacacgtattacaatgtgcatgcatcattccatcttcttcgtttgctcgctaagttaagcttgcggtgttaataatttgctttacagtgaccctgtgctgacaaacgtgtattttctcttcaactaagtgcttctcgtacgttgcttatatgctagttatatgtacgacggtaattgtgaagttcactgctagataagatagctagagctcatacttgggggcgaaaaaaaattcttacgttttatacagtatttagataatgaaacacagtcagtgttagttttcatggttgataaaagtgttgatgaattcattatacaagtagagttttgcttatttttcttgaaggtgcaaaaaagaaaaacaaaatcggtatgtaatcatgttaggatttaagttttcgaattatagtattcagcatgtacgtatagctagcagttggacagtatagtacgtgcccggccttggcctctgcggactgcggctctgcccatacacgcttatcaatgcaattatgcaaatgtccccatcagtccaggacatatatgatatatggacatatgaattaaaaacaaacaactcaatttatttatcttgtcatacggcaatcgatttgctaatcaataccgacttgtgattcggcaatgctcgattatttgagaaaaagaaagtagcacagctcaatgaagaatatgatgcgattctatttcatcccaactatcttcataaagaagttgaaaatcatttcgtctccttttcaatttcgcttttctttcatacggaattccttttcattattggatgccagctcttagataccttgtggtttatatcatgcaccggcactggcagtcatctgataaaatattccaactcccatacgtaacgacattttaaattaatttgccatggaagggaaactttttaaggttagaataaaatggttggaagacttgataattaaacaggcagtaccaatattccaagccacgtactactaaatacaaatcctattaagaaagttaagcacctccaatcctgcatgaatatatttgtgccattgctatttgaccagtcaggttgggttatgacatatgagaaccttcactgtcagtgcagctcagatctccatacatatacatgctttgtttatgctagctctacggaactttagtcactggactttgaaagtgaaacatacgccatggatggacagcatggtcagatatagacgacaccaaccgttcatgtgacggtcttagcattctgtctagttaccttactaatttgctctgcaaaatttaaatctttaacctcattagctgtcttcagaatcttccttgtatcatgtccaccattgccatcacctactggctactgatcttgtaccagtcacacttggcaccaacttgttatgcgctactcaaactaagcggttctttaattactagctcaaagatagtatgttgctatcttaaaccttttggtactagccatgcacgcatgcacttgcatgttactactacagagctagttaaactaatcctgcatgtgctgtttgttttgtccagatcgttgacgtcggagtcgtccatgactcggagcaccagcaggaagctgcggtcttggctgagcacgctgcacggcgaccgcgacgcgcaggcgcggcgcgagcagcgcaaggggtggacggtgacgatccacgacctgtcgggctccccggtggccatggcgtccatggtgaccccgttcgtgccgtcgccggcgggctcggggcgcgtctcgcgcgccaaccctggcgcctggctcatcctgcagcccaccggcgccgggccggcgagctggaagccgtgggcgcggctggaggcgtggcgggagcgcggccccgtcgacgcgctcggctaccggctcgagctggtgttcgactcgggccccaccgagtgcgccgtccccatcgccgagtcgtccatcagcaccaagcgcggcggccagttcgtcatcgacccggccacgttccccgtgggcgccgccggcgccgcgtggccgttcgccggcggcttcgtgatgggctccacggcggagggcgaggggagggccagccggcccaccgtgcaggtcggcgtgcagcacgccacgtgcatgggcgacgtggcgctgttcgtcgcgctcgccgccgccgtcgacctctgcatggacgcctgcaagctcttctcgcagaggctcaggaaggagctgtgccatgatcaagaggactagcagggagacgaaacggaatcaagtgcatgtacttgggggtttggcttgtgaagttgtgatgcatgcgatcactttcatgattgtgattaaattagttaactatagatattcaattgtttcttgtgaaagtgatggcctgtggctgtttttagtttaggctgggtcggatcacaagaagagaaacgtatgctctatattctttcctcgcgatattcttttgattctttttaatttatatacgtttctgttcctcttttttccttctgaaagtctggaaataaactcggctgcccgatgcaaatctgccctttggtgtctctgtagactgtagcctgtaggtgcctctgatgagttgatgtacactacacaaattgtcttttcagtcaacaggttaattatactatcttatttttcaccatcccgcacataccaatacccaaaaaaaaaagaataccctcgttttatcaaatcccaatacaattatttatcactttatcatctcccaatatattaattcttcactttcacatatttcgatgcaatgatttactcaaaaactaaacttatttgggataaatgggatgtcctaaaaataaacttatttccgaacggaggggtagctatttttggtgtggaaacgttcggccaggacagtgcccattggctgatgggcttaaacctgacgtgtagcccattttcggttggccacggggctgctactgacatgcgggcccatgtattacgacggaacggggctgtggcagacctacggcctgttaaggtacacatgggccgttttgggcaggttgaggtgtatttacgacccaactcgtacaactgccttccgattctggtgggcttgtgggacgtagggttgggtcagacgctttccattgtactccctccacatcaatggctagatttgtggtggcgcagcggcgccggagccatcagccatgggctcatcatcgtcgtgaagtatacgtttcagtaagtttcttcagtgcagcgtttggtgattatttaagtaggaatagccttgttgttcctttgtgaaaaaagagatagtctgttcctgtttctagagaaaaagtgtgttagttttgccgttgcgatattttcattaattctatctcttttcttgtttgctgttagcctattagtgttgtacctgatatggatgactataaacgatatggtattaaatttgcattgttcataacttcagtgtgttcaccaaaaaagtacatcctctttgttttccgatgcgagaatttagaggatttaccatcaaattcgcctgctttagggcctattaggattgttaccctaccaaaattttttgtagtgccaaaatagggcaagttttggcactaccaaatatttggtaagataagattatgtttgatcatatttggtttgctaccaacatatagtcaaaatgtgaaattgtagtaaagtatgttctagatgatgccaaatctagattaggtattaccaatgaatgggcttcaatccaaatcaaacacaactactattcaaattaccaaaatattggtagggcatgtttttggtaacaatccaaataggcccttaatttttttaccacctaatccgcaatgccctcaataatatattattagaactgttaattagtatatttgataccactttctatgtttttcatgtatttcttatttcttaattccattgacgttcaagcgttttctcagagaacgcaatacaaaatcaaagcagtattgtatatctataagctatacacataatagaactacaaaagtagtacacaagcatgtgtacaaaaaaatctacacaagcatctgtacaagtaacattccaacttcgtgcttgaatcgatcgccatgaattgtgtatatcttcattcttttccttgtacttaaggaatcaaattgtaaagaggatcaatagccagcataacatgactatccatgcaggtcaaacgttctttggcctgttggattgtttgattgctgaaacaatgtccagcctattgagttcaatgatgttatgtcaggctgccggcaagtacaacagaagcctgtgttattgccctcgcgactctgtgaatctcgtgctgtacaaacttccacgattctgtagtgttttccttccttgcactagctatagcattttctacaccaggataagatgcactttcccagtcattctgttctgatggtccatagacctgcgagaagcaacagctgccaattagcacaaaatacaaactgcaatctgaaaaccgtgatatcatggtgtaattcaaaacaagaaacaatgtaaactgaatccacacaccagatgtttgaaccattctcgcttgaacaggccttccctgttagtgaatgcccgttctgcctgcatgagccggtcattgagcgaccgtattttcattgaatcctttttcagctggttgctcgacagttgcctttgaagctcctaagaacagtcattcctcttagtcatgatgaaaacctgacctagaaggctgtctgaaatagtagaaattcttcatgtacatttacctttctctcgccatttactttggtagctgccgttttcagagctctaattgcattgtgcagtggagagcaactgatagccgttccccttacttcattctctactaccttcgtatatgcctgtgataaaaaaaacattaaaatcacgtaataattccagtcacagaaaagggaaatcaacagagttcctctctacaaaatactactggaagcatagtgatgatacctcaagttcaacagggtaggacatgtaattgaagggcaggatctcttcgtcagcaagcctcaaagccatcattccccagatgctagcagctgtaatacgaaaatgccgctcatcatgttgcagagaaagtactaacagccttcaaaaaatacagagcaatacctgcagcgtgcctactgaaccctggatctccgaatttctccatccacacgaagtcatcgtataacgaatgatatatgggatagcctggtcctgcaaaggacaaggcgaaacaagcaaaatccattaaaaagatagaagtgaaaaatccatttaaaagatggctcgatagattctggaacatgaaaacccttgccttctccaaaacccatgctggttgaaggaataccaacatgctggacgaaagctgaaaaatctgatccaccatggcctagccgtccaatcttttatgtgggggcaggtgatcagcaatgacgttaaaattattttttttcgaaatgaaaattttacagctaaatatatcaagtaacttggaaataggaattgctactataactattctgtttctaatataaaccatcttacaactcaccaagggggaaatgttggatttgacccatgaatcatacacggcttgagatgaattgtcaggatcttgaaccttcatgattggagaaagtgcatttatagttattagaaatcacaaccaaggatacgttataaacataaaatgtctcactagtgtttgaaaaaaaaagttgaaacacccattattgactatttctacagtaaaaccaaaagaaaaggcaataaagctctgccattttttttcgtcttttcccccaaaaaatgtcaacgtgactcgttttcaggaatgatgtgctcaccaatttcattgtttcctgaaatagttcgtcaagttgcggagttgcagagggatgaaataccgggccaactactgaaacgtcaacgttaagataagcaacagctcttgaggaaagcatctccctattttcttcaacccattcagttgatcctgtctgcataaatgtaagttgtgaatgatcaccattctagttgctcttactctgcataactctgtacatatatagtgcagagagagagagagagagagagagtcagagatatttaccagcccatactcttctgcatcccagctgcagaagattatagttcttctaggtctccatccttgcttttgcagcaccgaaagcctttgagctagctaaacgacaagtaaacaacacgccaagatgcagacatggccatgttctgagtgatcagtcgcagtattataaaacggtgttttggctcagcaaagttacgataaagtacagcctactgaacttcggagaaagaactttgtgccccaaaaattacctcaatcatagctgccgttccgctattgggatctgatgctccaaacgtccaggcatcacgatggttaccaaggataacatatctgcatcacaaaagggtcaaatttcagttaagtcacatcctaagttcatctctgatttcattttgtgtggttgtgcctagactttctgcagactgatacgtctctaatcagtcagctacatgatttttttaaaacgaaaaatgtgtagctgtattactttctgatctctatattctgcaggatatggatatgatagcaacaggagacggtggacatctacatccgaaatataaagtgagccatgtatagcttgccaagataatatttttgttatctacaaatctgttgaaatattgaaactacagagggagaaaaaaaatgtcaagggctcccactatccaaatgtcaagggatagaaattatacaataaatattggactagaaaatcatctgttgataatggtgggtgattgggtgaatatgtcaggcctagattgataatgtagaataaaattgttgtaattatacattcccggcaatgataagatgaaattttgtggcaaatataggcatgtaaaagtaccacggtagtgcagagtattaggtcaatggtagagcacatgaaatttttttatcggtagttatgaatcttcataattttagtgaggctagagatatattacagatctctatcaacatatggttagcaattccgaaaaaaatattgtcaacgaatggtccaaaagcagtgcatggcaatgcccaagtgggatgcatgtgttaacaaccagcacaggttgtgattgaaaatctgaagcagcagttagttagagaaataccccatgaagaagtgtatactggaggagtagagtaatttaatctgatgcaatgtcaaaaagagttacctgtccggctcctctgcaccttcgatcaccgcgaagacattctcgatggtggccatcgtatcattcccctgcaaactccacaagaaaccattggctcgttggttgcaagttgcgacccatgaggccatgactactaaaaaaacaacatgcggatttcagtgatcgagacagaaaggctcgtcgaatgttgcttacggtatacgtcaggttcaggatcgccgggccagggccgaggcggtacactgggctgccctcccggccctgccagtccgccggcgcagcgtcgccgcccagagcggcgtggatctccgccgcgtcacgcgcggacaccggcagcgcggggatccccggcatgtcgtcggtgtccatcgcctcctccacactcacgcgctcgcacccttcggacgacgcccacatcggcgtcgtcgggtcgcccacgccccggaacaggctgcccacctgcacgccggtcggcggcagccaccgggagtcggggaaccacgcctcccccggggcgccgccgtactgcagaggatcggtgtacaccaccgcggccgcggcacccgccacgcgcgcgttgtgcacgatgtcctcgcagtggatcctcccgtaccgcgcgaccgccaccttgcccgcgacgtcgacgccgcgggaggcgaggtaggcgaagtcctcctcgcggccgtagttggcgtacacggcctcggcggacaccgaaccggaggcggcgtaggcgtagaacgtcggcatgacctccgccgtggccgacgcgtaggggtcgttcgggtacgtctcctgcgacagggcgaagctcgtggtggtggcgcggccggggacggcgagggagagcgagcgctcgaccgggtaggagaggaggacggagtagggcgtgatgtgcgccgggatggagagggacgagaaggcgtcgcagacgtaggcggcggtgagcgagttggccctggtgcccgcgacgtgggggtgaagcgtgagcgcccggaggtggagcgccgcggtatcgttggaggcgagggagaggaacaggctgccatagttcggcgctggtgcggagtggacgacgaggaggagcagcgagagggaggctccgagggcggcgagggtggaggagacgacgcagatgagccggcgcggggtggtaggtttgtgcggcggcgtcagcgagggagagaggaggagggaggtggcgtcgaggcgcgacatggcgcgcggcgcggggtggtgcgcgcggggatcgcgcggcggaaggaagaggagcagagtgcggggtgctctgttctggctcgtttgcttccgtgccgcgggcgcgctgtatctggctcgcgcgctgtttaatccgcggagacaactgacaagcggaccagtggcaagctggatactgctgctgctactgccacaccggcagtttgatcgtgcggcggcgatgcgaccacagcgcacgccacaacaatggcagtgtttatagtttccgcctattcctaactttccatcacatcatattatatcaaaattgtcctacgcatataagctttcaactttgagtaaattacacccacggtacaacaatttagtaggtgggtgtaatttagtataataacttgaaaaataagcgttctagtacaacaacttagcaggaaagtacaatttagtataaggactttataagtggtcgtataaatgcaataacttttaaggtaggtaagattttaatacaagagtaaagtttatcaccggtccctaaacttgtcgctgtgtcattccggtccctaaactcgcaaatcgatcattcagatcctcaaacttgttcgactgtgtcatcccggtccctaaacttgcttatcactcgtttaggtcctccaacttgttcagttgtgtcaccccggtccctaaacttggatttgaatatcatctgggtcaaataggaccgtctaaagactttatatttaaaaataattcatagtttttccatgtgaactctaatgaaaacaaactttatatcaaacttgtagccctcgacgcgatctacaattttatagttgaatttttttattttaagtcattttttgtcccaaaatgtaattttaaaattaaaatttcaaaatctataaacatgcaacaacattttgggaccctaaatagttttaattcaaaaccttttcaactacaaagttgtaggtcgcgtcgagggctacaattttgatataaagtttgtcttcattagagttcacatgaaaaaatatgaattattttttgatataaagtttttagaccgtcctgtttagggaccggggtgacacaactgaacaagttggaggacctaaacgagtgatctgcaagtttagggaccgggatgacacagtcgaacaagtttgaggacctgaaaggtcgatttgcgagtttagggaccgggatgacacaacggtacaagtttagggaccggtgatggactttactcaaaagagtaaaataaattataattttgacaacttaatttcaagcattttttatataaattcaaatttttaagtacttattttgacaatatactagcgtggatttgtataaacatatttatattttttcctaataactaataactgaaagtcaattaaactgaatatagaaattattatatttcggttgatatttgagaaggtgaagaaaacaaaaaattcttaaaggtaattggatataaattgtatgtgcaatataattcttaaagattaaattcaatattataaggtaatatttgtatcaactaaaaaaaggtaatatttgtaggattattgtgttttggcatattgacatagtgaaaaaactcacctagcatatgcttatccaaattgatttaccaaaatactaaattattaagttcttgtactagaatgcacccacttgtcaaattgttacacttggacgttcaattctaaagttcttgcactatatcgcacccatctgccaagttgttataccgtgggcgcaatttactcttcaaccttttttttttcaaacttccaactttcttcaaacttcacttttttaggaactgaacacacccaggccgtatttagttccccaaattccaactttccatcgcatcaaatcacatcgaaaactttcctacacacataaactaccaactttttctttaacctaccaactttctctcaacttctcaacttttccaccatctaaacacagccccaatttctcggatgaaaatcgtgtgaggctggacgctggagaggatcttgccggcttgccgctttggggaaggagcgattattatagatcaggttctcgctgatggttcgctgtttcagccactccgtcacaacgtgcgctacagttgagtaccccaacttcgccgctcgtgtgacgtcgccggtggccatctccagctcagacatgtttgtttcctaataagataagctcccgtgtgtagtgcatggtctcccgcaaggcgctaggcgctaggagcctaggatgatggtgatgtagtacttactcctacaagggatcaactacatcaccatcaagtttaatagttattgattggcggcaggcaatgccaacagcgttaggatgttgatgagcgagtgattgggtggtgtcccaatgctacgctacaattagcggaccaatctgttaatgttccattagggacacgcaggggtactccaactagagtccctttcttcctgtcaattcatcctattacaaatccaaaagttgaacaaagtatggaggcttaattatcttgggcacgcactatttgtggatgcctcgaactatttggcttccaggtttaaaatttgccatctttttttttctatgtcgacactatgtcctcatcttttatttgagtgtcagattaaacttgctgcttactacccctccgtgttagaaaaagtgcagttttacacggttcatgttcaaccattgatcatctgttttatttttaaaaaatatgattggtattttaattgttattagatgataaaacataaatagtactttacgtgtgactatttttttttatgttttccataaatttttcaaacaaaacggacggtcaaacgttagacacgaaaactcgtatctacgcttaaattgggatgaaggtagtattacttgttggatgaacaactgaaactctcggatgtgacgtcaaaagaaaattgggggtgggggattggaataaaggccctggttagttccttttcatcctgtcacatagaatgtgtcggagaatgaactcctccaccagggaactgtgaggcccccctttgtgagttcggccgggggcagcgggtgagattcgaggatttggtgagcgaagctgtgtgatcttgagggggttagcccccccctcaagacgatgagacaaaagaggtttatacaggttcgggccactgagaagcgtaatactctactcctgtgcatggttgattgaatgtaaaacaagtgcttggggttgcgagacccaagccccagttcaccccgaagtccccctctccaccactaggcctggacctccttttatacctcaaggggttaccacatgggcccaacaacctaacctagctccggtggagaagtattataatctttgtattaaatgcatgtcttgtctcttgacttgggaagccaagcacacgtcatcttgatgatggggcctgtcaaatcttgccgcctgacacgggggtgcccctgtcaatcaccatttaatgggtgaagacttctgggctcctattacaccgagaaacgggagccttactttgaccagagcgggaggaccgactccggctgggataagacaatgagaaactctcaccatcattatttgatgggacatgttaggctgcacgccgcctgcagcgcacaggcgcactagccagtcccatcggtcattcgaccagtcacagaccggttgagtgcactgcacgctgcgcgaccgctcgggacgccataaatgtgggtaggtggacacctggaggcggacacctaacccaccgtacgtggtgacctagagagggggtcgggggagcccgacccctagtcacgggagggggcggccgccgcccgacctcggggggggggagccacgtggcgcctggggcagccttctctctctagtctcggccagggagtggccgccgccctacctcgggcccgacccccctcgggggagggccatgtggaatcgggaggtagcctcctccatccagtctctgggaaggagtggccgccgtcctacctcgggcctaactcccctcgggggagggccacgtggcatcggggggggggggggcagcctcctccgactattctttggggaaggagtggccgccaccccacctcgggcctgactcccctcgggggagggccacgtggcatcgggggcagcctcctccctctaaacccgatactcccgggcccatatcaccgacagaatgtttagacacatgcatggagtattaaatatagataaaaaaactaattacatagattgcgtgtaaattgcgagatgaatcttttaagtctaattgcaccataatttgacaatatggtgctacaataaacatttgctaatgatgaattaattaggcttagtaaattcgtctcgcagtgtacaggcggaatctataatttgttttgttattagactatgtttaatactttaattttgtgtccatatatctgacgtgacacgccaaaacttttcataaaacacaagttttcagcgtcataaaacacacactaaagttttcagtgcttgaatttactattccgacccagatcgataggtgtgaccaacgaaccaactgctgcgaccgacgctacctacagcagatctatcggccaagcagattcacgaggaatcaatcaataaaaactgcttgatccgtgtccttgtgtggccatggaggtgacgcaggatatactcgtctggcaccattccaataagctgcaagattccaagccttatcgagataattaaaaaaaagagatactatcgtactggtcaatttgttgtggtacactacgacagcgaaatggagacggtcactcaactcttaaacaattatgcttccggttttattcaacagaatttgggttaacccatctgaaaaaaaaactctcaaacaaattattcgtagtaccctagagaatcacgcagggtaatccacaagagagtttcttgtgtgcttggaattaattagaacccttgatcacctataatccaacgcactaagataaaaggtacaggagcaaagtagtaaaaggatgggccaggtatgagaggtggaaggttaaaatggtaattaacttctatagttgatttgtgtggttaaagataaatgcgttatcttttcaatattcatctctttacgatccgctcaaaactcccgatccgttccaaatgccgtgcacgtcctgatgccaccgctggctgctcctcccgccggttcctcgccgggacgccggctacataagttgatgttcggacttctcggataggttggccttcagagtgtgccgtccatgacctcgaggtaaaagcggctgccgctgatgtcgagtgaacctgccggctttgcataaacgtgcttgatctgcttaattaaatgatcagcgattaaccacagaatatcttgttcgatcaggatagcaattagatgcatcaatttcgcaagaaatcaatgaccaaacttttcaattccattcaacagctttcgagccaatcaatgcttaacaaaaatgaaataatgcttcagcatttaggaaccatcagcagcagccagcatccagccgtcggtcgcaaccatcgtacatgcccgccggtcgtcgctgccgaacgcaaccgtacgtgcctgccgatcgcagccaccttgcgtgctgcccctgctcctggtccgttctttcacttgggatttaaagttagggttagacatagagagattgaggtcacgctaatatcgtgaaaaaaaacaatctcattgaaacgacaacgtcagccagcggatggggattggacaattactaagctacccttgttaatattatttcataatcctaaattaccctttaggaatcaatggtggatattaattagtttaggaggtccctgggatacctctcaagcaccgtaaaagatctccacaattcattaacatcaataattatgatactaactgaggatagttcttcagtatcttcacaggtacttgtgtaactatatcatatcatcgtaactacgtgtagagctggtatctggtactttaaactgcacaaaactacgtgtagagctggtatctggtactttaaactgcacaaaatggaatcgtgtagtgatcttaatttatgtactctcatgttagtctaccatcaaggacagctgaagccttggacacagcccttgcagccctgtaaatttcatgctgcaggagctgccaagattcggttgtgttgagcttatttgccttgtcgatggccgacacgataccagggaatgccttggtgccccagtcgtcttggtcagacgatgcgtatatctgtcaaaagaaaaaaaatgattggacataggttatcactttgtcagcatcaaatttggatcagaacggcataccaaactgcagaactgatgatactcaccatatgtttgtaccacggcctaccgtcgagcccttcccggttgatgaagcctcgctccgccatcattaaccggtcgttgatatctctgacttttactgtgtacgctctcgtttttaggctccagttttctgcttgtagcatctgcaaggcagaaatgagatgttttcattggaatgttggagcaattttgcgcgccatacacttctgtttcactgaaaacggaaggcgttaccatcttttctttgtgaattttgttggctgcttttctaagctggtcaattgacttgtgtaaaggagcgaaactgacaggacatcctgtacacccaccttccacaagttttgtgcatttctgcgataaaaaatgtggcaggtaattcatatgttaagcatttgctgcagattgttccaccaactctggtaatttcataacctaacatttacccatcagcgaaaagtgtatcacaattatgttctgtttttatttataaaatgaatcgaggctttgtcttgtgtcctaaattggtcatctcaattgaagaaaagaaggaaagttacctccagttctgatgcgtaagagacataattgaggggtaagatctcatcatctgcaagcctcaaagcaatcagaccccatacacttgccactgcatgattatgcaagcaaaacaaatgaatctgtcagtgtttgcaatgagatgaaaaacctttgaacaacaactagttcagtacatgcaacatgtctgtgaaacaacggatctccgaatctctccatccaaacataatcatcgtacagtgagtggtaaacagggtaatcttccactgcaagagcaataatattagtagatgctaaaggagtgacagcagcagagactgcaaacaatggtgaagtaataaaaaaaattaggagttatcaagatcaacatctccaatatataatcattacttgttccgtaagacatgtcaagtgaaggtactccaatatattgtagaaaagctgcaaaatctgttcctgctccagccactctatcaatctgaaaagaaaactttatcactttcagcacaaagataattttattccagatctaagattgcacataacaggattataaagccatttcaccactgtacaatgtacgcaccggaggatggtggcgaatcatagtgtcatacaatgtctgcgatggatcatcaggatcttgcaccttcaaaagagagggtggaaaatgaaatgatttttgtgcctttgtaagactgctatatactttgatattggccctgttcaaagaaaatttccctccctccctctcttttcaaaatgacggtcttagttatacttcttaatcaaaaacaaaatctggctgtccaatttgtaaaaaaggaaagacggagtaaagcttaaataccattttacttgcttctttgatcaactgatcaagttgaggggttgcccggggcctaaaacctccagggccaaacactgttatatccacattcaaataagcaatagctcttgaagccagcatatccatgttgtcctcgacccattcagtagaccctatctgagacattgagtgtgccgcatcaatacacaaccttctgataaagaagcaattcagaacaagtgatcaaggacataccagagcaaactcttctgcatcccaactacacacaatgattgttcgtctaggcctccatcccttcttctcaagcttggacagcctttctgcgatctatatatatacgtgtgatgctaacattatatcatcaactcttggcattcagaaattatagatgccttttatcatcaacaaaaagaatatgcacttaaatttgttgtttggaaaatgagacaaaggctaactagaaagggaaaggatgaaatattcatgtctccaaatgtctgatgaaagatgacatatctgtataatttgctcctctaaactgaattgattacctcgagcatagctgctgttccactgttgggatcaactgctccgaatgtccaggcatcacgatggttccctatgatcacatatctgttcacaaacgggcaaatttatccttattagctttgccttggctttacaaaatttctagaaatctaatcatctcctgtgggatgaaaaatgaggactttgatctaaactcagaacaatatgcagggcagggcactaagtcaaagcctgataaacagtgataccacgtgtccacgtgcaactgaattctatacgtatgcagaaaaagacaatcaggaatgccattcacttgttcgagcgagagattacctatcaggctcttcttttccctcgatcacggcaaagacattttcgatggttgctaaggtgtcatttccctgcagttcaccacagaaacaacgatgagtcgatgagttttcttggataatgactcaactagaacactaagatccactcacaatgtacgtgagattcagcacagcaggaccgggtccgaggcggtacatgggcgcgccctcgccgccctgccactccgtcggcgccgcgtcgccgcccatcgccttgaggatcgtctccccgtccctcgccgacaccggcagcgctgggatgctgggcatcgcggcgctcccgtcgagctccccctggctcagccgctcgcagtcctccccggctgcgcaggacggccacagcggcgtggtcgggtcgccgttcccgtagtacagggtccccacctgcacgccggtcggcggcagccagcgcgcgtcggggaaccacttccgcttccccttcgctcctgcgccgccaaagtccttggcgtcggtgtagacgatcgcggcggcggcgcccgcggcacgggcgttccgcaccatgtcctcgcagtgcaggtttccgtagcgcacgagcgcgaccttcccggcgacgtccacgccgcgggaggcgaggtactcgtagtccttggtgttgccgtagttggcgtacacgacctcggcggcgacggagccggaggcggagtaggcgaagtacgtggggatgacctccgccgccgcctcggagtaggggtccccggggtaggtctcctggaccagagcgaaattgaaggcggccgcgcggccaggcacggagagggagagggagcggtggatggggtaggagagcagcacggagtagggcgtgacgcgggtggggaatgagaaggaggagagcgcggcgcggacgtactcggcggcgacggcgttggcctccgtcccggcgacgtggggccggagggtgagcgcgcggaggtgcgcggcggcggtgtcgttgttgccgagtgagaggaagagcgcgtggtagcgcgacgcgggggccggcgcgaggtggtggtaggaggcgaccagggccacggagatggccaggaaggcgacgaacctgcgcctcctcgtggccgcatcaccgcgcccgccgtcgccgcctcccatgggcgcagcatcggggaggatcagcggctgccgctgctgtggcttgccgtggcgagacatgggtgatgggcgcagtggcttgggtggagtttggagaggcgtcgtagtttgcggttgcaagcaacgtcactttgtcagcgccaagagcccaagaggttgtatcgtctcgatttaattgggtcgttcgcatcgcaccgcagcgcgcggtgctcgcacacgttgcaacttgcaagttgccgcgcaatgcttcgttcggcttcaataattaaacgcttataataagtgtggaaaaatatcaaggctgattatgagcgtcagccatcagctcacttttgttgatgcccacgagtttttcctctaaaaaatattagctcgtgagcaacgttccaactccgcgagcgaaaagtagtacttgtctctctaataaacgaagttacggattgtctctctaataaacgaagttacggattatgacacgttgaaatgcaaaccatgtttttaatatactccctctgttttttaatagatggcgccgttgacttttgaatatatgtttgaccatttgttttattaaaaaaatttatgtaaacgtatagatataaattatgcttaaagtactttgagtgataaaacaactcataataaaataaattataattaagtaaattttttgaataagacgaatggtcaaacgtgtgataaaaagtcaacggcgccatctataaaaaaaatagagaaaaatagaggtagtagtatcttaaagcataatctgtagtgctgtagtgcgggttagtttctagaacgtttggtggttggtcttgcgctcttgttaggaagaggcttctggacgtggcttctctgatatagagcactactcgtactttggataatacaaaattttgatacagtaattaaattgaaaatgtgtattttgttcagacttcagaggatttgaaattgtgtttggttcgtcgcatgaaccaaacataagatgcgctttgctgagttttttctgcacccaaaggcatcatggagcacatcgttgtcgaaagggtgaaccaattcggatactgggaatcgacaacaagattcattcaggtccttgtcaaagattggtcgtaggtggaaccggacaacggcacggaaccaccacgaattagcagatgccccacatcaataatgcgccacggcccagttcagagcgtagcaattcatgaggatttttttggcaggaaattcgtaccctttgcttttcggagttgaaacgagaaaacgcaacatcatcaccaattacaccgcatcacctgctcctttggaaaatactcaccggccggaatggcaccgcgacgacaacggcgtcgacttcaatcgacgtgatttgggcaatcagtgcacccagaaatcaacgagacagccaaagctttggactttcgggtccggttgatatcttccaacggtccaaggcctatccaaaattccaaatatcccaactcgaataaaacgaggagaacatgcatgcatcaaaatgttgctgggctcaaaggccttaaaatgttttcgttgcatggcctaccttgggctaaatcagatttacggcttgtttggtttctagcccaaatcaaaggaataagttcactttgggtccctctatttgtcgtccagtccgattttcgtcccttggttgcaaaaccgggtacgacaggtcccccaacttacaaaaccgtttagattaggtccctcggcagtattgtgtctgatttttgctgaggtggcgcctacgtggctccttttaattagtttttgtctaacgtgtcattgatgtggcgtttacgtggctactagattaagggtgtgtttggttcatagtaagactggataggatatggccatccatattttgagggatatggtggtccagttttttgtttggttgggtggatgagaatggattgaatgaaaacaacaacatattaattaataatgaaatatgttaattatcattaatatagccataatttatactaattaacaataaaatagagtaattatatctaattttgacaagctaattactgattaacaataatataatttaattattgctaatcaagaactaatgatcaaaattagcaaaggtgaatatcctcatccggccaatttggtcgcatacactcatccagcatcttcgtggaatattccctctccaggccgtcctatccaccttcgcccaccaatcaaacacactcaaaaactggatcgccatctcccatctagggatatccctccaaccaaacacaccctaaaaaaaacccgtgggacccacatgtcagtcacagacacaaataataaaaaatggtgggcccatgaagacccacacatcattctctcttttctctatccctctctatcctctccctccttcttatctcgctctccaagccggtggagcggcatgggcggcggccgaagcgggcgacggcgaggtggagcggcagccggagcgggcaacggcggggcggatccgaggggcgaagtgggtcgggcggcggctgatcctcgctgacacctcggtcagcatggcaggagagtggaggcggccgttccgcgatccgccggaaccagcctggcggcggtgacggcgccaccacgaagccgagagcggagggcgatgccaagggggaggacgatgccggagggaacgacgatgaggaggacatcgccggcgccgcgcggtccccctgacccgcgctggcccccgccgcacggaggatgggggcgtcggcggcggcggtgatggaggacggaggcaactggatcgagtgggcggaggaggacaaggagaaggtgtgggcgcgggagtcggcgcccgtcacagagatgcgccccaccggcgacgagcgaagccggcaggcgagaggagaaggaggtgggacggtgacggttgcaaggtcgacggtttggtcgccgttgacgaagacgacgggcagcatggccttgggccgcggtggcagtgggggggaggcacgtggacgcgcccgtgcaaaccttcgcctccgaggacgcaaggacgcaagcggccgtgactagcagcgccgacgcgggagcagggcggcggcggcgctcgggtctacacggcgctagctctagcggcggcggcatcgaggagggtgtcggcggcgcgcggggccccagggcgcaagcggaggatgccgtcgcccccgtctctgtcttctccgctggcacccccaactcgccaccggggcagcctcgccccctcgaactcgtcggcagtgtccgcatctgaccctaccccgtcctggtgggagacggcgaggtcccacatcctcgcgctctccaacatcctcccgccgccggccgattccgacgtcgcggcgctcgccgactccgactgcccggcgcacgcgcttcttcggtcacccgcgcgcctacgccgcgctgtccacggcgctccggtcggggggtagcaccgaccacgctcgccgcagccgccggagctcgcctgctccgccgcccacacacaccgtccgctgcccagaaggagagagagaggggaaagggaagagaagagagaatggagagggaaggaaagagaagtgaggctgacatgtggggcccacatgggccccaccattttaaaattattttttgtgtgcagctgacatgtggggccacgttttttattattttgctgggatataattgccacgtaagcgccacgtcaatgccacgtggggtgaagacctagtcaaaaaagccacataggcgccacatcagccaaaaccgccgaaggacctcgtttgcccggttttcgtaagttgagggatgtgtcgtacccggttttgcagtcaagggacgaaaatcggactggacgactgtggggacacccaatttaggcttgatgccccaaaaatccactcgtgatcgtccaggatttcaatcacgcacagattgatgtacagaacagctttcgattatttacacaggtttattcatacaagctaattatactactgttaaaaggtgaaaagatccaaactaaagaaaggatatttaaagatatttaaagaaaggatatttaaaggaaataaagaaaaggtaattaaataaagaaagaaaggatatataaagatatttaaagataatttaatttaaaaatggttttaaataaaataagaaattttaaaattaaagggatttaagataaatcaaataggtttaaattaaaagggtatttaaacaaaattttaaataggaaatttggtatcaaaagggagggtttgaaattagatgaacttagatcaaaggttcactggaattggatttgtggttggagagatatgggtgcctaaagtttggaatttgaaataactcaaataaaagaaaagggattactgtacagtggggcccgcttgtcatatgtctcttctacctcttcttcttctctgcttctttgatccgagaggagggagagaagagggcgagcggggcgccggctctccggtggccgggaggtgggaacgccggtaggagatggtgttcccgagcaacgcgcacccggagagggtggtggaaggcggaggaagagagagggatggccggaacggcggcaacaagagctcagttccggcgataagagaaggtggtggtggcggcttatcccaaggtggagggagaggggaaagggggaaaatggaatcatctgggcaaggcggagttggtggcgcaagggtttggcttgcgaagcttcggtgagggagatcggccgacggtagtgatggccggacatgggagtagagagagaaaaagggaaagctccgttgtggagagggagaggggcgacctcgttttctatttataggtcgcggaggtcggtttggagagaaggagagcgactaaggcatggcgacggcagcgaagagaagaggagcacggcgccgatttcttagcaactacggaaaagagtttgcggcggcgtgcgccgtgcgcaacacgtgcactgggaggaggagagaggcggctgggctgtgggccggctcggctgggcttcggctcagttgggtcggcagcccaagaaggagggaggaaaagaaaaggggaatgggccaaaagaaagggaaattggcccaaaataaataggaagttttgataattttgtatagaggattttgaatggaatttaaaggagatggaaactaaaggatagatggatgtggatttttttaatcttagtcaaagaattgaatctaaggaattttgaatggagggttaaataaattttaaaggagataaaatttaaaagagaaacgcttgagggtcttttgaactttataagaggaatataaagtttttttaaaagcaaaaatgagtttaaaatatttttaaaataaaatcaaatatatttattttgagatataaattttgaaaaggataaaaataaagatgctccaatttaaatagaattcaaataagaaccaaatgtaaaacttgtcacgaaagatttaaaaatcaaacggaaagaaaaggcaataatttaacttctaactttggataaatttgggatggtggcaaaaatagatggaggtaaaaactaagattttagcctccaaaatatgtggtatggattctcagtgaattatttgtggctaaaggaagttggactttgaatagaagggattgcaaataagtttcttagcacaagagcaatcattcaaatatttgtgataatattattcttgtgccaagaatgtgatcaagtcataggaatcaaattggtggatggatcaaaataggaacttgaccacagaatattttggatggattaaaaggagacaaaggttttcggagataggtttagataggggttgatccaaaataaattccaatggaaagggaattatactggtttaaccctaaagataaaaatggttaatggtatataatagagagttgggtcaatcggggaaatattggcccaagctaaatggtagactttgtaatcttgaatggataatttaaatgaacgagatttcaaagtggtaatatttgtgagagtatagaactggatttggaagtatatgtggatgggaatttttctaggaacggaattggtggtatattgataaactctaaatgatgggtatgttgactcaaaggggggattgaagaggatatttttagggactctaggaatatttaggtggagatccaaaggaaatgtatcaacatttcatgtattctggagatagttgagtggagatcaaaaagaaagtattgcttcaggggaaaataataattggtatttgtggatgttggagatgttcaggaatggaatcaaaggaactataatctagagccaaagttagagattaaagaaaataaatagagaggttttgtaaaatttaaaagagagcgattaactttgcaaataaagttttaaatccaagttaaaagaaattaacagaaggtaagatcacttcaatagaagaatcgagaagagtgcaactaaaatatttcgcaaaaaaaatttctctgaaaatttgagtccgttacaacgacaaatagagggacccatagtgaacttattcccaaatcaaacgcacctaccttgggctcaaaggccttaaaatgtgagacgatgattcatttggtttgttgccaaaagagttggtagcaaaacgtaacccaagtctatatgctcccaaaaatttggaaagaaagctaacaggcaaacgacgtcaaatagacaaagaaataagttcactttaggcccctctatttgtcgcccagtctaattttcgtccctgaaccacaaaactaggaacgacccatcccccaacttacgaaaactgggcaaacgaggtccctcggcggttttgataacgattttggctgacgtggcgcctacgtggctaatttggctcggtcttcatccgatgtggcactgatgtggcgcttacgtggcaattcgatccggaaaaataataaaacccgtgggacccacatgtcagtttcacacacaaaataataaaaaatggtgggccccacatgtcatcctcactcctccctcttctctctatcctctgctcgccgccgggggagcctacctcctcttcctgctcctcttcaagctcccctccatctccatctccgtctccactgcctcgccggcggtggccaccacgcaccgcccgcgccaccgcgagctcgaggccgcctcctccatgctcggctactactcctcctcctcgcctctccgcccgctcaagaccgccttcccttcctgccgtccccactcttcgtctcgtccatccgcttgcgccgctgcaactcgtcttccatcgatgcttccgccgcctccgccttcactgctgtgcacccgctcatgcaccacctcctctcctcctcctcctccccttccccgtcatcctcaccgtccccatctccatccacgtccgattcatgcccgtccacgatctcagtgcctacaccgcctacatgtactgccgatcctcgtgcgacttaatctccccgcgagcaagcgcggggtaggaggccccgacgaattgagctcgtgcaagaagatgacaaaaatcaagaacacgatgcaagtatacatgtttgggccacacgggtgcgtaaggccctacttctgtgttttgggagatgtgaaacgtattaagcgaccaactctagattagatgccctttttccctttctaatcttccaaccccttgctaagggggtgtttggatacattagtcctaggactaaagattagtctcaggactaaaacattagtcctttttagtcctagcctgtttggttgaagggactaaataggactaaaaccacattaattgagctgtctagtaggtattcataggtactttttaatgaacatgcattgcacaaaacatcccctcatgcagccacagatcaaccaagaccatcttgcggcatggcaaacagattcacagtagagattacaaagtacaagaagatttgttcacaatacagagttaaaattcaacacagttttaggccatcaagcacagtttgacagcaccaccatatgcagacatatagcatacacaatgaaaagtacagtacatgaaaatgcaaattcccgcatacatatcagttattacaagttatatgttccaaagtccataagatgaataaaacaggagactacatattttttaaactccacagtccattggcaaccgtgtcccgaaattgattcatcacttgactatccaaagagctggttggatcatttgattaaggactttgctcagacaatggaacatagctttcatcttggtcacacatgtcgaattcacagtcggctagtttactatctctaatgaaattatgcaatgctaggcaagcgcatattatcttactctgtttttgctgtggatagcttggtaagtggaacaaaatcctccatttatttttgggtgaatacccaacatgatccttgaactttcgcttaaggatcaatttagtccctgatatttcgtattgtccaaacaagtaccttaagttcattgtgtgattcaatatagtccttagaccctctaaacatgccatgtgtacatgccacatcatctctgcatgcaaatttaatatttaaatgtcctttacacccttatgttttcataggaaataaagaaaaactattgagaaaacacacaaaaaaaaagcttttgaccattggcaaaaatatgtagcattgatagataaaaaaattgacatttttctttgttttatgattgctttttcttgtttttcttttctttatttgatagaaaattgaaggttaaaatggacatttaaatgttatcttgcatgcacgaatgacgtggcatatccacgtggcgttttaagtgggtctaaggactatattaagccgtatgataatctttagggtcttgtttggacattataaaacatcaaggactaattcgagccctgagtaaaagttgaaggactaaactgcctattcaccctttatttttcaacactccaaaggacctctctatcacatttcgacacgaagaatggcagtagttaaagtattccttcctatgttggggcattatgccttcgttgtattcctgaaagtgataagttattcccttatatggtgcaagataacccggcctgtttgggtaccctgagtccacgagatagaacatttctaacaaagcctgtttggttgaatgcctcattttagctcttaggaagaatttttccttcaagttcttatatcccctagttgtccatcctccttggggacaatttccattccttatttcctcacaggctactacacacaacataaaagtattttcttctatccaacaagccttgtcataaggagttttatcctaaagaaaaatttattaatacatagattaccatattctgtcctaacaaagccagagaaaagtataatgcatctaaaatatacaagatcacagatccaagtctaaaatatacaaccattcatatagcatgtcaaacaggattgtatgtgtaacatttcaccagatcaatgcatgtaacaaaagctcatcaaagtaaatgaaaaaccaatgaatactctggtttggatgattaccgtgcgttgaccatcgttgtcgtcttcgtcatcgtcctcaacgtcgttgtcctcctcttcggcagctgcggttggggcagaggacgtcccagcatcccatcctcctccaccgaagcccccataccccgtagcaccgtgggacatagagctcccacggccgctgacacccgcactgtgggacatggagctcccatggcccacgacacccgcaccattggacatggagcccccacggccagggggaacgaatcccctcatccgattgccggcggcggcaccaatggtgccatcccttccgcggcctcgacctcggcttcttccacctcttctgccgcccctggaaccaggtactggacggcgcgacggggcgatgtcggatctggtggcttggaagagtggaggtattcctccaccatcttcttgcaagatctgctggtaggagccgaaatcggggaagtcttctgcttgggagtttagatccaggcccgccgatctcctccctagaaaatggtagcccgcaccagatccgccatagcctaaggaagcttggctgaatctgtactcggtggcgtcaacggaggcggcttcgtgatgtgcttgtgattgggagaaaaaaatcaaacatgtcgtcgtcatggccggccatggctgaagggctacgagcggcggcggcagagacggcagccgcgctcacggcggaggtggcggccgcgtgaggtcgcgcgcggcggcggcctcgggagctcgcggaggcggtggccgcgggagcttgcgcgtggcggaggtggcggccgcgctcacggcagaggcggcggccgcgtgagctcgcgcgcggcggccgtgggagctcgctcggcggcggccgagggagccttcgctcggcggcgtcggtggcggcacttgcgccggatggggggagtgagtagtacaggagagagatagcgaagtgtgtgagagagagaccgagtgaagtgggagtgacatgatagggttaatgcgctctgttataggtttttagaccgtataagctcctcccccagcgacttattggcctatgctgttttagtctcttttaagtccctcccgtttggtagtttagagactaaaaaatgacttatttgaagggacctatggattagtccctcaaaccaaacaccacctaagttgcataactcctcttatacttcgaaggggagcctgcgccattacattttgcatagggttatgtctatgtctagtcttgtcattgtccctcctgtcacattagtctgaatgtactcattgctactgaccgagcctacgcttgtgccccaggaagctgagcatggggcccaggacagctggaacgagcttctagcgtcacttatcgtgaagtcgggcctagtggacctagatgagggcgtaggggattgtccgcccttcataacaccatgcagccataccaagtgttgctcgctggtgcatggcgcgttgttctagccctattccttcgggtgacacaactagcttgatcacttcataccttgccacctccttcttgcatgtatctgagttgtaatctcgaattgtaattatttgggtaccgctttgctgtggtttaatgtcattgctcgctgggcccgctaccctgcatagccggctgggagatctccaccaagctcagggcagcgagcaccaccgatgtggtctccaagtcaaacccaagtgacatgtgcaattaggctcgccttttgacatggtaatattatcatggccggactcatgccctgagaatgcaagcagtctgcaatctcaaggcgcggttcgtgcttggcgttggatccgtgttcgggccctgcaggtaccctcgggtctgcacatgctcccatgctgcttgacgagatgtcgtgttatttctgataagcttctcgaaaacgtcgttgatgaaggatttcatgatagacatggcctcagagggagtgtcgatgttaagatgtggatcttgtaggtttccgcactcttcttgatatcttgaagatataaaccttgtgtggcgttaggcgccgggatcccagggcccaggatgaaccaagccttgggttcccaccttacgccacacatcacctaccaccttagtggttttctgataggtaatgaattatgtttgtgtgaagacgatcctgcaagcccaaggtgcaacaggcccttggaggaacaagaccctggttcccatttctctagctaccaacatttggtaattataaaaatttctactcgcagaactaccaatttaaggtgtcaaaattttggcattagcaacaaatgtgttttttttttcagtgaactcaacaagcctttcgatctaagcttcaaacttcaaagagaactacactgatgcatcacaggagatcgaagcaaagagacgatgaaatggtgcaagatcattgcattagaacttgcaaggcacatttggtatacatacatggttacatatcacccaccaagaaatatattgcactgtggtagatactttgaaaagaagatgcagaaaactgctcaactgggcaagaaaccagcaaaatgcaggagaaggttacaggggaaaacgcctctagtggagcagggaaggagatcaccgaagagcgcatgggatagcaccgtagcaaccaggccaatcttacaggatcacctcccagccacaagaccactgaacacttggctgttcccagctagcgtcgcttcccactcgatcgacgacagcagtatttgcgatagcgtgattactgcctgcttcatgtctggccgaagaacaggatcttcctccacgcactgtttcgctagcatggccatctttataagaagaatttagagtgagatttagctttgaagcaaaggtatgtgaaatgtgcaggagatgttgatcatcaagcaccaacagattttattgtgcataccttgtatacacagtcatgtggatacaggtccattagattagggtcaatgcagtctttcaggctccccatatacattgagttacgacaattctttagtgcactcaacatctgcattgttaaaactaaattagttcaaaacttttggagtcaaaatagcaagtaaaatatactaaaacttcaataaagccagtgaaaaacactgcaacttgggatggcaaaataattctaagcccgtaagttataatgggcatatatgttcaattgcttatgctgaacctagaaaacttacaactgatgccaaggaacgcctttctgagtttgatccttcgttcaatccatcagtccttgtaattgcctcctttccagatattaactcaaaaagtactactccaaaagcataaacatcatttttcgtagttgccaggccatcgcgcaagtatctacaggaataaatgaaatgtcaggattgagctagatatttttcttttccaaatccatactgagctaccagaaaatgtactcactcaggggccaagtaaccaaatgtacccacaacttttgtgacagaagcctctgcatcagttgacttcactaccagttttgcaagaccaaaatctgaaatctacggagacagaaaatgcaggtaaacaagctgttctaaatggtgccaggagaaaacaaatcagtaaacaaatttcaaatcaattaacctttgctctgaaggattcatcgagcaagatgttactcgatttgatgtccctgtgaacataatgatcctttgtatgctcatgaatgtattcaagtcctctagccgcatcaagagcaatttggaccctgtagatccaagacaatgatgtgtaacctgaaaaagaaacaacacaaaatcaatcaataacgatagaaaatgtatgtgtgttcagaaaagaaaagttaacaaaacttgagttagcagcaatcaagaaatgttctcaagcagcaatattttagaacttgtacataagggttgcttttgattggtacctactcaacaaatacaatatcaaaactgctggaagtggaaacattacatggcgagattacccaagttaaacagaaagcaattagtaaatcactcgtacaagtcctaaatgatggtatacctttgctttgaggatcatgaaggtgattcttgagtgaacctttttgagagtactcgtaaataaggtatagttcatccttgcttgctgcatagccaatcaactctacctttgacaaatcatgggtaacacaaatgaaattcaataaacaggatataagacataatctattagaaggatttacacaactgtaaaatggcataccagactggcatgatggaccttacaaagaactttcatctccactataaactctttagttttagttgctgtcattctctttatagcgacctcctatgaaaaaacatatttgttattggcaagggaaaatcacaacagttttgcatggatatggtcagctcagatcacatacctggtctcgaagaacaccataataaacagagccatatgtaccatgacccagaagatttgcatcagaaaatgaatcggttgatgcaagtatttcttgataggtaaacacaatgggcttctccctatcaaacacgtccactacaacacctgcatgagaggaaaattgagaacagcttgtatgtgagaggaacgaaagaaaattagaacaaatcaaagcagagcgttctaggctgctagaaatggcttgtcacactaagaaatcatgaagttgtttagttgtgaatttgtatcttgacgttttgttttctttgatattatttggacaatgtacttcagtatagaagttcagatcatcagatgtgtttggtgctacttgaactcatacaaaaatttgaacagatcgtattcctgcttaaatcattgcaggaaaagcaactaagcgatgctgacatgagtgtcatatgcaatgacaatataacattttgaaaaaacaaaacccctaagggatatgcatatgacaacatttcgatctttaatatgcctatataaggcactagattcatcaggccactcctatattaatatccacgcaaaatgaactcagcaaaacccattcaccactgcattgccgtgctgtgcagatgcagtggccaggaattattcccatcatatatatacaaaaaaaacatgttatgcagcacaatgatggttaaaaggagatgaactaaccttttggggtattcatatgatgatcactgccatccgttcttgattgtttcacatttccaaattggcaacataagtatcttccagaaccataacaaaaactaccactcttaagaagttgaaacttgtgtgatatagactggtctgggctctttccctggttatttggagcttggggattgtattgggagagcttgcacagaacaagtgcaaggagagcaatagcaatcaaagcaagtgcaactcccatgctgccaataacccatccataagggaattttgtggaatgatgttctgatacatctgccgatgtaattcagaaaaatacactgttagtttatcataaaaaggaacatctcaattgtaggctacccaacctaacaaaaccaaaatatttcaacattaatacttgaagaaaacaataggacaggatcctcagaatgaagtgccaacaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcctcctcattcggacacttttgacggtgagttatctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaaacagaagtactacatgaaattcaggggaaactatgataatactcgtaagcacctgctgttgtgatcgatcaaatcatcaactgatgattaggccgcttccacgcggacgggcacctcacgggtgatgtgcgattagtgcgaacgtccggtgccccgcgtatgccgcgcgcgctatccgtcgtacaggacgcgagagtagctgttacgtctcccggccggactgttccagtgtcctgtgtccacgcgcacggtaccgggcggggcggccggtataaacgccgaaaatacacgacagattccataaaacaaccccgcacatgagctctatttagaagagaacatggcctgcttcgatggacgcaataatggagatggcccagacgccagtgggtgagccccatcaccgtggagttcgagtgaaacactgaaacgtaaccaagccgatcgataagacgaggccatcgatcacagcttcacgtacacctttcacggccacgatctgcacgaaaagggaggagtccaaaacatccgaggtgggggctactgattgacgtggtggaccattttaagactttgcagaccgcaccacgtatatggcgtatatcctcaatattggaccttggtccaccactccagcctggggacaggcccgaaatctttttatcagctacagtaggtagctttcatacacaaaaagatgatactgtagatgatctcccgtttgcaattcagagtacagaccgaacctcggtttgcgatgataagtagcagtctagcagaaacagtgatccactgcttagctttacctggcctatgttagaccgtgatatcgtttggaatacattcttgcttgctgctagaagaaaggctacctacacaaggtcacacctaatggcaactggagggtgggagacacagaactacaaaagcaggggcattcatgagtggtgggggtacagccaggtagtgctgcactgcccgcgtaccactgtccagctcgctaagcgactcatgtcatgtgttaggtcaccaacacgaagcgctttctcctctccttgtctcctctcctgtgttgctaccagccctatgccaatatcggaacaccaacgaatgcgtgcttgaaaattgctaatggaaattgccaaatttcatgtgctctcagtcgcctttaacctctagaatggggtagacaagaagataggagagccaggggtggtggcagccagggcttgtcggcgacgaccgacgaccgcgagctccttgacaaccccttccatcttccgcaccgtgaaggacacccgaattccagcaacggatgtacggattatggggtttttagggtgggggttagaggaaggggaagatgatgttttttccgagcttgaaaggatggctagggagatctgcaggggaaaaggatgggcgacaggatggtggtggccgtggcatcgctatagctgaggctcgaggacacgggcatgcattagatcaggagtggttagaggacggagtttaaatagtttaccttctatacctccttaattgatgagatggaagaaaaactttctcgccacactgcgtactataattcttctcttgtgtgatgtatactccctccggactgataacacttatcattttagacaagggtgaggtcaaactttagaatctttaattatgaatcatttttaaaatatttgtctttcaaatatggtgactacatgtatagcttagtcaaagtactttaataaaatcatatatttgttagagaatttttatagtccagtaataggtaccgcccagtactgatatctgtaggtacctaaaaagatcggaccgttcaattcggaagcgtacgatcgggagaaaatgtaggtgcgctcgcttgccatctagtcgcagcccacacgcgtgtgtgccgtaatcctttccccttccatgccctccagcggcaactcctcagccgccacgtcctcctccttcactgccaccgccgcgtccccttcctcctccgccggcgcctactcccccgttgttgcctcctcctcctctggcactgccgccggcggcttgaaaaggatgagagaaaaatagggaaaaaaaatcaaggccacgagtctccgtcgccatggaggaggagagcacaagctccctgtctactcgcaacggtgaggaaaaaaaggagcaaaaacgaggagtcgaacaaatcactctcatgaatgaatcaatagtttactcttttaccagtttatcagtgagtgaccttggtccttaccagaagcatattagtcggagtcacccaccggaccggcaacacaaccactccggccttggtaccaccactgtgtgttgccgtcgagggtttcctccagccactgaacagctcgcttggtagctagcttcctcgttcagctccacgcccttccatgtgtgctctacttcacgctagttgccgcatctagggatccacacgcactgccgctggccgtctcacatgccgccgccgtcaccggccgcctaatccgaacaaagaggttcaccggctccgatcgtttcaacctcatatccaacgcaaaaatacagttttacccttccacctctatctcctttggccggtaccacctacaaactgaatggtacctggaggtactgattgctgttagccgttcgatccatgcccctcaatggttcagatttggtaccgacccaggctgaagaactgtaaaaataatctagttgttaacatttttatacatattataataaaaaataatggtcaaagttattttttagaaaccgtacccttgtccaaaacgataagtattatcaatccgggggagtaccatatataccactaatgagtaaatatttttttctttgattccaagatttacatgtagatctcataatatataactagtgggcttgcattttttttaagtaatgaatgggaatacaatggacatgcgttgaacttggtcttctaaaaaggacagatatatggaacttggtgatataaggtatatttgacaaggctgtaactttagcttcattcctcttgaagctagagcccaaccaaaaagttttaattccatctaaagaaatagtagagaaggttacagtgatctgaaaaaataaactagagaggtgcatcgggattcaaactccattcttgaaattattgtttggaaattggagccatgtcaaacatggccagactagtttgtagatattagtggatacttagagcctcttttggggagcttctaacatatgcagcttctcctagaatctctaattgccagaacctcctttaaacagtctagattttcagatagattataagaatgtgtagttgtagaatctaaaaaataaacaagaaaatacaagttgggaaacccaacttttccaaattctcactagctagcttctcaccaaccgcttctcagaatcttggagcaccttcaaacaaggccttaggctagcggctaggcgttggctgctctatggggcctagagcctaggttagtcgcccactggccaaacagatgaagtagagttatctcccatggtccagattggcacggacatcccaagagcaacaaatgttactcgcttgccaagttatcggacagaaaatgaataagtccactttgactccctcatatatagctccaatctaatttacgtccctgaaccacaatatcggatattttgactccccaactattaaaccagtgtaatttgatttcctcagcggttttggagggcggtttcgctgatgtggcgctttgatctgatctatcccgctgagtcaccaagtggagccacatgtcattctctcactcctttccttcttcatcccgtagacactttggtctatggagaagccgaatagggaagaggaagaggaagaaggtaaggaatgagataatgacatgtgggccccatatgatgactcagtgttatagacctagtcaaaagcgcaatgtcagcgaaacaaccctccaaaaccgctgagagagaatcagattacattgattttaatagttgggggttaatatatccggtattgcggtttaggagtaatatgaattaaattggaactatattgagggagtctaagtgcacttattccgacagaaagacataacactggaaatggcccaagcttcggcttgacaccattttgggcctaaactacttactgcttatcaggccttacgccagcagagagctcggcccattttatgccctagtgaagtctacgcgtgcctaccgactaccgagtaccactgacttgtccggttgtcccgtaatgcaggagcggcggcggcgtgccagcgccatcgtatcaagaaacaaagaagggagttactccctccgaatttgaattttaatgtataacgttgttaacttttcgaccaacgtttgaccattcgttttatttaaaatttttgtgcaaatataaagatatttatgtcatgcttaagaaaatttgatgacgaaccaagtcataataaaaaataatatttacatatttttttaataagacgaatggtcaaatattagataaaaagttaacggcgtcatatattaaaatatggaggtagtacaagacaaaatgagataaaatatggtttcagcggttacatgcactaagaagttgataaaggatatctatcgcgcgcctagcggtttcatccggctgataatgtcgcttatgcctgatcagctctaagttcgtcacttcgtgggctcgtggcgctcctgcctaccgcgagaccacgccgagcagcaagggcaatgacccagcaacggcgcaccgcgtatgactatcaacgcgcggggagaaattaagcagcagcaccctgaaacacggagtgttcggctcgtcgcgtcggcgtcgaaagaggcaagtgatgcacgcatggtgcagatcgatcacggcggaaggggctggcgacaacggctcgcgtcccgtccaaggtgaggaggacagtattcacggaggcgagctctaaccgcacgaacggagccccgatcgaccaggcgcaggcgcggccggaggataaacccgtgctcgacgtcgccgaagcccgaagttacaagcgacacccccggctagccatgctcggcgccacggcgccgtggttcatcgcccgcaaggtcctctcacgatcaaccagaggccagagccggctgcagctctccatcgtcgtcaagggcaaggacatggccccgcgcctgctcatcaccaagaccggccttgacggaagccgagaaggccctcgtcaacgtacaagcgcggccgggagcccgggagtactcgctgaggttcaggtactcagcggcaacgccaccagctaccagctcatccgaagctgggtgaagttcctgagagagaatgaattactcatcggcgccacgcggctataagtttgaagcgccgtgtgtggaccgtggggatgacctggagcagtgggcattacgctcgcgcgaactgccagcctgccacatgccacgggccccgaggatgccggccacccggatggcgcgctagggtttctcgtgttgcacggcgacgacgacatggaggagacggctgccgtgatcaaagaaagaagaggtgcctgcggctgaccatacgtccatacacgtgcagagaagggtgaggagaagtcgagtttgatcgcaaaacttgctgcatttgtgatggtgtacgtactcttgaggacaagcactcgatcaagggaaacgaaacacaaaactgatgacgatagacgaaggccatagaatcttgcatgtatgcagcagatgcacgaggaaattaattgttgtcagtgctcttaagagtagtatgttacctccgtgtcccgtttcttatacacgcaagtttaatatatagattattgtgtaatctatcactttaattattaacacataccccctccgtgtcttaatatgagggattttgacatgttacttgcactggttgaccatttatcttattaaaaaataaaattattatttattttatttgtgatttactttattatccaaagtactttaagcataactgttcgttttttatatttgtataaattttttgaataagacaagtggtcaaacagtgcaagcaaaatgtcaaaacggaggaagtacaaggtgaaaacctacccatgaaaaaaaaatcattatggtgcggtgttgttgttagtcggatattctttttagttgctccatgttagagctcgtgaatgatagtggcactacaattcatctagttaaatatttttagtgttttttttatagatatatatgcaagaaaaaaaaggtgtgcccttaaatggcttaaaatatagtcccacgctatatgttacaggcattccccctgtgtaaagggtgtgttctttacaacatcttcctaacttttactttctcttctttcgtgcgcacgttctctgaactaattaaatggagacgttttttttagcaaaagtttgctatgagaattactttataatccatttctccgctttacgtgcccaggagaaaacgtttctataccctcccctaaagaatacacccatccgagctgggaaaataccttgactttggaagggtgccaatacattctcttcaaaccttgcttttgagaaagcaaattggatgtttttgtagctatatcttttactacatactcctaccccagtctacaaatatgattttttttaaatttttaatgttaaaaataaacctttctgaaacttatttcaagatctgaaccttttgaccacgggctgacatggtaggataaaactgtcacgtacgcccgtagcgggtggcgtgacagtgttattttgccacaccaaaatatttagattttgagaataagttttagaaggttttatatttaaataaaaattacaaaataataaaaattccacaaatataaggcgtgtaggtgcatatcttcgagttcgatagactgaggtagtatgcgctagttatagatggccatatggcctgtggcccgcggctcggcccaaagaacgcgtgtttggcccggcccaagcacggcgcggcccgactggagtcgtgctcgtgccggcccggcccgacagcgggcctctgtcgggccgtgcttgggccgcgccatcggcacgctgggccaacacggcacggtggaccggcatggcctggcacgctataacggcaggcacggcccgaccgaggcacgcacaccgcagcccagcccgctggcccatcgcctccctcgcatatataagccgcccccgccgctccgctcctccgcctcctccgctcctcaaaccctaaccctagccgcctctctctcgaccgctcgtctctctcgactgcttcgtcgctccaccgcctccacgcctccactccacggctccacttcctccacgcggaccagcggaccacgcctccatcgcttcgctcttcgccggatctagcaccgacggtcgccggcctaccgctggggacatgaggggctgagggccgttcttctctctctttttctttcatctccacctctccgatggccacgctatcgatttcctctttttttttgccaccctcgtcgttgctccgtgagcacttcgtcagatccacccccatttccagtctctgttctcgtcttcttgtagatctgtcgatctctgtcatcaacggcaactccggtgcttcggatgcgtaggtaggtagagtaaaaaaagtccatgtttttctttagttttttttccatgcgacccctaaaccctaattattctctgtgtattgtaggtcgctgagcggtgagcgccagtggtagccaccgttgaggaacagtagtgtcgtcgatggatgatccatccttctgcaacttcgagttgaggctattgggaatgcggggtgatgacgaagatgacttggaggaggaacgcgtggaggtgttcggcaacactgcctcgcctcggatcgatgggtcgcagccggagacgaagacggagccggacgatgacggtaccggtgctggtggcaacggcgcgccgtccggctcaagtgctagcaacaaacggtccagatctcaggtatggaacgactttgaagagctctatgaatcctgaaatggcagtcaggtttgtgtccatgctaaatgcaattactgccataaaatcttgtctgctttttcatctggtggtactggacatttgattaggcatattaagtcatgcaaacctataaatgctggtgctctgtctcagtctatgctccggtttaatgctgatggttctgttagtcaatgggaatataagacagatgttgctagaactgagttggttaagttgattgctagagaggatcttccactttgttttggtgaatctgctgcttttgaggagtatattcaaaaagctcataaccctagattttgttctgtctctagacaaactactagtagggatgtctttaaggtttttgacagtcagcgtgctatgcttattgagactttaaaatctattagctctgttgctttgacttctaatatttggtctggtaatgctaaggaggattatttaagtgttgttgctcactttgttaattctaattggcaattagggaagaggattttgggtcttgtgctgattgatgtgtcacacactgctgaaaatatttcggaacatattctttctgttgttcaagagtatggtttgactgataagattttctctgttactctggacaatgccgctgctaatactaaagcaatggatcatctaaaacatgctatctctggttatgttggtgatttatatttgcatcagcgttgtgcatgtcatatcatcaatttaattgttaaggctggtcttgagatcttcaaaaacatgctggctgattttagatctgctatttcttttgtgaatgcatctaatcagcgcattgctttatacaaaagcttctgcattgctaagggtgttcgccctcgtaaatttggtttggacatggatgttagatggaatgcaacttatttgatgcttaaaaatctcttgccacataagggtatcttttcagtgtttattgcaactaaccatccacctgttaatggtcatgcattgttgactgatttacactggacaattgctgagactgttctgttattccttgaacaattttatgattcaactattattatgtctggtgtttattatccaacatctccattaattatgcatcacattcttgagattgctggacatctaaatacatatgagaatgataggaaccttagaaatgttgttattcctatgaaatcaaagttcttattatactggtctgagattccatttctgtattcatttgcttttatcttggatcctagggctaagatcaggggttttagcaatgttctccaaattatgactggtaattattctgagtatttaactgaggttagggctgcattgtctgatatttataagaagtatgaagctaagtttggtgatgtaagattgcaaagggcaaccccaagcagttcttgtggtaagaaaaagacagcttgggggaaaatttttggatcatccgctagtggttccagtgttggtgctggacctggtgtaggtgatggatttgctagtgccagtccaggtgctggacttagtgctagtgctagtccaattcctggatttggtgctagtgccagtccaggtgctgggcttggtgctggtctatttagcaggagaacttctgctactgctttgattcaagctgtttattctactgctaacatgaatgcatctgagttgtttgcctattttgacagtgacacagtcaaccaattcgatgacgacttcaatatccttaactggtggcatgagcacaaacacacctatcctattctttccctcttagatagagatgttttgaatgttcctgtttctactatatcgttggaatatgcttttagcttaactggcaggatcatcgaggatcgacggcggtgtctaggtcctgccatggtgcaagctctggcattgatcaaagattgggagcaagcagaatcaaagaagcagcattcagcggagaataaagagcttattaagtcttttgaatacttgtatcttgatgatgaaaccactggggatggggatgggactgggactggagatggggctagggctgggactgggacttgatgctatttgtattggacttggactttattatgaacatttgatgaaagatgtggattgcactcttttttcctttctagggttttctcacgaggtgtgagtttttacctagaaaggattttaatgaggcaaccattgcactacacagctactttatatttgcaaataattgccttgtgtctgtgatttgtctgaatcagtgaatgaatgagtgactgtatgactaaatgctttcaaatattgtgaatagtgcatctgtgatatgtgcatgtaattttttggacatgtgacttgtaattttttgaaacttggtgaatgaattgttgttaaagtttgttgattcaatctgtgaaatgagtacttctgagttctgattcaaaatgttggtgcaaagatctgctgaatgagatgtcacaggcttatcgtgcctgggctggcacgagcccaatgggctggtcgtgcctttgggccaacatggcacgacccgagtgtttgtgggccgtacctgggcctgaggtgcagcccgtgggagggcacagcacggcacgaagtgccagtcttgccgtgccggcccgattgacctcggcctaggcacggccgtgcttgggccgggccgggccgggcggtccatttggccatctatagcgctagtggtatggaattttgttatatgatcatgtcagccaaacttgtacagtccacaacctagatgtgtcctatagaacaaaatttgcagttggacataattagagctagtgtgtctttgtgcttctctagattataacttttgactttatatcagtaagactaaccaaacaaagaaaaataatcgtgggagatgttgaatattggtataagaaattgcctaacacgtacgtaagacaaaatcaatcacttgatggatgatggataaatgccaaatggttgtttaattatgagtatattagttggtgctcctattgttacacacatttgatcctgaatcgcccaccgtttgaaaggtggagttaaaaaataagtgtatctgagattggcaggttgcccaaattaaaatcgcagaggaccacatttggaccagcagtagttacaacacatgaggtgatgagtcgcaatcaggtaagctctcaatcaagtttttgctgagtttctgaccaactcgctgcatcaggatttgttcagcgacgtcaatcttccgctcccttcactgtccacagttccacatatgcccactgcagggatcttaagtgcactactcttgtagatctacagcgttcgtgtcgcgttgtttccagctaggagacgagccatccgatcggaatggccgtgcttaattcgggcgttcaatcatcaggaagcctgtcggagacgcagctaactttcccacagctagctcggtagctctgcttcctgcacgaacgcagcggtcgcaggcaaagcaccggaagacacagagagagacagggacgactccctccacaaaaccaaccgcgagtgcgtccaaaacacgcacgacgacgacgacgacggcgaacagtgtggagagaggcaatcaaacgtgcgcgcgccgtcccagtaaaggctgtgcctgcccgcgccccctggaccctgcgccgcgcgcggcagctgaggcgaccagggcgtcaccggcggcatcagggcgcgtgcatgcatggcgcggcatggcatgcatgctgcgttcgcgcgtgagacggcgtgcgcgatcagatcagggggagcgccagagcccgcgcacagtgcaggcgggtcgtcgcagccgcgcagcgcgaggaggccgatgcgcgcgggggccggatcgagggcgacgggggccggcgtacgtcgtcggcacccgcggctcacgagcccccgtttttctttctttctttttttgtttttttttgtcccgtgcccatcaatcaggcccctggccggctagctactagcctgtgcccctgtgcacacggccgcgccagccacaaccctgcctctgacgcgctatagctccatcgtctcatcacccgcgcgcagctgcgtacggtgtatgtaggagtacgtgcaaccgctggcccgtcatgcgcgtacgtacgtggaccatgcatgcaacgcagtcacgcagcgcgctcgcgtttggtgcgcatgattgaatgcgggaaaatgtttgcttcctctactgatgtttcaccactctgccgcgcgcgatccgatccgatgcgatcgcgcgtacctatacacgggtagctggagtagcatgcatgcacgggccggtgatgagtgatgatgcaaacgacaacggccgccctgtgacgtgccatggcgcatgccgggatacgtgccagttgtgtccgtgcgtggtcaccgatcgccgcgctgcaatgataaaccaggccatgaatccctacgacatgccaggacggcaggtccattttgaggaagcagcgaagcacagtgtatatggcactactgggcactgtgtgcgtatactgactgctactgttagatgctttttacacagatataaatcagatttctctcggcattcgggtagagcagctagctgtgtccatggagggcactaccgtttcagttcacatgattgaaactctcagttcctagctaggacagtccgaataaatttcactaaactttacaatacatattcatatagtgtagtgcccctgttttctttgagctttgctcctctacatgcaccgcgccggccatacctctttctctagtgaatggcaatacatatatattcatatggtgaaggcaagggtgatatggtgatctcgtcgagaagctcttacaataggtcgccggccatacctctttctctagcgattggcggagccgcggaggtaggaagctagtatgactagagtcataaggggtcaatataacaagagcgaatagagagaacaaacctccgtcaaatgcatgcttcatgtcaaagataaaagatagtgacagcggtgtgtaaggccgtaaggaataaaaacggtgcttaatggcatacaaagtatcgagcatttcgatcttcggggcatgaaaggaagtactacctccatttttagatggggcaattacaaatttaccactgctttgaatagttattgcaaaattgccactagaaaattacaaaaataccactataactatcattcgagtggcatccttgtaaaattgaaaaaccggtggcaaatttgcaaatgcccctttttaatatacaactccattgatcttttttatacattacgtttgataattcaacttatagaaaaaataagtatcatctattccctccatcctaaaatgtaacaacctaattaatacacacatcataatactagaaaatgtgtctaactagtactagggacttgtttagattcaaacttttttcttcaaacttccaacttttccgtcacatcaaatgtttggacacatgcatggagcattaaatgtggacgaaaaaaaccaattgcacagtttgcatgtaaatcgcgagatgaatcttttgagcctaattacaccatgatttgacaatatggtgatacagtaaatatttgctaataacggattaattaggcttaataaattcgtctcgcaatttacagacggaatatgtaatttgttttattattagtctacgtttaatacttcaaatgtgtgttcgtatacttcaaaaaacttttgccacacgaactaaacacagcctaggttactatattttggggcagatagagtattttgttgtgacttattttatcactaaaagaaagcatgacttgaattttttttacatctgcactaatttttttaataaacgccatgtccaaaagcctacatcgtcatataatttaaagcgagtagtagtaccgattagtgaatgtttagtggacatgtaagaaaattacccttttatccttttacatttttaacaatacatactataccaaataagaaatgtggctacaactctattgttacaataaaaaaaccagctaacacaagataaagaggtatttcccttttcttttggtttcggtcaatttggtgctagagttttctgttagtacattgttatgatttctaaagacgcagaatgcagaaacttgttgaggagaggcagctggagtatatagatcaagtactaagatttgagtaattggaggaggtatatcccggggttggtagccgctcttgtcgtaatgatccggacgcgtgtggctgatttcgacaaaatgggctttaaaaacttaggagacggaaagtgactaggctgtaatgattagagcacaagcagcacctattatactaatgatggatgagaggtagtagcactgattgagttttagatatcaattagaggaagctaatcatctgtggtaaaattggccagctttgagaaaaggatgtgctatttactctttatagttccaatctgaaaggagggaggggtacgcttttgtccatactgtttagattatgggcaataaaagtacatgctgcagcagcactgcacgcatgcagaccctaccagccgcatgacatgcaacggacggcagagggcgcccaggaacagcgaaagctaacaaatttgggatttttcagagggaagagccatactaaaagccactactactcatccttattagtcagaatccgtgctgtttgttcagtcatgttattttagaagttcagtaacatgttggatgcattattggtgcatcagtgagggactttatgcaattatttcaaaactcggcccggtcatatatacacacagacaatgtttggctaatgggaaatggcaatgattttccacccaccaaaatgcatctttaaatactaaccattcattctccctctttcatttaatcctaaccctttattcatttcccaattccaatctcaccctctatttcccattatccaaacacactcataagagtttgactgatctcaatatatagctgtatatccacgagtccaagaaaaaaaacaagtattctttttttcttttaacagatcgagtcagctagcccaaagttcttgaaaagtcagatgccggggtcaaaatgcctggagcagcatgcgcgcatccttactcaacttgcacgactgatgggccctcaactgtttaaagattcgatatgtcaacgagttgaaacagtaaatgttatcgccttcctttctttaagcctctctttctgcacttagctaaggggggccaatgtaccggccgaaagccagcacaatccggatatcaaacaagcacgagttttgtcaacaaagatgatctaatggtccaagcccaatcaattgtctctgacaagcatgaatagtaagcaggtggagctccactccaatccaatccaagggttcagcgaagatcaggagttcagacggggtaatgtcctcatcaacagtggtcccctgtggtcggggcgtggaaggaggtggaaccattccttacgccacaaccaacagcagcgccaatggccacacggatggagtatgtgcgtaagccagccaggaagacaacccatcaaatcactcatcgcgcccccacttgcccggataagcgtgccgctgttcctgtcctgggcgcacgccttgctcgcgcggcgcggccacaccctctcccatatcatatcgcccccaccccaatccgccaaacggcacacgcacacacgcgcaagaggacacacgggcgaaaaaacgcgcacgctttcgtgatcgagccgccctctcttctataaatggattctctactgtaattcacatgctaatcttccagccacacacctagtcagtcatcaaagtgtgcgtgcttctccagaacagtgagagagagaggggcaaagggaggcaggataaaaagccgagctgtaggggactaaagaagaaagaaaagcatagaaaagaacggcaagcaagcagctcgaggcacccgcgctagtacataaagccaccgaggtgcgatttcgcgagctctagccgcttccacttggccatttcccatctgcctcctggagctttagctctaactctagttctagctctagctccggctacgtttgcaactgttgtttatctcctggtgagtcctcctgtcatgttagccgtagattttggccggagcacaaggtgtttttgttgcttgctgattttacaggttgcaggttgttcttctctttcctgaaatggttttgacaaaagagctgttttgatctggggctgcctcaatcatttgcttctatggcaggctatacaccacacttttaagatgttttagcctcattggtattgtttatgtttcattatgagttattacgaaagactttaattaaaacaaacgtctagggtgctgcttgttgcacaaatgagttattcgttccgctttcaatttttcattgccagaacctgatcttaactccgtgtttttccgcgttctctttcgttctcgcttagacctcagcttacgcttcgggctggtttggtgcttttctccagcctaagttgagtgtagaactaaactttttaaggagttggttgaactcctctcattgccttcaaactcttcctactattctaggtggatagcatttagactcttgaagactttgagctagttaaccttatggaagaagggtccaacaaaagagaaggacttcctcctcaactcctagatctcatcccagatgagaaggaatggaagctgagagaagcattaggtctagggagatcaagaaacgcaggcttcgacggtgaagaagacaagaagctagacctaaagcttggtcttcctggttttatagaagatgatgaggcagaaaccttaagagattacaggctacagcaagagagcccatctctctcccttagtttctttccaaagcactccaagaccaccagcagcactactacgacaactggagcaaagaggggattcatagacacagttgaggacaaaacagaaggtaacaaacagcttttcagttctctcgtgagcttgttcttgaaacatgtttatacttgggattagaaacatggaaacaaactgatggaagcactgaactgaaaattactcttttgttgctttataaggttataacgaccagaagcagcaggcaagggcaggatgtgggaaggaacttgcagtggaggaaatgatagcagccgtgagtgagaggaagaaaggatgctgccccccaccaccaccaccacatggtgctcctgctacacctgcgcgcaacagaccacagacccagggaaggtactgatagcctatatggtgctttttccatcttttctgctctcagccaaggaacacatgctcgtttattcctgtcactcatttatagttcattcgaaggattgcatatagtccctccatgctcttttccaggttcccagaaatcgcaggtgtcctatgtccatttcaatcttttgattttaacgtgacgtgcaatggctaatttacttagctgttcttggtcgatatgaacctcaaagaatatactacttcttttatccctcaaaaagcacccctttttttatagaaagagagttgtcctttttctaaacactaaacttaattcctacgctcatagtcttgtctatttatcacttattcaactaagggcattcccgacccaatgactaggatggtgtccatagcattaaataagctgccacctaggataaaaaatgatgtggcaaatgaattaatgaggaaagagaaggaaaccatgtcttgcatgagacatgatttctacataacatccaagatattatgtgagataagtagcattaaatttaagtatggaatagtagtgtttgcattggaagagtagtgtctagtactagtttcttgatgatgtagagtttatggaaactatatctagtgtcttgggttgagaatgccctaagtctccttgggcacatatattcttggattataatcactctaacagtttaattggttggaacaatagcagtacaaatagaaaaatatatatactagtacaaccaattaaattattttaactattttattttattaatattatgcaatcatttatctcgatggcctttcagagacgaactcaccagttttctaacctgtttgtagaggagctgcagcaccagtggttggttggcctccaattcgatccttcaggagaaaccttgctagtagtagttcatccaaacattcccctgaaccacaaaatgataatgccaatgcaaaggtgacgctcacctgcaagaaaaaccctcttgtaaaaatcaacatggatgggatccctattggaaggaaaatagaccttgcagcctataacagctatgatgggctatcgtcagctgtcaaacaactcttccatgggtttcttcaaggtagaaattaacaatctatccaaataaaataagtacttcattttttataaaattcttagcttttatctgatcatattgcagctcaaaaggaccaaactaatgcgcaaattgcacagcaaggtgcagatgacaaaatattttatcaattgttggatgggtctggtgaatatactctagtttatgaagacagtgaaggagacaggatgctggttggggacgtgccatggaagtaagtttgctggtcccccttgtcatttacagtttttactggcatttacaaaataatcaaatcttaaaaacaacaaaaggacactgccaccataatttatattaggcaccaccaaaccatctaaattatttttcctgttctccaattcctgcagagtatttgtctcaactgctaaaaggctgagggttctaaggagttcagagctttcccataccctggtaagacaagctagaccacttaaagtcgtgtccaaatctttggtgtagccataaaaaaattagctttcgctaaatttgaatgaagatagctacacttttatgttagtctcatattctttactatttttttcctattctccagattggagctactgctagggtctagccgtctaggagagtcaccaattgctgaaatgctgggatcttattaaccattcggaatgaatgtgtgcactcaagccagtccattctccattttaggactacccctattttgcctatatagatgatctactgagatgagttggcatacagcaaatgcaaggaaatggcaatctgttttgtaaattaggttaccttgctatgacatgttgcttaattcaattcgaagcgattttggttttatcggggagagccgcatatgtagacttgcaggtcacccatgtaaagtgccttgttctgcgtgataaatttgtattaatcgctgctgcaacccgacatgcagatctaatgtcaccagcgtgtctcagaggacagcaactaggctaacctgatagcatcaagtcatcactccacgtggaatatgctactagtaggaatttttttttttgaaaaaaaaacagaattatccactgggtgagttgttatccttctaatcccatcactttccaaaatttgtcacaagcacagcgagaaaggtttgacccgactatgaaactgccgaaagcaaatatgtgctaatgccttcgcgcttattgggtgtcaaatagctatcatgtgatacaacagtggcatgattgtgaccacacacaagaggggtagatgttcatacttcgttttgctgtgaaagctaagaaataaactggttgtactatttttagtttttaacatgaatgcattatgtaggtccattaatgattaaaaccatctgatagcactagctgccaaacctggatgttatctccaagctgccctggtgaccatattcacattggcttttttgaataagccaatatcaacagctggtggcactgtttttattttctccccaagataaatacagtgcattagtttcaacttgacggttaacactgcaagcatgcctaatgcgtataactcttgcaaatatgtaacacaataggaatattagatgtataactcttgcaaatatgtaacccaataggaatataagatgttagaatagacactggtaatatttttggagggtaattgttatgaggcgtacctgaaataggactgcagaagaatcttataagttacatataatcttgtagcgccttcagtgcccaaagttttgacaggaaaatcaccacacagccatttccagcagttcatgccatctgtacagataaaaaccttatgtatttcaagatcaatgaagcaaacgggcacgaataaaaccagagagagagagacagagagagagagagagagagagagagagcttttctggtaaaggagaatattcaccttgatgcttccgagccttgaaactggggacaaaggaaaggtctttgtcattggaccatccctaaattccggacagcaggaaaagtagaagagacggggtggattacgaaagaatcttaggctcttttgtaatgtccttaccaaacatctttatccccacagtattgtgtgctcatgtgctggcacttgcagtgtgcgactgtataatttacctgtgtggcctaaaaactatactccttttgcaagaacagttctttggtgacagtgaaagccaaaaagaaatgcagacaatccaatgacagaactaaccttatttccagcacccaatcatgtggatttgctggcacaacaagttgaatactagatagattaagacgctaacaccattcaaagatgttctatggaaatacaatagagaaatgtaaaggagtgcatttatttgacacaaagcaatttggcatgatgtgatcaaaatctaatgaacaatgccatgtatctcgtacagtgtgctctaattcatgatgctacagttacactggaaaatgttaacctgacatcgacagtcgccttcagatttcagccccaaaagggagtatgcataaaaaaggataatatttttgctcacctatgaggctatagctagatgacctactatggataaaagtggtactcatcccatgttccacttcttagatgtttggttattaacctcgtaaacatagaccttgcattagtttttagagaacacccaggagagtggcacatgtttgttattaagcagatagctctgcaagacttttaggcttattaactcatgttatcatgtaggatgtgtaagtgcgttcatgggttggtccaacccaacccatttgctgatttgcatccctatgcccaaacataccaacacatctcttatgtccacatgaacagaatcaaatatcaataagagattagcagaagatcacacaagaattatgtacaatattatgatatcaagaggaagaaaataaccgcaccagcaaaacgcatacgtgtaggcttgatggataaaataaattcaccttagggttttatttctggaactgcatataccaactaataaaaaacaaataaatcactatatgccacatttaggaagagacgtgagccaattgcttacgttgcattagagaacaggcacaaagaatacctttacagcacaatcagcaatataatttcacaaagcaatgtaattaaatataaaatgttagctaaaatggcaaattggaaattgtgtaattcagaactccatgtggggcaccatcctgcatatgtgcaaccttataatcaaccatcacctagcctacaaaataagatcgggacgcagcaatagtgcttatatagtttttaaacattatttttctttcagcaaagatattgcatcttacctgtgttcaccgaacataaggcagaaatttgttcccactttatccaggtatgccaactataatttggggtattccccaaaactatttgtaatggattgttccatttcaggtaataagttgggtttctgtgtcttgtattggcatcatgttcctatttccaactctctagccaagtacttgttgaaaaacagtataaggatggtgtacttatgatctatcaggtcaaaccagtgttttacagttgacagctcagcaatgctctttgttttgagaagaaaagtagaaaacatgatggctactgtgcatcagtaaaccttcccgtgtcataagaatatacaaggccagtttccttcattttcaaaatacctgtcagcaactcagccttgactagtatcattattcaaattttaaccaccaagaacttctaaattgttaggtcatattcaacaaaagatatgtgattacatttgccatgcaacatacttcaataatacaataatatgatagctttgaagtattttcaagttcgataaaaaagtggtcaaagtttgaataagaatagtgtttagtgacaagtattgtgagtttgtgacatgggagtagtaatattattacaagagaacatcttgggctacaatagcaagagcaataatatgactatattttgcgacaaaacatgtctaggtatgaatgcatttgaaagagatgtgaaactatagtcttgtagcttgcttactgtgaggctggtactgttgaactattatgttgttctgctttcacttcctaacttttactaagatgatgctgaaagttcaaacatcacaaggggacaatcataaaaatcagatttccagaagatggaaaagaacgccagccaggagacggtaaatagcaggaccagattctgtccagatggttctatttgacttccaattcacatattttttcctctaaatcctaattttcagcaacttgtaaatcaccaacgtcctccatccttccaccaaaaaaaaaaagaacacaatattaatactactgtgaaacagtaactcgtggccctgcatgctgagcaaggatcagttaactctggtttttttaatctccaagcaccaccagttaaaatagactggcattatatttccagaaaataatcacaaaatggatggcaatccccccccccacccccgcgcctttgtcaaacacgcacgcacaccaaacacaaaaaaaaagggaaagaaaatgcccatgatatacagattaaaatacagtaatatactcgtattggtgatgttattgttgctgtaataaaagatgcagtgtccaagatgcctctagaaagatcaaaagtaatacgatctgtaattgtgcatacatgtatggatttcaaatgcaaaaacggtataataatactctataacaacaatgcagtcgttatcattgatcaaaaaggaaatccaaagagaatagttagttagttattaagatcattagttatatatatgtgagcaaagatgtactaaacacaagcagagaaggcagaacatcaataaattcctatgcatgctttatatgttgaagaactttgagaaaactatctgtctgtgttatattatgagggaataattagcaagcaaggataactttgtggatttttcatgaatgccactcagaccctcagaatagttcgaacttcgaacgcgcctcaccttacagccttcaatcatcagttccacacttgaccctcctaactatcagttgctttaaattctctaggtctacactagctgtgttacttttctcagtttattgctttgcgttggattacaacagcaatatatgacatctattgtaactgactggctgcattattttcactaataaattaacacaacatgcagtatttgagtttgtaaacaatgccatccatatacttcagtcggtccatgacaaacagaaaacaaaattattataggccatcttaatcttaaattatttaagtcatcaaaacaaatgtgtgctgaatgaagctgaggtgaaaacggaagcttaagcacaaattatatagtatgtgtaccaagaaccaagcaaatagaaggacatatttttttaatgagaacaactccatcttaaatattttaatgtgtaccaaggaaagccatgcatatggaagctaagttcgagaatatatgaatgaaacgccatacattgaaacgtattacaagactagtgatatcattcttcatatgaccaatgaatctagtttttttcgatgttagtagtcaaagtaaaagaactttgacagtacagcttctaaaaaatcataaattagtaggtacacccatgcttgcaaaattgccttagcaaaccaagagatgtattagctgttagtgcgatttatctagatataatgcagtaatttggtgactaaactaataagaatatatggaatatagactgtaaaaagaagggaacagagcgatatttataggaatgaatttgaggatgacaacttgtcaggaacagagcgatgttattttccaagttgggtcatctttctagtgttacggtattacagagatatttataactgaaaaaacgacactaaacatgcaatattgcaaggtagatgcaggtaatgctcaatttccttggcatgctcacaagagtcgtccaggtaaggaatagatttcctctgccttaatcttttttgaccttttggacttctgaaaaatatttctaactagcaattctttatgtgcttattccagaacataattatggcactatgacaaagaatcatttatgtagaagcatgcgactgaaactgaactcagtacatagagggagtaagtgttaaaagagaactaatataaataattatgatatggatggatgaattatgtgacatccttacataagagggatgctaggcttatcacttacaggggatgcatttgttccagccagatgataaagcaaaacccctgctgcgacacttacattcaagctctccactgcaaggaatgatttcatatcttggttacctgaataattatcaccttcttcccctccatctgtgtctgtatctgctcctacaaaagatccatcaacattacccggaattctgaccaaatgtgtgcaggatcgctcaaccaggggcctcaaaccagtgccttcactacccaacacaaggattgttggttctcctggcacaacttcagatagaggtatagctttaggagcaacagtaccaccaagaactcgccacccattttcagccgatgaagataaaaactgcatcatgttcctacaggagagcagttcgatcaactcaagtgagcctgcactagctttgctcactacaccacttaatggagcagagttcttagcacataacacaacaccttccgcgccaaagaagtaggcagatctaattatggctcctaggttctgaggatccatgacctcatccaaagctatccagacaggtgcctttccatcgtccaccctgactggctccaactctttagtattcaccatttccaagggtgatgcatcgagtacaaggccctggtgtggacggttatccacaaccatgttaaggtcatgctttgatgcttcgatgactttcagcccaatcctctctgccagttgcaacactttctcaatccctttcttgtccttcttcttcttgttgctcacactaaaatccatcccttcctgaatatacagcgcatagaagtccctcctctcagccatgagagctgcaagcacagggccaaccccataaaccccctgtccaaccatttttggcactgtcgattcccctgcctccttccatgtcttcctcccccagttctcctgcctgctccactgcctaacctccggcttgtcaaatctctcccctctaaatctctcaccacgggaccctctatccctcggcaccatccgccgatacttgtccttgatcctgccccacttcggattgtcaatcgagccattatcctcttcctctctaattatctccctgcccgaaccacgatccgtcaatacctcacctcgcgggctttggtcgcctctggagaaaaacttctccgcggaggtctcccacgaggaggagcggccggcgctagccctcgccgcgggggcggcgccgccatcgcggctcgcggcggcgagccaagggagcgcgctcccgccgtcgggcgatgcggtaccatcaggtgcggtggagaacgaaaccctacctcccagccccagctgcgaggggccgcccgggctaaccgcggctctggcgctcgcacggttggtgacggtggttaccggatgaagcgcgggcgaggaggccgtgggcctggagaagcacgctgcgcggagaaggccggcgaggaggatgcgtcgcggcgaggacgccgccgcgaggagcgggaggggctgggatttggtgaggccggagtggagcatagcgcggggcggggggagtagggttttggatgaggctggagccgagggggttttgggcggcgcgcgccacccgttcgacaaaatgccgcaacgagccgacgacgacgatgcgtggaaagtcacggttttgcagttcgcttcatctctggcgaccaattcatccaacggcacacgtgcatctttcttcctttactcgcacaccgtgcggcccagttcacctacagcaggccatcggctagcccatcagaattcagaaagaggagagaagggacttctgtattttgtggacccctttaaaactacagtactgtaagggcaattactataatgcttcatatgctacctctagaaataacacatagaattaggtgatgaggtggaggagagaagtgaggtgagagatgataaaaccacccctaaatgaagaggtggcttccacacaaactccaagaaggatgtgagagtactaaagacattgatatttgtctattagggacagtggcggacccagaaaaatcatattgggtgtgcccacgctaggatgtataataccattctttaactaaaacatgtcaggttataggtagcaaaagttttatgaaatttgatcaaaatttagttcaattaattcatgaaaagttggtaaaatgtacacaatttatgaaagaacccatttcacccatgcttggtccgttgtcgcaacccatgcttgattttgcattttagttttgatgaatttgaatcaagtaacactggtccaagaatcagatattcagagaaagtaaattatagaagggtaaaagactactagttcggtgatggctttagggcctcaaggctccaggccattggcgtcggcgtaacatggactgcgttgtgcgatggtctcagcctcaccgtggccgaccaccacaacatactgtatggccattgcttccgctacttttcttgcaccaccaactgaccaacagaaatgcccacaacaactagagaacgagatcaggtaagccttttggtcttccgtttgtttaggaacaagggcatctaccaaatatttaggccacgaatgaatactacatcctatattttctctgaaatatttgggtatgtccgtgcatacccggcaccatacctaggtccgcccctgattagggatgacctattgtatatcttgcatcttaatttataggtaaatgatataaataaatttgaaggtagcaatcacatctactataacacttgctttaaagcactgtaaaacttgtgtctagtgctggtcagctggcatgtgaggctcggtattatagtgagacgtactgtaaatatccttatggctttgctgttgctccccgctgtcgtctgctactccatacaggaatgcaaaggacaaggctgcaacagaacaataaaaactgaaccgctgaaatataaaattgatttaacattgtgaaggcgaaggatgaaataggccgagtttagttttaaacttttttttcaaacttccaatttttccatcacatcaaaactttcctacacacacaaacttctaacttttccgtcacatcgttccaattataactaaacttccaattttgatgtgaactaaacacatagtagagaaggaagcggaggaggttctggtcccaaagagtgggggcggtggtggcgatgagatagtggtagtgttgtcatcggcaacaatagtggctgcagcggtggtggcacgtgagtcatcataatacgagaggagtttattggcatccctgtcgctgggcaccattatctcttgtttgtctggcaccttgttttcaaggtttagatctagttccaccatcgaaacaggtgtgcactatatagatattttctagcatcggctgataacgcatcatatcaatgatctggtacagatgggtatcagtcgatactagtgagatatctgatactgtctttaggtattactccgtacctgatatcgcgtagggtaccagatggtgtgatacctatctgctatcaaagcatagcaacccctaacaaatgggcctgttcggcaggccgactgtgagggatgcggctgcacacagtgagtacggtgctgttcgtgcgcagctgcagcctggcaaccgaacagatccaataataactcattatgcataatttattatactattttcatcttaaaatatagaatagtttgttaatgtaacctatataatttttaggagtattctgtaaggaaaaaggtgtgtggtaaacttgtgctggaaagagccgtaaagattccgcaacgtagcaccggcatgattcatgagtgccaggtgccaggtgtcaaataagccatgaacccaaagccagtcaaaagtgacgaaaacggtgagggtggttcttggccgctggctgcctgcctccctgcaaaagccggctcgcgaacttcgcctggcccaacaagcgctcctgcatgccgcttttcgttgcgcgcctcctctactcccgtagtcccgttgcccagcaagcgaagacagtttttccgcggtgtctctcccttcccgacctccgtttcttggagatctcaggtgactttccggttcaaaagctttcaaggtgttcattcttcctcgcgcgaggggcgcacgactgcacgaggcatgacgcagctacgatgcttctgccgcacagctcatacggcgcgctacttgtgtttccaccgtgtgtgcaggcgatcgctcacggttgttcgatggccggggtttgggtttggtttggtttggtggtgcttctcgttgttgcgtatacttgcatgaaaagttgaaactgcagcgcgtcgtgtatgcatagcgattgatcgatcaggccatcatatggtcctcactcctcacacgtactagctaggagttgaacacaacaatatgcaacgacgatggttaattatacacggatttactctagatgtacgtgcgtaggtgtgcatactcgagatgcgccgaactgattctattgatcgcttacgcgttagcttaggaggtaataaaggaaaaaaaaaagagagaaagaggttaaggaccgagatgaattgatctgcatgagtcccattttttttcggcacatataatgtccaaataactcttcaggactgtttggataataggttaagaggaatcgaattaagataggaatataagtggacgattgagatgaaacgagggatataaagaatcgatggttaggattaagagtttaaggtggtgtttgaatctcttgaagatgaaaatgaagattaagtgttttatgcaaaacaatgtgataataacgtgtgattagttgagttttattttttacaaacttgaaaaatggattaatctgatattttagaacaacttttatatagaaagttttcgcacgaaacacaccgtttagcagtttgaaaagcgtgccacgaaaattcaaaagtttatccactctttgtcgtggattcgaacaggatggtgggaaaatattttcccatcccaggctcaataataaccattcttaaatagggaaaattggaaccatgccattataattttgcaaaaattgagatatgccatccaaacccacatgtcattgacacatgtgggtcctatattcattgagataccgatggcatatctcaaactttgcaaaattataatggcatggttccaatttacccttgtaaataagttactccaattatctaaatctattctaatactttctccgtcctaaaataaatttatttttcacctatctcacacataccaatagaaaacctgaaagactagaatacccttactttatcaaatctcaatgcattcctctactttattgctcctgtcggagtgtgaaattcctctgacagataaacaacgcgacgctcgcacgataaaaatgagggaggcaagttttttagactgtgttacagccctgcctagcgacgcgtggtgcaggactcaccacgctcccccccattctcaacaagacgggatggtatgcatgcgccacatcactattaattagggggggggggtgttgagcaaccccctcgcctatcaaaacatcatcgatgcgactgcgcttttcatggggtgcctaaggcaggtggcgcgctcgggccactgcttgggcatgaagagtgttcttacgtggtttgtgtaatctttgattctatcttagctgtatatgagcttgcaagagctacaacggatgtgccccaagcataacccaggaggggggcacgctatgggcggatgtgccccaagcacaatccgcggggtgccgcgcccgaggaaaggagtgccccgagcacagcccacggggggttcgtatccggaggtaagatgcgcccgagtagttggtgatggtaactctagttttcatttctctaacaacccccaatacaattattccctacttatgcaacaattactctaaaaataaacttattttggaacaaatgtaatgagctaaaaataaacttattatgagacgaaggaagtaagcaatattgaaattttgtttcaactggttggactcccatttgtttagtgtcgccagtttacgtgtgtcagggttatggataccacatacctaatagtagttgacttaatctcagcaggacccaccatataccatgtcttatacgagaactaactttagatatggagggagttccggataaggaaagacaatcagagttctacatggaaacgacaaggactactcggattgtatccatattggtttccctagttctaccttgacaaagggacacctatgggtataaatacaaggccctctaagaggagagtagacacgagataatcgacacccaccacaatctacagaataatatatcaagacagaagatcaacatacaagccaacatacgccaagacaagacgccagatatcgacttcagagataggcacggctagtcccctacggtgtctccggatactgtcaggagagacgaaagcgctatctttgatctcgccggacacgaactcgaggaggaagactaccctgttgtcgactacgagtcagaccttcagaccaccatgtcgacaacagttatatatgctaccctaaatattgtactggtgtgattatggtgaataagagcaataccggcttcggccaacaggatgtagggttattacctgacaactcaggggcccgaacctgtataaaaatccctgtctccatctcttttacctcagtctcacatatatcctagtaccaacgatccccatactatgcaaataccggaatcgcgacatcaaacgtcgacaacgtgttttagagattttctcatgtgttatgcgaattctcttttagactactatgaaacacaatattttaaaaatacagggataaggaaaatatagaaatatgtcatcacgacttattgaatcccagagaaaacaaaaccacatgaatcgctcaaaatagatatttggatgattcacaggaacaatatactccatccgtcccaaaatataagtatttttagactttgatacggtcttcgagatgctattttgaccaacgatattgtgatagtttgtttaatgataaatctagtaatattaattttacatgattgatcttatttttttgctattaatagttaaaattacaaatatttgatttggcagtatgctaaaaatgcttatattttatgatagagtagaaaacttaagattatattgcgatttgttagagagaggtgagagagaaagatataagttgtattgaaattcttaaaggaatttgaaaacataaggttagatctcacgctaaaaatactttaaaatatggaggaatcttttcctatcctatgaaaatcttttgaatcaatcctaataaccaaataataacctccataggaattgttaatgtgagattgggggtcaagacagcctttcacacgttcattgcattgggcatcgattggttcgtcgcccagccggaaactctgatgaagtctgaactctaggttagaattcccggtcacgggagaactgaaaagtctgaaaagcgatcccgcgccgaggtgctgatcccacggccacgggccgttgcgccgttgagcaccgacggctgccgtcctggtttcccatggcagagcagccgcctctgtcggtcagttgttcagtaggcgacgatggccagcctcttctgtcggtcagttgtccaggaggcgacggatggcgtccgtgcgtggccggccagccccaagcgagcgagattcaggctggcacccggtctacaatctacatccatgcctcccgaggccgcgggaggtatacaccatccgttacctccaatggatcccccgccttcccctgtatgctctcgtattgcgtattcccgtggccgtgcgcccgtgcctcactgcctctgctgtatgcccgtacttattccgtttgtatgatggttgaacgggtcggtactcggtagtaatgcttgctaggtgttcgttgttttgcctgacaagaagagtcgtggccttggcccgagaagcattagttacatttcgttttacagttctcagttactgaatttgttttgctgccgtacctctctgaattcccaagtacaactagtgagaaattgaccatggtttgcttggtggtaggtgccatgtctactattgtattcatattagtctttttttttctattcttaattgatgtgtagttccttataggtgccacaccaaatatgtgtagcgttgatcaaacattttagtctgacacatgacagatcagtgctttatctaattatctgttgtcttaatgatatcgaaaattccaaattgttgctctgattactattctgtgtagtacttctactcctgtcagttttccacaaacagatagttcattaggttggataagtggttaaatttagttgcaaactctgggagagatgcaactgttatcttaacaaacattggatcaggggaagcacatggagtgtagaagataagtcaaacttatgtcagattcccaaggaacatgatatcatgatacacatgcttccagtatagttatacattagcacctggctgcttcgccatttgttgtggtgatgctcatttattatagttttttgagcaagatgcacagttctattaagtcatgtaatgcattttttcattatgcacttgacagctgctgaattttaaattgactttcagtagaagtactattgatcttagactcaatatttttcttaacgcgtgcttgccattctgaaacacaatttctagtttacctgcggctgttattaactcactgcaagttattttctgaacacgaacttgtaagcaattgttctagtacaaattcatatggccatgcattatgtcagcattaatattagtgaaagtgggcaaatggatgtcgaaagaattaaaattaacactttataccatgaatgaacttccttctccatagctttattattctgattttacattaactgtgaagtttcacctgtgccaaatgtaaaagcaagataggttacttttcaaatgtttataaatgctcttccaaatttatttagcatgctgctttatctttcattttcactgtgaggtttgctaatcgaattctttttactgggatattcctggattctgactagattgatcatttcaaaacaggaaataagtttggtgtaaattgaaaatcactcacaatggttaagtttacggttgaagagatgcgcaggattatggacaagaagcataacatccgtaacatgtctgttgtcgctcatgtggaccatggtatgtttgagtagagtgctctaagactgttatacaactattatctttttcctgatatgccacctgttatgttgtcattattatttatactcatgcaaaaaaaaaaaaactactattcctttttgtagtagtgactgtcagtgctcctgccttttttttttcagaaaaagggcccatgctaagaacttttgctctttatcatctgtagttaatgtgttattgtcatatttatttttgcttgatatgaaatgtctgtaagcaaattaactgtatctgccttttcatttgcatgatctcaaaattaaaagctagcattttatagtatcaccttcatgtgtgcatccttcatcctgctcactgtttgtgctttttcgttaattaataaagtaacttacttgtttggtctgttatcacttctttgtttaacagagggttcctgatttcctgaatatattatgctcttgttttcctatttgtttgctgattcaacatcttgagttatatttgatgcaacaatgatgtttgatctgttatgatttctttgcaggaaaatctacccttactgattcccttgtggcagctgctggaattatagcccaggatgttgctggtgatgttcgaatgactgatagtcgttcagatgaagcagaacgtggtattacaataaaatctactggtatctctctttactatgagatgagtgatgagtcactcaaaagttacaagggtgacagagatggaaatgaatacctaatcaacctcattgactcacctggacatgtcgatttttcttcggaagtcacagccgcacttcgtataactgatggcgctttggttgtggttgactgtattgagggtgtctgcgttcaaactgaaactgtgcttcgccaagcccttggtgagaggattaggcctgtcctcactgtgaacaagatggatagatgttttcttgaacttcaagttggtggtgaggaagcttatcaaactttctcccgtgtcatagagaatgcaaatgttattatggcaacatacgaagatgcactccttggtgatgttcaagtctatccagaaaaagggactgttgctttctctgctggcttgcatggatgggctttcaccttgtctaactttgcaaagatgtatgcatccaagtttggagttgatgaatctaaaatgatggagaggctttggggtgagaactactttgaccctaccacaaagaagtggaccatcaaacacaccggttctgatacttgcaagagaggttttattcagttctgctatgagcccatcaggcaaattatcaacacctgcatgaatgatcagaaagataagttgttgcctatgctgcaaaagcttggtgttaccatgaaggacctaactggcaaggctctcatgaagcgtgttatgcaaacttggcttcctgcaagtaatgcacttcttgagatgatgatctatcaccttccctctccagcaaaggctcagaggtaccgtgtggaaaacttgtatgagggcccccttgatgatatatatgcatctgccattagaaactgtgatccagaaggtcctcttatgctgtatgtttcaaagatgattccagcatctgacaaggggaggttctacgcttttggtcgtgttttctcagggagagttgcaactggcatgaaggtccgtatcatgggccccaattatgcccctggccagaagaaagatctgtacgtaaagaatgtccagcgaactgtcatctggatgggcaagaagcaggagtcagtggaaggtgttccttgtggcaacactgttgctatggtgggtttggaccagttcatcacaaagaatgctaccctgacaaacgagaaagaagttgatgcctgtccaatcaaagccatgaaattttcagtgtcccctgttgtgcgtgttgctgttcagtgcaaggttgcctctgaccttcccaagcttgttgaaggtttgaagcgtctggccaagtcagatcctatggttctctgtactgttgaggaatctggcgagcatattattgctggagctggcgagcttcaccttgaaatttgtttgaaggatctgcaggaagacttcatgggtggtgctgaaattactgtctcccctcctgttgtctcattccgtgagactgttcttgagaaatcttgccggactgtcatgagcaaatccccgaacaagcacaaccgtctgtacatggaagcccgcccaatggaagagggtctgcctgaagccattgacgagggtcgtattggcccgcgtgacgatcctaaagtacgctccaaaattctatccgaggagtttggttgggacaaggacctcgcaaagaagatatggtgttttgggccagagaccacaggccctaacattgttgtggatatgtgcaagggagtgcagtatcttaacgaaataaaggattccgttgtggctggctttcagtgggcatcaaaagaaggtgcactggctgaagagaacatgcgtggccgtggcatttgctttgaggtttgtgatgttatcctccattctgatgctattcatagaggtggtggccagatcattccaacagccaggagggtcatttatgctgctcagctcactgccaagccaagactgcttgagcctgtttacttggtggagattcaggcccctgagaatgctcttggtggaatttacagtgttctgaaccagaagagaggacatgtgttcgaggagatgcagaggcctggtaccccactctacaacatcaaagcttacctccctgttatcgagtcatttgggttcacaagcacccttagggcagcaacctctggtcaggccttccccctctttgtatttgatcactgggaaatgctgtcagttgatcctttggagcctggcaccagacagctaaccttgtcctggatatccgcaagaggaagggtctgaaggagcaaatcacccctctgtctgaatacgaggacaaactctagatatttaatcatgttattatgcttatagtgttatatcgctttataattggtagtggccatctatgtgagcagtgagctgctatttcatgtataatattatgtcgaacggttgtacggtagcatgggatgatgatcaggcgatattgttataatttgttatggtatttaccatcatatcataatctgttctctctcgtatgactggtgcttttcatgccattagctctttgacccattttaatgctttgtactgtaacttaatccgatcattgattctgggagagtaatgtatttgattttatgctgagagtattataaatttataatgatgtattgctggccggaggggtagaaatcgcaagtcttttgtgtttcacttgtgcagtggagtaaggtaagaaagcaggtcaccgcaaacttttctcagactaatcacagttccatcaacattttttaagcttgctgaaatatgctccaccgtcagtgtgtggaccgatcattccaacaagccgactgagagcaaagataataatatagcaagctgcagagcatagatctttataatctatctctcagattactcatatagtggttaactcttcactataaatatatggtttatctatctgtctcatagatctttttggttcctgtgactaagccggctgtaaacttacaacccgcttctcatctatcccctctactatcttatccatttacagcccgcttctcatctatctcctctactatcttattcacctcagtattcagtcttcttataaccctctattgtacttgctctgacaagaacaaactataggagtatgcactagtaagggtgtgtttaatttaggtcaaaattaaaagtttggttgaaattggaacgatgtgacagaaaagttggaagtttgtgtgtgtaggaaagttttgatgtgataaaaaagttggaagtttgaagaaaaattttggaactaaactcggcctaatcccaaacggtgaaacaccacgtatgcttcttttattgatctgaatcttttaaccactgtactgtaaacagacagagcgaagcaatcatccaaccattccattacacgatcgaacacatctaaccgagctgagcctgagcagagctcactccggtttcttgtcaaggcaggtgttgttgagccgctcgatggcgaggatgagcgcctgcgtgccgaggccgccctcgccgtgcgcgagcagcgacacgtagagctggtgcgcgagcgcgagccccggcagcgccagccccatggcctggcactccgacaggcagatcccgaggtccttgacgaagtggcgcacgtagaacccggccgccatgtcccgctccagcatccgcttcccgtacaggtccagcgacttggaccccgccgcgcccgtggagatggcctccagccacttcgccacgtccagcccggccttgtgcgcgtacaccatgccctccaccagcccgaccatggtggacgcgatcgcgatctggttgcccagcttcgcgcgctgcccggcgcccggcccgcccatgtacagcgcgttccccatcagcttgaacaggggcgccaggcgggcgaccacggccgcgtcgccgccggcgaagatggagagcgtcgcgctgcgggccccgcggtcgccgccggagaccggggcgtcgacggcggcgcagcttttggcggccgcggcctcggcgatctccgcggcgagggtggggtcggaagtggtcatgtcgacgagcaatccgcctggggcgaggccggcgagggcacccgtggaggggtcgagggaggtggagcggacgtcggaggggaagccgaccatgaggaagatgacatcggctgcggcggcggccgcgcgcgggctttccgcgagggtggctccccgggagacgagcccctcggccttggaggccgtgcggttgtagacagtgagcgcgtagccggcggcgaggaggtggccggccatggattggcccatgacgcccgtcccgacccaggcgacgcgggtggtgtccggggaaatcggacggtcggagacgttcacgccggtggcggacgacgacatggctgctgctgcggcggcggcggcggcggaaagcggaaggggtgggcgacggcgagtgaaggatcgggagatgcttgcgagcatttgggggcgaagtgtgagccgaataatttgtctctgtgtgcagatgaattgtcccaaatgccctctggtgtcgccggagttgataaggtgagcctcgtttgcggtgctcctgaatgcatctcgttcgtcggaaaatttctttcccaaagatccatttgtcaaatttttcgtttaaggctgtgtttggttcctttcaaagttagaagtttagattgaaattagtatgatgtgactgaaaagttgtgtatgacaggttgatgtgatggaaaaagttacaaatttggatctaaacacagcctaaaatctactactctagtatggtctatagtttcatttgtgtactggcactctatatcgaattgagtagagcatcaaaaataaaagccagaatctcctaagagcgattctagcggttctatctaggccacccctcaatttcggcctaggagaatcccatgccacaccgaatccacaacacctgcatgaccattatcacataacatagattagaagcggtcaaacgaaggccgaaggtatagaacgtcatcgctccccgatactcgttcagtcgtcctatcaatgtctcacgtgtcggcaggggctgcgaggcatcttagcttgctcagaacagctcggaaacatagaaaaaacacgtagaaagtacacaggtttgggcctcctaccagataatagcactactcctttgcttttactatttcgatggagagttaagctcttgaacaatataaatattcgagggaatctaagtctctctctatagcaacttaccgctaggcttttatacccacgggtcacgtcctcatccttaggccggtgaaaacgccacgatatcccttctcgagaagtcaaggagttaccatggcaagccaggtggttgtgggtttgttttctttctcggagagagacacacatccaaccctgaggaggggtgactcacttgatccagccaggtacgttcttaacgaagaacaagtggagtttctgggcggctcgccaatgagtttcacacacctatggacatgccacgtttccgtgcccgagcaaccctaggctcccgtctaggtttcgattgttttaatcttaccatgcttatgtgatttgaatggcaaagaggcacatggaccttcttgaaaggacctttatgtcgcctagaggggggtgggtgaataggcgattttgaaatttacttcaaattgcagtggttaaaattagggcccagaacttcctggcaaaaggcccggaacttcctggtagctttttatgccgagcaaagaaagctgcctggaacttccggagttcttcctaggaacttccggggagttgtgagttgctctttcgagcacctcacaacaagtaaattgattcacaaggaagcctaaaccatagaaaggtgcaacatgtatcaaacaagagtaatacacatgaaactacgcaagatagcacaatgatcatacaaggggagacatgatagcacaactagacaaataaggggataagcatcacaatcacatagataaagagagtgggaggagacaaacgatttgttttcccaaattcggattctccaccgagaatcctacgtctccgttgaggagctccaaagagacgggtcttgattaaccccttgcctcaccaagcaaaggcctaggaagaggtctttggtcttcaagccaacacccctaggtacttctctttggtttcaaatgaccactaagattcctaacttgaacaccaagagaacaccacaagtgaggcttgctctaccaagacgacctcctaaaccttagctcggaatccactcaccgggtattctgtttcctttcggaggtggaataacgccctcacaaacttcctgcgattcaccacaagcttgggagctcaccgggcaactcctagccgtctaggaggcttaacctccaagagtaataaacacaaacgatgatttgcttgctatgaactcatgtgctcaaatgatggagtggatctctcaagctctcaaccttgccacctctcaatctctcaaatatcttcccaaatctcactcacaaagatctaccactaaggtgggaggtttgggaggggctatttggtttttgataggtctattcttacccaaagtcagcagcaaacaaaggagagagtggaggggcttaaaaaacacaagcccccaaaaaacttgccattactcacataatagggcccggaacttcctgccccgagacccggaactttttgtcaccctcctcgcccaaacagagagattgggtcagaacttcctggctcagggccctgaactttcgagctaccatgacatcacttcacaaaaacagtcataactccttgctctggagtctgttttcggtaaaattgggctctatggaaagcttattaagagggccacccaacccaaccagaaaaaagctctaaaaccactcatagattaagttaaggctttggtttctctcaaggtagcacttgcataggtcactttgagcaccgagacataaacaaacatatcaatgttgcatccctcttaatagtacggcattcctatactcaaatgcaaatagaaaagctataccactaggaatgccttcttgccatcttcttgcttcaccttgaggggtgccaacgtcaacgccatttcaccatagggactattcttatctacaactagttaagcacactagtcccaaatcaattatacctttgtcttgatcaatgcccactttggcttttgacttgatgttcatcggagaaccgcatcctcttgatcttcggcattccatcttgcggtcttcttataattgatacggattactcatagcttcaaatggcctcgtacggtccatcatgacaaagccttcgctcgcccttcaccaccggattcggtccgtcggcgccaagcctcttgcttgcccttcgctcccgcatgatccattgtagctgagccttacttgcccttcaccattttgccatagatagccacttcatacccgcatcatcaatgtcttcacttgctcttcatcaaggtataatgtccatcttctagccgagccttacttgctcttcaccgttttgccatagatcgtcatttcataccccgcatcatcaacgtcttcacttgctcctcatcaaagtaaaatgtccatcttctagcttcaatcttttaactcgatgccggaacttaacctaatctcactaactcatcgaaatagttagttccaacaacgggttgtcattaatcaccaaaacaatcaccgcactcttagagtcatagatattccaatctccccttacaaggcaactctagggcataaatctttcaaaaccatatcattttttaagtaaaattggcaaacacatgatgcactggtaatgcctagagaattctgacaacaacaactattaacttattaaagtaataggaaaaaggagccaccattttcgttctcacggcctaaaaattttcacattgataggagaaaaagaaaaaatagagtccatataaaaatgtaatttaagaatagctaaaatttggaattaaagataaataattttggaagatgagttttgagtatatatagagatacaattaaaaataacggaacttcggaactaaagaaataggaaattggaaaaacagtctagatgcgtccatatatgaacttagatctaactggaagctggacttaaataataataaatttaaaagtagagtttagaattcgtatagaaatacaatttagaaataactaaaattcaaaattttaaaataagcaagattaggagaagagttcaatatagaaatacaatttataaataagtaaaatacggaattcaaaaaaataagaaatatttagaaaaaaaagactagagtctatatagaaatacaatttataaataactaaaattcggaattaaaaaaataaattttgaaagatgagtttagagtccatatataaatacaattagaaataacgaaaatttgaagttaaaaatatgaatcttagaagaataatctagagtctatataggaattcagacataattaaaaaataagaaaaaaagttaaagtagagtttagagtccatagagaaatataattttaaataaataaatttaaaaaattaataataaacaagattgagagaagagtctgtagtccatataggaatataatttacagataacttaaatttggaataaaaaaaggtatactggaaaaaaagtttatagtccatataggaatacaaagtacaaataacgaaaattcaaaattaaaaaaaactaggaatattggaataagagtttagagtccatataaagatacaatctacaataactaaaattcaaaaatatgaaaaacgaatattagaaaaggagtatagaatccatatatgaataaaatttataaataatggagaaattaaaaaagtaaggaaaattgaaatatgagtctagagtccatatagaaataattaaaattaaaaaaataatcataactatcacgtatatacaataccatataaatatcacatattggttagttttgtcaagttattacataatttaaaattatgtattttaataaataaaatgtggaaatatttaagatattatatgagaaaaataaaacgatgctagccgcgcaatatgcgcgggccaccatgctagtttagtttgtcttacctgccttttattatactatcatttttttaattttaatattgctaaatttcgaaaaggtactaatcgtcctaaatttggaaggatgcgtcacggtggtgagcggtgacgtagctagtctttctatataactcaggccgtgtttagatgctttggaaaaaaaataatgtatacgtacacacgtttgaagtactaaacatagactaataacaaaataaattacagattccgtctgtaagctgcgagatgaatctattaagtctaattaatccatcattagcaaatatttactatagcaccacattattaaatcatgatgtaattaggcttaaaagattcgtctcgcaatttatatacaaactgtataattggttttttttcatatttaatactatatgcatgtgttcaaatatttaataaaagttggaagtttgaagggataaaaacagcctcaggctgatgagaggacgcataaaggcaaaccggctagtgaggagcggacctctcggtctctcggaccgatcctgtgggcgcgaggccgcgagctatagttaacggtgtggattggagtctacgcgagtaacgcaactcgtcgagtcatcggtccgcggtggcgacccggctgaccagtcaacggtccactggtctccgggtggagctttcccgcttggtttccttcctgcagttgccccactagtgaatctttttctttcggttttctttacggaccagtctcgactctcgagatcgatcacacgcgcggtgcgcacgatcagctcatatggacgtccttttcgagcttaccaggccgcgcggaacgccgaaaccgttagtgctaatcaccgatgtggacactcccagtcgcttccgttcaactctctcaggaaggtggagtggatggccggacgttgtatgcacaaaatactctcaccccgtcccaaataaaagaacttttatacatgaacttgatatcttaggacatacagattagtgagtactcccttcgttctaaaaaaacttaatttttaggtttccgtgtctgatgtttgaccgtccgtcttatataaaatttttgcatgattagaattttcattattgttaaatgataaaacatgaataaaactttatacatggcttattttttaattttttttataattttttaaaataagacgaacgatcaaacgttagacacggaaattcaggaattaagttttttttttttggacgaatggagtagagaatagtgagtgccatttttattggtagagcagtattcgatcaccagtattgtttgcatgataaaatctgtatactctactataagctcctgtgtcggggcaaagctcggttacatatggcatctgtagtttataaacggatttgtggaacggtaaattaacgttctggatcttgactcttgaccagttcatccacacgtgtgtagtccgtttgttggttggttgctttcctgttccagctggaagtttttgacctacagtaacatcatttttcgctttctattttgattccccgttgccaagtcgacagccgacttgaacctgagcctttcggcgaaacttgaaacctccaatccccaatagcccacgtacggttgcagacagccttgtagagtcgccgtgtttcaccggagcgaactgtatactcctacagtttaagatagttcggtggaaaaacgagtcgttagttaacgacctgagtaagctccgacttaaaaaatggtgaaaaaatgctgttaatcatgcgtcgggaagacctaactcacatacccatatttacaaacgaaaaataatttatgaataaaacttttatatatatgttcttaacgatctaaaagtaaaggttgaaaaataaatatggataaaaaacaccaaaattaacttcaaatttaagaccgaaaatttaaattttgactgataagtataagtataagcgaaaagattaggctgccagttgggcctttcctgaattctggactctcgatgtcttctcgaataaccatgccgtctgaatcactcttaagtcttactaatccacagaaaacaatcatgtgctccggtaagcaacatgaagcttcgaagcaagcacgcaggagcttataacggtctcgttcccgccgcatttgcttaacattctcaaaccgaactccccccacttcttcccgcgtccacagcggcttgcggcgggggcagaacacaccatggaaaccatggcaaaagcaccgggccctgtgtacctcctcttcctgctgctcgcgctgccttgctgcctcatcccgcaccgcggcgcggcccagcccgcggcgaacgaggcgcggctgctcctccagatcaagcgcgcgtggggcgacccggccgtgctcgcgggatggaacgacacggccgcgcccgcggctcactgctcctggccctacgtcacatgcgacaccgccgggcgcgtcacgaacctctccctcgccaacaccaacgtgtccggccccgtgtcggacgccgtcggcggcctctccagcctcgtgcacctcgacctctacaacaacaacatcaacggtacgttcccgacgagcgtgtaccgctgcgtttctctccggtacctcaacctgtctcagaactacctcggcggggagctccccgccgacatcggcgtcggcctcggggagaacctgacaactctagtcctcagcggcaactacttcactggcaccatccccaagtcgttgtcccgattgcagaagctggagtggctgatgctggacaacaacaacctcaccggcacaatcccgggagagctcggcgacctgacgagccttacgacgctgacgatctcgacgaacaagctcggaccgggtcagctgccggagtcgttcaagaacctgactaagctgacaaccctctgggcgagaaagtgtcagctcgtcggcgacatgccagcctatgtggccgacatgccggacttggtgacgctcgacctggcggtcaacaacttgacaggaagcattcctccggggatctggagcctgaagaagctgcagtgcctgtttctatttgcgaacaagctcaccggcgacatcgtcgtcgccgatggtgctttcgccgcagtgaatttggttttcatcgacctgtccgcgaatcccaagctgggtggaccgattcctcaagactttggtctcttgcagaagcttgaagtcatccacctgtactttaacaacttctccggtgagataccggcgagcatcggtcggttgccggcattgaaggaaatacacctattcaataatagtctcaccggcgttctaccaccggagcttgggcagaagtcaccggatttgtgggatcttgaggttgatttcaacaagttcaccggcccgattcctgaggggctgtgtgacggcggcaagctcaacatattcaccgcagcgaacaacctcttgaacggctccatcccggagaggctcgccggctgcaccacgctccagaccctgtttctccccaacaacaagctgtccggcgatgtgccagaggcgctatggacggcgacaaagctccaattcgtgcagctgcagaataatggcctcaccgggactctgccttccaccatgtacagcaacctttcgagcttaaccgtggagaacaaccaatttcgtggtagcatccccgcggcggcggctgctcttcagaagttcatcgccgggaacaacaatttttccggggagatcccggagagtctcggcaacggcatgccggtgctgcagacactaaacctgtctggtaaccagctctccggcgggatcccgaagagcgtttccaagcttaaagtcttgactcagcttgatttgagcaagaaccagctctccggcgagataccggccgagctgggcgccatgccggtgctcaacgcacttgacctgtcgtcgaacaggctctccggcggcataccgtcgtctcttgccagtctgaatctcaactcgctcaacctctcgtccaaccagctcagcggccaggtgccggccaagttcgccataggtgcctacgcccgcagcttccttgacaaccccaccctctgtacctcaggcctgggctccagctacctcgccggcgtgcggtcctgcaacgccggatcgccaggcagcgcttcctccggtggcgtctcgccagggctccgcgccggtctcctcgtagccggggccgcgctcctcctcgtcatcgtggcgttggccttcttcgccgtccgcgacatcaggagaagaaggaagcgcgtggcgcagcgcgaggactggaagatcacgcctttccagaccgatctgggcttcagcgaggcggccatactccggggtctaacggaggagaacctcgtcggccgcggcggctcggggagcgtgtaccgcgtcgcctacaccaaccggtacaccggcggcgacggcgccgtggccgtgaagaagatacggacgggcgccgcgaaggtggaggagaagctggagcgcgagttcgagtcggaggcgcgcatcctcggcaacgtccggcacaacaacatcgtcaggctgctctgctgcgtctccggcgacgaggccaagctcctggtgtacgactacatggacaacggcagcctggacgggtggctccacgggcgccgcgccatcaacgacgggcgccccgtggtggccgctgtggcgagggcgcggtccgcgcggggcggcgcgcccgctttggactggccgacgaggctcagggtggccgtcggcgccgcgcaggggctgtactacatgcaccacgagtgcaccccgcccatcgtccaccgcgacgtcaagacgagcaacatcctgctcgactccgagttccgggctaaggtcgccgactttgggctggccaggatgctggcgcaggccggcacgcccgacaccgtgtccgccgttgcaggctcgttcggctacatggctcccggtaacgatctctctctgcttgacactgttaattttgtactctccttttgtgccgtattctatacagaacatgtctagttaattaattcgagtattattatcactgagacttactctctctctcttttcagagtgtggttacacgagaaaggttgatgagaaggtggacgtgtacagctttggggtggtgctcctggagcttaccacgggcaaggcggccaacgacggcggcgagcacggttccctggcggactgggcgcggcaccactatcaatcgggagagagcatccccgacgctacggatcagtgcatcaggtacgcgggttactccgacgagatcgaggtggtgttcaggctaggcgtgatgtgcacgggggccacgcccgcgtcacggccaaccatgaaggacgtgctgcagatcctggtcaaatgctccgagcagacgcaccagaaatgcaaggcggagagcgggcaggaggagtacgaagtggcgccgctgttgctgccgcaacgaggcagccgccggaaacagcccgcgaaggccaaaggagcagacgacgacgctgacgagaggagcgatttcgattccattgtctgaagaaaggagcagagcactgccgcacctttacctactaggaaacactgatgtgagcagggaatggttagtctatgagccagcactgcactgcatgaatataaacgccatattagacagtactagaaaagatgatcatactctattaccttaccttgatggtacacttcttagtactattttgttagctgctcgcggctgatcagatcatttgagctttgataccagtgtgtaagagtacatacatagttcaaactgacatacgaaaagtgaaattatgtccccctctttattctgaaatctgaatgacaaaaggctacacgcgaaaccgctgtgattggtttgcgacatcgcatcacaatacaaacttacagggaaagggggaaaataatttgcaggaaaagaacggcatcattcaagcccccgttttcacttccctgcagttgcaaatgcttgttcatgtgataactgcaaactctttggcgccatactagctacatcccgctgcacaggcactcgtttatgtgactgcagaatagcaaaaggagatgcgaatcgcaggagggaaacgaactcccattggaaagaaacggggaaaatgggaggaaaacaagctacactgggagctcagtcccatgagctcctgttactactcgacgctagcatactgggagtgagatgctgcaagaagtgcagctccgatgccagagccatcgtttgccaacttgacaacaactgatgaggcagcctcctctccaagcaggtctgcaagcgttgcttctaggcaggttctgaacttcttgtaatgctcatagagaccaccatccagagcaatgacagtcctctgcttttgactaccgtcacttggcactctgtccctgcccagcttctttagaatgccatatataccagcagcagctaagcgtgcacctctctctgcaacgaggtcgcagacatgaagggtgatgtatcgtgcttccagggaagtatcagcgacctaaacataagttcaggcatatcgtaagtaatcaatggttcttgaaaattagatttgatagtatcctattttcaagatatgtattatcatacccccaggatatccttcagcttagctcccaggtgtttcagatcatgtgaggtatcatgatgcatcgctgacatgtccggcgtcctgcaataccacaattggagttccgttaagaaattttctacatagttacatgaatttatcttattttgatagttctgtgctaccatgatcaaggaacgcataatgcacaccatacagtctatgttgaaattttatcttattttgatagttctgtgctgcatatatgaaaagctagatacttagatgatcaacataggggacatagaagtgcacctcagtataaagcgctgctccagctttgttggaacaacatctccaaacaaggaagcatcatgagcaagcttaagcaagattctgcgcacaatctctccaagatacatgccggaaatcatcttttcatatatctgaggaaaagaagaccgaaattctttcatgcccacatatagttggaaaataaaaagataaaataaacaatacctgctcgcctgggtttaaactttcaaagtccaaggcattatcgtaatctgaacgaggaagcctttctgacttgaagtttccccattccatgttaatcaccttcatcataccaaagatccaaatgttataatattaattgatgtgacaatcatccagtgcagaagttgaagtggatacatacatttatacaaggttcaaagacatttaatgctacaagtataacgaaatcagtcactaaccatatttcctgatctaggtagtaatccagtccattttggaattgcatttgcatgctccacgtaggctgcgtttgtgccagtgcctaatattacagcagcagcaacgtcattatcaacatatcttccgccagccaatgtgcctacagtgtcattaacctgggcaaaatattagttgtcaatttacatgacacagtctggtgatatactagtaaacatccaaactcatagaacattgaaaaactccaaagtcagcattttcataggaatgccaatgtatttacccatcagcatatagcagtagcaggcatgggaaagtttcagatgataaataattttaacagagtcatgaaccaagaatttacttacaagagctgtaactttcatatcaagcccttgcctttccatagccctgctcaattcagccacaacatcttcccccacctgagttcacagaaatcattagtctatacatcaaaattatgggcataacattataaaattaaaaaagatattgcagtgttgatgccacatttgtcttgagaggctagaaattgccacattaaaagtaggaaacagaaatatgactagagtgcttcattcttggaggttcaaatttaagaagtgcaggataagcaaatacatttttttatggttacaagtgttgtatagcaaacacagctctaattgtaacatctgcattcacaatcgccgcaggatttagaagcaattataagatacttgtgaattggataaatggggacatatgccaccatgtcccgtttatatcacatctaagaataactttaccaaacatgttaatttatggataaccaaacatcagtccaaatattctgaaaggaaaatgaagggcaacggctggtcacttggtcaatgcagggaacccaaaagtcaaaagtgacacagctagtgagaattcgtttgctgacacaacgtggtttctaatcaagactgatcgtcaaggtaataaataattcctagatcatttagccatgaaatttatactaaggccattcgaattttaccgtgccattgatggaaaatccctttgtccacttaataagagtgcctgatgatattgatgtttggtgcactgggaaagaaaaggtgaagcctaactctctctgcctgccctctggcaagtggaaatcctctccctcggtcttgacaaaactttccaactcagccgcaatgaagtcaaacagttcctgtactcatatttctgaaatttgagtaaccatgaaagaaattgtgcaaacacaggagaattgaaacataacagttgaaaggaataagccactgaccatagaagtcccaaccatcaggtgaggtggaatggcaacctcttcgtactgttgactaacaacacgcttttcccttcctccaagctgaacacgtataacacggaaattggtgcccccaagatcgagagcatagaacagtccgtgctcatccctgcacaagtggcatgcaaatcagaggaagcataaaagaagatttcatgaagtgataggctcaacatttttcattttccatacgcctatggatacatataataaactgtcaaactcactgaaacttttaagcctcgagtccttgaccatttctttctctaaacttattcataaacctttcatgacatttcctacaaaattcacatggtacaaaaaaaagaacgattgttctgtgatcgactgatcgtaagcccagcatgaaggcacaaattacaaaatggacacacagatatatatagttgtcaaaagtgaccggaacctaattgttcattttataattctgtctggagtcttcactgcgaaaaaaaaattatgtcaagtctatcctggtggccactttctgctaccaccgtgagaaacctccactcagtagatcaaaattccataggaaacgaataggtctcatcattcttccgtgatcaataagaaaagagctaaaaggccgtgtcaaggcacagtgctcttgatatcaatatgtcgcacctccatctcaacaaccgaagatcaatgccacatttatgccaaatccgaacctaagcaagcgctaagccgctagggatttccaaccgattcgcccccgaagagaaacacccctcgcgaacacagtaacaactattcccaagctttctcgtgtcacgtacaccccagaaatcataaaaatcgcacaagcggagcggagggaggcctacccggtggggaggttgtcgacgtagctgatgagcatcttgagcggggcgtgagggtcggcgcggaggccgcgctccatctcctccaccatggcgtccgcgatgccgcgcagcagcgccgtgggcgtcgagaacctctgctccacctcctcgatcacagcggcggccctcctccgccgctcctcctccgcctcccgcttgctcctcctcctccgcgacaccaccaccgccaccccaaccgccgcggccgctgcagcgcacaccaccaccgccgtccccactaccgtccccttccccatagccgcgcgcgcgcttcttcacgctccccccaacccaaccctggcctccctctcgatcgagcgcgcgccaggagcaaatcccccagaccgggtcggcttcccggatcgggagctacgccacccaccactgcagcgtcctcctcctcctccttcctcctgcctccctccctcagtctctctcctctactcttttcttccgcttgcgcaagcgtgggaatgggacgagagccacgagttgggcgtttttgctcgcgaataaatcgccctcgagtttgacgttatttacggatatgcccttacgtatgaacggccctgatttgtcctttctgtaaccgtagggctcagattgcagatgccccaacgcgggctttgtctggattcgtttcgtggctctgcgtgctgctgcctgtaatatggagatttcgtgaggggtttatgtatcaaaagcttcacaagattaacgaacgaacgagcatgacagccagggaccagcagatggcacctgccggccgtgcatttaggagagccaagaagggtgttcccgtcaaattccctaattttcactagagtagtaggagtaatcagttccaaatgtccaactgattactttgtcagaactcgggcaactaggcccaccgatcagcaaaaggctgggagtgattagttaaaagggtggcaggacgtgattatgatacgggggtcacgtgcacgttggggcccacctgcagtaccgatgacgtgaccatgagctcagaagtatacgtgtcgatgaagcaacggccggctgcctggagatgcgtgctcagcgactctgagcacatatcttccctcgcgcttgggcgtgggcgtcgataattcacgactgtagcgagcgagcgatccatccatccggcccactacgtatcgtcgtggccgacgctcggatgggtcgccgcacacccaaaactcacgatcgttttagctactgctaataaaacatctatccccatcctataatataacaacttttaattacgaatctaaacaaatatatatctaaatttatagttaaaaattattatatttaacaacaaaggcaacaaaaagcagtgaacaaagcaacgaaaaacagttttagataaattacaggtaaaacactatatctatgttcttagtggtttaaaagttaatacttaaaaatatcgaaatgtgttacgattaaataactctaaaattaagtgtgaagattaaaattttggttactgtcgataagctaacaaggacgaagagttgaaaggcgcatatctatgggtaccttccacgatttgattagtcaatgtcagaaacagctttcgcacaatcactctcacgcaaaacgtgatataggccctaaagccattagtcataggctcaactggtttgctgatcatatcttttaatcagat

SEQ ID NO: 74718 - DNA, 12337 bp, Oryza sativa
atttagcataatagtaagtgctagtgaaatttggaaatctcttcgcatttatatttgttcatacgacatattgttaatacacggtttatttttgtactaattagtttgcactaatttgagtaatttaaaatgtgacgatacactttttttttatattagaggtttgaaacgatggccgatagtactaaagggacttaagagaagggtttaggggagcaggagcagtcccttgctgttatggttgctccggaaccaacggtcccaccggatggtagttccgacagcgacgtaggtgacgaagacgaggagtactcgttgccaagcgatccttgtcaaagcccaagcccgaaaaaaaggaaaaagggcgacggtgaagaaggcgacaaggactacattccccctaaagaaggggtaagtaaacttaatatgtaaaatgttcacagtgatagctattagcccgagctaattcgaaactttcatgcataccttctagtaggaaacggcgccacgacgatcaaaacggcagccgaagaaaaaagttccttcgaaagacaaggacgtaccggcaaacacaaccggcacacagaaaagcgaacggtcagcaaaggcgaagagaaggaagggcgagagaagcgtaaatagaaaggatgaagggttccatgttgttacccatgtttcgcctaaaggagagccgctcgcccctaagacggcacgtgcgaaattcagttcacagtgtggcataatagtaagggagaagatctccatcacggtcaaggactgggatcatgtaacggatggggataaggaagtcctatggaaagagttgaagaaaatcttccagttcccggaaggatcagaggcagcggtgagaaattgtgcactgcaaacaatggccaagtcttggcatggttggaaaaccaccttgaacaagaaatttgtgaagacgggacgcacaccgttttcgacgtatgccaacataacccccaatcagtgggacgactttctgaccttgaagaactccccggaagaaattaaaaggagccaaaagtactcagagttggccaagaagaacaaatttcctcatcgcttaggctccgcgggctacgcaccaaaggtggaacagtggacaaaagaggaggaggaaatgaggaagaaggggcaaccggtaccaatggaggagtggacacagagatcaaggaactgggtaagaggtagaactccgaagatcacggatgagggaaaagtatcgtttgaaaatccggagctgcagagcgtttccgataaaatagaaaatttatccagttcacaaaagaaaggatattttaagcctaaaagggagaaagatgtgctaagtacggcgctgggtactcctgagcatgggggaagggttcgaggtgtgtcgagcaagataagttggaaggaagggttcaaaaatgacccccacaagaaacgtgaagcgtacaaggataaacttagagacgaaggggctgcggagtttgaaaggaaaatgatggatttctgcatcaagcacatgattttgcctcgccccgaaaccaaagaaactgagccagattaccccttcgataacctcaaggagaatacaccctgcagattgcacgttcccattggacgctccggtaaaactcttgaggccgctacagccattgctatccctggtagaacatacaatgaacagttcatacccgatgcgtatgccaaggtgtagccacaagtggtccacgaagggtttgagtcctacgacattgactacccgactgcagatggtatatctgtacttggggatgcgatcgatcttgtaattctctggcacaagaatgacatattctttggattgggcaccgatgccggggaaaaacctgtgttgcctaaaccgggtttgggaaaacctccgaggcctcctaagaggatggtgactgataaggcggatgatccagaactggataaggaaaatccagtgccggaagtgccaccagagattgcattgccggagacagccaaggagattgcaccgccaaagacagccaatggagattgcaccgccggagacagccatggagattcaagtgccggatgtgcccatagagattacagtggcagaaccagaggtggaatttgtggcaccagtcgggtcagacaaagatgaagtaccaggattggaatgggatggtacagagccagagatatttgaagacccttctcctgcgaaagaacccgaggtgccatgagtgattaggagccacgaatccaagtccaaatatgcgaacaaggagaagttcatgctaaccgtcttcagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccgccagattgtttcggcgaagaaggttacgtatggctagatttctcagatctccacgccatatatcgtcaggataagatggacgtcaactatgtcagtgtttggtgcatgtgagtacgagttttaattaattagatgaaaaatatgtacaatacaactccatgtgattgttactaacaaacttcttctgtaggatgcaatacatggatgctaagaagaaaaaagaacccatcggcttcttggatccaactcggatctgccaaacacagcataccgttacgctagcaccagggtcagaccagctgaagggcaagaatccgaaagagatagcagaatacaagaagggcttgcacaaggagaaattgattactgtcgcacagtacattggacgagccttcttgtacttttaaaataagagagtcgtcatggccgcttataattttaagtaagtccggtacagttatcttgtatacatatgtcttattttagctgttactaactaataataatgttgttaatatgtagcgatcattatatctgtttactcatccaccctaaagacggaaccgtggtagtcttggatcctctcgattacaatcacaagcaatacaaagaatttctaaccatcttacagtagtaagttattatgactcttgcatttgtatatggatgtattacaaataaatatcctccttactctgaaacggtatgacatccatacagttcataccaatactacaagttcaagggtggagaacagacccgaacacgggagaagctgctagtacgtacctattggccggtaatactccactcactttatatattccaatagtttcactaattgcaaattataactacttttttctatgatatgttcttcagtgtcacaagcaaccgcgaggaacggtcctttgcgggtattatgcgtgcgaattccttaaggttaatggacggtacaggactaacgcggaggatgtaagtctctatactatgtactagacagctcttgatatttttgatactaatatattgattaatttcaatacatgcagttgccaagattagaatgtcgaacaagctttgacgatacaggtatcacaaatgtgcagcgtgatctgtgccacttcatccaccatgagtgctgtcatgtcaaaggagatttcttcgacccagagggtgccctagcggcaagtgacgaattcaaggatcttcaggagtggaacactactatgccataatgtaactagatgacgttatttaaagtgacaatgtaaaacaatattgtaatatatatattttggcaacacttttgatttatgcaatataagtagatttctcagtaccaaatgcttgataatcttccaatatatgtacctgcaagaatttctaataaataatttaaaagtaatttacggccaaattatatttaaatttcaatattttctacatatcttcgcaggcggaagttttcttttttgcaagcggacgattcctattttcgcaggcggaccggactagccaatgtccacctgcgaaaattatcttcgcagacggacggccgccccgcctgcgaagatcgcgatcttcacagtcgttggcttacaggcggacggccgccccgcctgcgaagacccttttcggccgcttgcgataatgcttttcctagtagtgggtattcgtcttttggtgcagatctttgcatcaacaactataccgatggctgggctcgaatcagatgcacctgaaaccaagtatggcctgttgatttggtcttttgcaggttcatgtcgatgaaaacgggctgactcaattcacatgcacggcggggtttgggtgggtggggctatgaaagaaattgggtttttttttgggaaatttcaaaacaagggtgatgattggggggaatttgaaacaagagcattaattggggatggtttatgcaattattttgatgactagatgcaagttatgtatatttctcaacatgtataaactttcaattagaaacttttttctacacctaaacatatactattaaaaacagagccatcagtactttccaaatccaaaacaaagtcgtcaaatctttccgaatcaaacccatccatcggtactttctaaaacaaaaccgttaaattattattcgtagaaagttatttagcacggcaacactatttgcatctgtgtaaaaatcaattcgacacacaaagtttgatcggaacagtgcaaaaattatttattaaaatagataaccttctacggtaacaatatttgtacatatgtataaaattgcaagtagaaagaaatataaaatttctatacacaaacttattttttaatgaagtgaaaaatgtttaaccataaattcagaaacactttatggcaccaatactgtacatgcataaactttcaataaaaagttattaaactttgtaaaaacaatctattatctatgaagtgaaaatattttatccgtaaattaatttatgaacttcctaggataaactttgtttacccacctctcaactttgcgtatcaccagaacaatttactcaagtaactaaaatagtatcggaaaaatgggaagggaggtattctcatgctgcatgaaacggaaaagaaaagaaaatacgtaccgcaaattcttgcgtagcctaaaattctgcatcaccacccgtaaaataacaagcagaccaggagacagtgactaaaaagaaaaatgagaacatagcgtgacactaccttcgcccataaatataaaagttttttttctatggatctacacgacagatttttccgtgcggtcgaatcagattttctcgtgcggaacttcggcccgtctagagcaaatcgtctgcgaaaatcactatttttgcgtgtgggtgcttatgccgcccgcacgggaaaataaaaatccaaaaaaaattcaaaaaatggaaactctaaccctagatccgggcaccccaccgccaccgccgccagatctgggtggggggcagctaccaccgccggtccccgtcgtcgtcgttggcagtggcccccgtttgcccgccgccgcctccccaccgtccacccgccgtgcgcacgccgctcccggtcaccctctgccgcgagcttgctgtcgtgcgcacaccgctcctggtcggcgagccacgccgctcccacccaccgccactcccgccactcgccgtcgagcctgccgctgagagccgcccagaggaggaggagaaggaagcacgcgccactcccggtccgcccaccgccatcgcgagcccgccgccgagagccgcccggaggaggagaaggaggcacacggcgccacggcacaggagaaggagaaggtgagagggagaggaaagtgagaggaggagaggataagtaggaatgagagaggagagaaggggccgggggagagaaagaaggaatttaaaattttttgaataggataggagggaactattatttttatgtgctgatagattaagaggcccgcacacgaaaataggcttattttcgcgtgtgggcctgttacgtgacccgcacacgaaaattgatttttctatgcgggcgacgacctggctccggtccctctatttttccgtgcagtctaacttacgggctgcatggaaataaaataggttggtgtccagaaaaatcaatcatgtatgtagtagtgatctaaattaaacaacggtcggaaaaaatgcataaatatttgtggacgaaagtagtagcaaacaagcgtgctctgaaagattaatcggtgcatctatcacatgggttggcgttcgctcgttaagatttcatgtttgacccgttgtagctcctccgctagcgagccaacacaaagattagtccacaggtaaaacttgactgaggtataggcttggtcgtctagtttcgtcttcagcactaaaacactaaacttatgaaaatagaaaactctagcaaggctcattatcaaccatcgtactcagcaagccacaccaataatacagtcatataagaaaagacaaagaggggtttctggctagttgcataaaggcagttgtaagcatctatagttgaatacagtaaaacaattaattaattatgttaacattaatctccgttgaataacgctacaccatattgaacaggtccaaccaaaccatctaaactacaccaatttattatgttaagttaattaatagtgagactaattacgactaacctcctcgatcgcccgtaactacatacatggctattcaaatagttttacactgaccagaggtgtacaactatacccatagaacacaatgccccatcatatcaccgtgccatgcctaacacgttgccatgcgagtgattatgataagatccttcgcataactcactccaaaccatccacatcacgatgagatttcacccccacccctaaaacaggggggggaggcccccaaatctagaagccgcttagccattaatccgtttctctataagtgaaggttaaatcccaaagcatcacctgataggtccatgtaagccaaaaaaacaggaccatccgatgatgaaaaaaaaaaattaaagagagccgtaggatcatatcagtaaaacaacctgacagagcgttctctcgagctttccaggcttccagcataccaataccacaccagaacctcccttggcttgctcacacatgggacatacagagcaaataaaagaagggaaaatcacatggcagaatactaactttggtatatcagcgaaaaaataatactataacaaataggtagttaaatgtcagattgttctttataaatcattaggtttgtacgattctaatataaatatacataataaaattggaaaatagtaaatttacacatgctataaaacttatgcactaatggaaaatgagtgaaggataagggtaatgctgtagcggagatggcaagaaggcaacgacttatgctacgatgaaggtgatgaaaaatattaataaaattatgtaaacttcattttagatattaatataaggtttggataaaatagcaacaaaagttcgttgtcgtactaatatagttgtcgaaactagatttcggcaataataaaagggggtggctatcaagctgaaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacaatagtttattacatatcaaaataaaaataagtatttttacattccaagtagacctcctaacgattttattctctaaaacattcagaaaattatatataagatgaaaaattcaatatgttcccaatattttttttaattatgtacaatttattggcgactgcaccttttatgttggagtccatgtatttattaataatagtataaaccaataaataatctttctagaaacacagtataaattggtacgtcatctagcagtaaaagaataattagccataaatataagcatccgtaccaagtctagaacttaaatctgggtgtaggttctactataaggaacctaacctattaagatatgctcacatcgcgaccaataaataatattgtaaatgaacactcaaatcatttaataaaatctatttaatttataaatatactctaatcatttaattacaatttgattatttgaagaaaaagtacaaacaaacacttaaaaacatgtaaaggcactcaatatagaggaggttaatatcgcgcgaatgcacatctatatacacttggtttagttgaatgattaggaccaataaaacatggcctggtgtctcgagctcgcagctcgtcaatatgctaatagtaaataatgtgattatcccattagatgagctagtggtaattaagcatggctaagtatatctagctaggtcaacataactaacccaagccagtcaaattattatcgaatgtttcacaaaggatggatatcaagtaggcatggccacaagcaagcaaataggtattgcatattcccatgtaattagcaaaacatgtacaataatcattttaaaaagtaggctcaacatgcacaagggagaatatgtgacttgccttgcttcttcgattaattttctgaacgcttttcattgcggtggtgatcctccgaaatggcggattctacatgctagcacacaaactgaggaaaaaaccaagtaaacagtacatgaaaagtaaacaaacatgtagagctcaatttttgatgaatttcgcaagttgaatggcttaatttggagttcgtatgaattagttatgaattttacaacatttgagccatttaaatcaatttatggtattaaaatgatttatgatgtcatttattaattattcttcaacaggaaaaactaggattatgacgtcacccgggggagtggcgcccacaagtgggccccagctatcgatgactcaagggggaagggcacacgttggaccgagtcctcgcatggccccggacagtgtcccccacgtgttcagcgcagattggccggccacagccaggccaaggcatggcgcataatggaccgggtggccagcgccggcttgactgaaagtggcggttcacgtgaccagatggccgctggcagcaaccatctggcatgccggcgtgcgtaggatacggtggatgaagccggaaaggaagagtgggacctcaccgaacaatcgcgcgggcaacacgacttaggaggcatgacggtggcgagtgcttcccggcggcgcttcgtgggtcgacggcagaaaggggcttccggtggcggttcacgaaggcggaggggaggacaggctccaccatgacatagcgaacaaggtgatagagtttggaagaagaggtgtggcacggtgccacaagagaagatggcccgagatcggtggaaggaggaatctcacaggattgtgacgaagatggcaatccggtggcctttggcaccgatggggaggtaaccgagataggccttgatgaagcgaaaccaacagcacaagatgtgcagcgtttcggcagctagagcggcgttgtgtggcagttggaagaggtggtggctttgggaagatggtgaaagcgttgttccagtggtgttcggggacgatagaagggtggccgagcttcttcttgtcccggaaatgctggcggtggtggagtcatgacatggccaagactggagcggtggcaagcagcggctggaaggcgaagaacggcggcgtagcttgggtgccatggtgagggagtggtgagcaattgagctcggcgacatggaaaaatgagagggggaggttcgacggttctttcaatgggctcagggaggtgggtcatggccatggaggacggcaaccggtgcgaagtagggcgatgatgtgtgtgggaggtggcttaaatgggcagagatttttggggaaagtgggatggagatagggtgggggagtgacggcgacctagtccacgccattggaacagggtgctgggaaacggcgaaaaaggcggcggcgtgtttaacattatggttcggtggttgtaggtcagacataggggatagagctaacaggtgggcccccggccccacctgctggcgagcgagagagggggctggtgatccgactaggctatgggaactagtcgagcggggcggatgggccatgtggaagtgtgcggcctggttgagaggacgggagcgacgcggccgacgggacaggccgagcgagctagtccagtgcaagtgctaacagaggaggaggccagggccgacctagggagaggaagggaggaaggattggttggaaaaaacccaaagctgagggagaggatttttattcgtttttctatttaactgatctctgaaatgaactttgagctttaaaattcgatattgagcaatttaggtcacggagaagattgcaaaaatattcccagccatgattttgaaaggaaattttaagatatcgatcgtgccgcgtgcttgacaagcgtgctgccttagtttggttggacaaaactaatgccacaacttttttttatttgcatgtgcaaccgaactgattgaaaacaaatctgttaggcactgcgactggggcgacgataatgggcgtcagcgatcaccccccatccccctataccggcctctccccctttctcctcccccttcttctcttactactatacaataaattttaaaataataaaaaaacaaagttagaaaattttatgtataaaaatactatataaaaaaatatttgaatttaaatttaaatttgaatcgggtatataaaactttctacttataaactttgggtctataaactttaggtgtataaactttaggtgtatagaaatgctatatataaaaaaattgaatttaaattcaaattcaaatttgaatcgggtatataaacttttgacttataaactttgggtctataaactttaggtgtatagaaatactatatataaaaaattgaattcaaattcaaattaatatttgaattcaaattcaaatttgaatcgggtatatataaacttttgacttgtaaactttgggtctataaactttaggtgtataaactttagatgtatagaaatactatatataaaaaaatatttgaattcaaatttaaatttgaatcggatatataaacttttgacttataaactttgggcctgtaatctttaagtgtataaactttagatgtgtaaacttgaggtgtataaactttaggtgcataaattttctaaaataggaaagtaatgcggtgccaataaataaaagtggagggagaggggattgatcgccgggagcaattgatcgctcgttaggattctcgctgcgactgtatctacaagccaaacagatatgtctcaaaataaatcgatttctaatatctcaaaaaaaaactttaatagtaagggtaaaatatcaaaatacatctcttattaataggaaagtggtatttgtaggtggataaggtaaggggtgtattgaagacaaaaataaaacatctcaatatgtttctgtagagagggtagctcacacaactagaaaaagtgtttttccatgcggcccaatcacattttcacaggcgggcaagccatccgcctgcaactcaacacttacgaaaatacttgattttcgcaggcaagcaactggtccgcctgcgaaaatagcttcgagcgctaaaaaaaatgggcagccaccgccgttttcggcggtagcttcctattcacaatccagttcccacccattccctatccattcccaatccagttctcacccattctccatccaatccagtgaatccaaattcaatagagaaatcaccagttcatccggttcatccaaaatcaccagaatcaattctagcaaagaaaccaaataaaatcattcctaaaatcacggccgccgccttgccgtagttcgccgccaccgccgcacgtccgcgccgcgctgtcgtccgccggcgccgcacggccgtg

SEQ ID NO: 74719 - DNA, 14581 bp, Oryza sativa
  unsure (1)..(14581): unsure at all n locations
tgccgccatccgccaccaccgcctgccgccaccgccggtagccgccgccgcctccggccggcggccggggagaggaggagaggtcaggggagggtagaggccgacgagagaggagaggtgtggaggggaggagaggtgtgaagtggagggacgctggagacttagaaaaaatgtagctatcgcaagtctatttatattccaagtctattttcgcagtttcgcaagcggacagtaaatttcaccccgatttatatttttgtagacggtcatttggttctaaggatcatgtccgcctgtgaaaaaaagaccccccacgtcgggaaaaatgctttttatagtagtgtcacaggctaaacatgaatttattttagacaaatcttaaactttagagatcaacttgtttgaagtctaaaattattctcggggaaaatacatgcgtctacgtgcttgcgtgctaggtgttcgaaaccttcactgtaaaagatacattacttgcatgtagtcagaaaattttcagggttgtaccgtgttcgatgatgatgaattgtttgaacggagttcgaaaaattttggtggatacccacggaccagcaccagcgtggtacacacaggagcggatccagcgttatatgagtggtgtcagctaactcacttgcatgttgtgagttgagggtgacatcatcggcccaaaatcctggatccgctcctgaacaagcatgctctaaaagattaattggcgcatccatcacgtcggtgggcattggcttgttaagatttcatgtttgacccgttgtggctcctccgctagcgagccaaccgagtggattagttttccgtagcccctctttatctcactgaataagtagacgcttctccagctctcgcaagaattgtgaaaaacgaatggtatcctggcgcgcctcttcgcggaggcccatattcatacgtactgaaagtaattagaaatttattacgtgattagagcatctccagcaataggcctgattttagagtccccaaaagttaaatggggctacacctatttttcgagatcccaaataatggctccagctccaacagtaacccccatttgttagcctctatttctttttctcttctattttgatatatactacatatttatttcttgattcacagcagaataattcaaacataaatattaataatacataaaattcaaccatattcaaatccacaattccaaacaccacaattgaaatttaaattcatttttttctcttcatattgctggcagcgcctgtcagatgcaaaaacatcttggctgttctagatattgttgaagtgttccactaatatacttcaggaaaaatcctgagaaaacttgaaaccaaagtttcagtaatttgcacttcaaggaagagactagaagcgtgcaaaccaatgtcgtcttgactgttctaggtatatccgtatatctgttttgactacaaatcaatctgaactaatgaatattgatgtaccagctatgcttggtggacggtctaatatgcaaatcaatatgagccaaagataagcagtttgatcatgtaccacctctgctcggtggtggacgttcgcgacaataggaacatcaacagccactaccacagaaacaatttctatgtacaagacctttggtaggttgtagatggaccataacctgccgcatctggaaaaaatcgagcggcatttttacatatggcttcttaagatgcccatatagaaaaatcgattttcccatacgagtctaagacaggtctgcataattatccgcacgcgaaaaatcggatttttgcgtgcgggtgcgtcactcgcacgtaaaagtagcgatttttccaaaccttttcgcgcgtgcggttgtcccttccgcacgcgaaaacctattttggaccatacgcgaaaatccttttttagtaaagagcaatggtgctgctgccgatgagagcaaggccaagaaactcctgaagagggcgtcgtcgttcacagacagatcgtcgtcgtggtgagcgatggcgggtgcagggtagggatcaaggagctcgattgacaagttcaacggatgacgtcgggtagcgcagcggtcgatcggggtagacgaggacatgacagagggaaagggcaacagtggacagtggaaccaagagcgacatgagaaaagtgcgctggagatttttcatcgtgaaaaaaaaaagagagataggggctgaacctagagcccccacgattgagtactggggggagagatttgggtgtcttcctagggcctcgctggacctcgatttttctctcttcacctcaaaaactctttggaggtttagtttaggtgctctactggagatgctcttagaagatcattattgggttgaggcttagttattttgagtagtatctaaatacccctctgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatcttcccaaaaaagaaaaaactgacttgcgccttcgcctggaagctaaatcacagcttgtctttgagtgaggcccagcgtcatcactcgcctaacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaaacctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaatgagtgtgctgcgctgcattaaatgcagcgtggggcgctcgtccaacccgcaataaacgcggctaggtgagcgccgctgtgctcacctaacccacacacgtggcgccaaacccacaggaggtcggggcgccccagccctcggggccgaaacgggagcggcccgacccctcggggagacagagggaggggcggccacatcaccctcgggcccgacccccccgagggggtcaggccacgtgggtgaccgcggctgccccaaacctctagccaagatacccccggtcccatgtcaccgacagtagcccccggcgttatgccagggcgatcgccttcctcgaggaaagcgctcgggcgtgacgccactccttaagcctggtgacaggcggggccggtctctacaggcgggcaggaatccagtggtcgcaaatcgcgcgcatcggcaagggaaaccgaccgacaataatttgcggctttcttcaagaccgctacattacttaagtagcgcacgaatcgggacgagccggttcgtttcgcctggagatgtgatgatggtgcatcggtcggcgagcgtagttaacgcgcgcacgatatgtcccatctcgactgccacggccgcaaatccgcctcgtgcgccgcaaacgggcgagcgcgattagtggaggcgtggacgcgagagacgatggggcgaggtagtaggcgcggggatcgaggagcccggcatagcgttggcaagggtactaagacaccagggaagggatttgtttccttcctctcgccactcttccccttgcctttgccacttgtgctctgactctccgtttccggcgcctacnccctgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcccgcattacccggggcggtccgtcttcttcctctctttcgcaatggcagggctggtcccgccattctcttctttcttcatagatgttctggagctttatgatctccagatggcgcacctcacccccaacgcggtaatgacgttggccatcttcgcgcacctatgcgagatgttcatcggggtgcgcccatctctccggttgttccggtggttcttcaccgtacaaccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcacgcctccgacttccgagccagcccccggcgcaagcctccagctggcgggcgccggtagatctgggagacggctacaacgccgttcttgaccgcctggcaggtctgcgatcccaggggctcacgggggccatggtgttcggcgactaccttcgtcgccggatcgcgccgctccagcggtgcgcccggggcgcctgggagtacaccgggcccgaggacatcatgaggacccaccaggggcgtaaatgggactgggaccctgaggatttcaggatggtggtccaacgggtgctgaatctcagctccatggaggcatccctcatcccccaaggggtcctccccctctgctgcgatccagagcgcgccaacatcctgaccatcatgcaggaggtcggggcgtcgggggagcgggccccccgaggccacgatggcgcgggcgggagccgcaggggggaacaacctaccccaggagggggtcgtgcttctgggccccgtgataggggcccggggggcagccgccctgccgacgcccgggggaagaggaaacaggaggataccccctccccatctcctccccgagggggcggggcggtgcgtgccaacagcaggcgcccggagggtgctgtgccgacgtcgcagcccgagggggagcgaaaaaagaagcggctccgcaagatggggggggaccgaaccatgccgaggaaacctcatctccccccaaggtggtcgtttagccgacctcctcgcaggttcgtccccgcgcccactgcggcaagttttcattctcccatctcccaaggcaagttttcactcacccgtttttcgtcttctggtttttcttctgcctcagcgagatcccgtcgcgcccttcccgccattccaagtccggccggtctgaggccgaggagacggcgaccgcggaggcccggaggcggggagttgaccggcgagaagccgcagactgcctccgggaagccgaagaagctgcccaggaggcggtccgggctcgccaggctgaggaagccgcttgggaggaggccagactccgccgggccgaggagtccgtccgggagacggaggcggcgcgcgaacgccgggcggcctgccaagcccccgactcgactccgcccgaggcgacgacgacttccgaggccgcccacgacaaggccgcgggcgcgccgctcgggcccgacccttcgggcgatgcttggggcgagccagcttcggggaacgcccccgagtccggcacgtccatcggcgggccgagccgcgcggcgcccacaccgaggcggctctcccctctgccttccgctgccccactgagcgctgaacccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcagagatcgccagggaggtgaaggaggagcgggagactgccctcatcgccaccgccgtgttcaacgcggcgcgagacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggaaagggaactggcgggtcgcgaggccgccgtcgccatccgggaggcaacgctggcggcgcacgaggccgcctgcgccgaagaggagtccgcactccgcctccgcgaggacgagctcactgggcgggagcgagctctcgaggaggccgaggccgcgacgcagcggcgggaggagcaggcgcgcctcaatctggaaggcgcccgcgccgagagggccgcactggatcagcgggccgctgaattcgaggcgcgggcgaaggagctggacgcgagagcgcgcagcggcggggcggccgcgggcgatggcgacctagccgcccgcctcgcagccaccgaacacactatcaccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggatggcgcacgcgcgagggtccgggacgccgccgaccacatcgtccacagcttcgagggtacggcccctcggctcgcgttcgcgctcgactccgacgaggagggcggtgacgacggtgcggacgacagcgacgacgaggccgacggcccgggggcgtcggagtgagcccccaggcccccgccaatcttaataacttttccttcttcttccgaggccttcgggcccccttcttgtataggctgatttaatttgtaatcaagtaaagaggaaatttctgcgtcaattaagtttgttgtgtgtatgagacgaggatggtctatgccgcggtccttctatgtcttggcttgaacgagggctcgtgcccaggtcccaaccttaagtggcgcgggtcggggctagtgcctggggagatccgcgtgtcgagactggccaggccgggagcgtggtgaccgagggttatggatgacccgattgtgggcctttgccgattcccacccggagatcaccacgccccggggcacggctcggttctgggccccgtttggcgattttagccggctcgggccaccgagggcagggtcgggcacgagcgtgctaattcaagccaagattcttcaaaagaaaacgatggcacagacacaatcctcaggaaatcgaaaatgcttttactgaaatacggaagagaaaaaagataaggatatgcatgtggtagcccccggccaaccctgcacgcccgggggggtacggggttggtccgagcccgaggcatgacacccgacccccactaggggtagaagcgacgaaggtgttcgatgttccacgggttaggcagctccgtgccgtttcccgtggccagccgaacggagcccggctgggggacgccgatcactcgatacggaccctcccacattggtgagagcttgctcagtccagcacgcgtttggacgcggcgtaggacgaggtcgtcgacgcagagtgatcgggcccggacgtgacgctaatggtagcgccgcaggctctgctggtagcgcgcggctcggagggccacgcgccgccttcgctcttccaagtagtcgaggtcgtctcggtgaagctgatcttgatcagcctcgcaatacatggtgacccgaggggaccttagggtgagctcagatgggaggaccgcctccgcgccgtagacaaggaagaaaggcatttccccggttgctcggcttggcgtggttcggttcgcccagagcaccgctggcagctcctcgatccacgagtcgccgtgcctcttgaggatgttgaaggtcttggttttaaggcccttgaggatttccgcgttggcgcgctccacttggccattgcttctggggtgggcgggggaggcgaagcatagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgactggataagcctcgggccacttagtgaacttgtcgacagcgacatacagatactcgaacccacccggggcccgcctgaacggacctagaatatcgagcccccagatagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaactaaggtgcgtgaggcgaagtgggctccgcactcgccttcatggatatcggccagaagctcgacaccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatttcagtgatccaagcaatcaatctaggggagctgggagcgctccccttgggtcccgaggcctggactccgacgggcctcgggggccgttcaggcgcgtccgtctcccctagggggtcgggtcgcgccgacggctgggcaagcctttcttcaaaggcgtccgatggggtctgggctcgcgagtaagcgagccttgagagttcgtcggcgaccgcgttatcccgtctgggcacgtgccgaagctctatcccgtcgaaatggcgctccatacgccgcacctagcgcacgtaagcgtccatctgcgggtcagagcaccggtactccttacagacctggttaacgaccaactgggagtcgcctaacatcaggaggcggcggatcctcagtccagctgccactctgagtcccgcaaggagtccctcgtactccgccatattgttggtcgcccgaaagttgagacggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcggggacggagatgggctcaggggctggggtccactccgccacaaagtcggcgagggcctggctcttgatcgcgtggcgtggttcaaagcacaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccattagaatagcgtaaagcatcttctgggcctgagggtatcgggtcttggcgtcccggagggcctcactaacgaagtagacgggccgctgcacctatcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctagcaccgtcggacaagcaggcggagggccagctccggccatcgggggcctcgggccgccgttcggctcgggggcctctcctgcctgctctctcccaggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccctccaggtaaacggcccggagcatttgaggagcttaaataggggcagtgccttctctcccagcctcgatatgaaccgacttagggcggccatgcagccggttgacgcactgcacatccctaagcttgctgggggggtgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaatcaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaatgacgaccgggttcgccagccactccggatggatgacctcacggatgaatccggcctccagaagtcgcgtcacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgccgtccagaaaaccaccgattcgtgtggtcttggacgggccgtcgcccatggcaacctccttgaccgggacctcgtcgcacgtgatcatccgctgcctcggggcggctgggacggaggtgctgagcctctcgttgccaccctcgggcttggatgcggcggcgaggtggtccgcgcgctgctccatacaagcaagcgcgcctttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagtccacccgctctgtgcggaagttggcggaaccaccgagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcgaaggtgagggcaacctccgaccaccgcgcccgccgtgtcgcctcatgggtaggggccgcggccagaagctctcgcttcatggccttgaagctccgacgagaagcgtgagcgcacgctcccccatcgacggtggcgatggtggccccaggctcctagaaccctaggtcatcgtcgccatcgtcgatgtcctcggctggggccttctgcttggcctcacttcgccggttgccggagggaagccgccggggcattgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggtgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgtcgccctgaccgagcggcggatccgggggcggccgaagctgccacaccggaaccggtggagttccaggtccaggcctcctccttgcgagccacatggtccgcgagctgaaaaagctccgcggtggtctggggctccttggaggcgatcttttcgagcatgcggttgtgccgcacgcctcccctgaacgcgtagattaccgcgtgtgcggggatgcatggtatggtgttgcggacttgacagaaccgctgaatatacgagcgaagagactcatcgtcccttcgctgtaccgcatgcaagtccgcttcttcacctgggcgcggatatgtgccttggaaattcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatcccggtcgtgtagacctggagaaactcggcggggttgacgcttccgtcatatttttcggtgatggtgggccggaaccttaggggccaacggacgttccgaaggctcgccacaaaggctcgacagccgacaccaccaaacgggggcatggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcttgacgagggaatggcagacgaacggcgggtaacggccgccgctcgccgcgccctccgcctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcagggacgacgggcgggtgacgcaagagcgcgcccgcagcttggagcgcgccctggggcgtgctgccatcgccgtagacgaggaggcgacgctccccgtctcgccgtccttcttcatcgctcgtgggcggcgaagtcgcggatctttcgacccccttgagcgcctnnctccggctaagacttcggcaagagggggcggtggagtacgagctcgacggcgcgggttctgctccccgtcgtcaccgctagcgctcggagagaggttgtgcgccactgtccgttcggccattgggctgagccggagaagcttgacgcacacgaaagaggacgaggccttagaaaaacacacgcgccccctacctggcgcgccagatgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatctttccaaaaaagaaaaaactgacttgcgccttcgcctggaagctaaatcacagcttgtctttgagtgaggcccagcgtcatcactcgcctaacaacggggatcttcctggtactccctcattaatgggcggagatttgccatggctgttgttcgaatgaccctctgatgggataggccatacctac

SEQ ID NO: 74720 - DNA, 3576 bp, Oryza sativa
tctgcatgttcgcccctcttcatacaatgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagaaaagggcggccgtatcaccctcgggcccgacccccccccccccccgagggggttaggccacgtgggtgatcgtgtctgcctcaagtctctaagtcatgatactcccggtcccatgtgaaattttctttaaaaaaacatcatacggtaatttaggaaatgcatattaaggtggtgtttggatctagggactaatttttaagttcccatcgtatcgtatgttttgaaactaatttagagtattaaacatagattaataataaaactaattgcataaatgagagctaattagcgagacaaattttctaagcacaattaatctataattagcacatatttattatagcatcacataggctaatcatggattaattaggctcaatagatccgtctcgcgaattagtctagaattatgaaataagttttatcattaatctatatttaatacttctaatctaattaatatccaaacatccaatatgacatggacaaacagcccgattgaaaatcaatagtagacggcagccgtatataccgtctgggggtccccccattttctcccttttgtcctcccctttctccgtccggaggagccgaggagttgtcgtctgtccgtgggtctcgactccatcggtcttgcgcgctatctccgaggctccggcgacgcggctgggccttgtgcagcgacggccggctgctccgacgttagtccccggcgatcccatctctccgacggtttattttttttcctgcatctcttcaaacctctctaatgtttatttatgttcggtcgagtccaatgtactggagtaatgctttgagtttggttggaaaattcttgattcagttactgatgtagcaaaggatctcccgtttttaagtttggtgattgtgtgggttcaggtaagaaatggaagtggagaatttatagggcttttgttcgtctaatcccttatatatcccgtggagattggaggggattggggataataagccgttaccaggaaaaaaaaagagggttttttataattgaaatcctgcatcagccactatgatctgctagttgcatctccttttcaagcttaagctgattttgtgaattcgctatatatatggaaatggggattactgtggttgatgcaatatttttggcactcttgtagactgcagtggaattgctccgagagcagagctctccaggtctccatggatctggacaccacacgaaagcggccccgtgaaagtggcgtcgccgtcgatcggctcagcgcgttgccggactgcctcctccatgtcatcatgtccttcatgaaggccaggcaggtggtgcagacgtgcatgctgtccaagaggtgggagcacctctggcgcaccgtgccgtgcctcgatgtagatcatcgggagttccaaagcacaggtgaagctgcacagggcgacaatgaggtgtggcagaattttgaggattttgcggacaacctgatgcttcatcaccagattgcacacctggatacgttccagctgcatgttaataatgtgtatcgttggggtcaacatgcatctaggtggattcgtcgcagcatcaagtataacaccaaggttcctggcattcctcgcccgggattgagctgcagttcttggagcctcaaaagactacatctttctaacatttgtgtggatgatctgttcgcaaagcacattagctcaatgtgctgctctctggaggatttgaatctcaaaggatgcagatttgcattcaatgagatcacgtcccactcactgaagagcttggtgatcgacagctgcgacagcaagctttgtccttccaaactggttgtcacggctcctgccattgcctccctgtgccttattgtgaaattgtggtttttccccggcggtctcattgtaaatgaaatgccattcctttcgaaagcatccattcttgtttcagccacctacgacggaaagaacttccaacacaatcaaagcaagtttcttggtagcctctgtaatgtgacaactttagagctgtcaggttttcagacaatggtatgtattctgtcttcacagacttgcttcttctatacgtttaccttgtggtgccatttcagcattatatatttcagattatacctgaggaaccggttgagttaccagaattcaagaacctcaagatcttatcccttgacaagtgtgatcttagtgacaacttccagttattgaagcactttctgcagaactcgcctaatttggagaagctcacgttgcggctttgcgaggtattcatgctcttattttggccttaacattcttacataattaaatttggctcattattggacatcctttactatactgccaacagctgccaaaggattctaagaaaaggaaagggaaggccaaggcgaagaaaacacgtttggtggatatccggtgtgagaacctaaagcttactgaaatcatctacgatgctgatgatgtcctccaactggtcgggcttttgctgaacgattcagcaaatcttcctaagaacaacataaaactcagcaaagttgatcgttagtatggttagttcaggccctcttttgtgatgaccgattcttaggcctctcctgaattcacatgtcttgtctgtcttccgatgcactgtcagttgtgtagttgaaatgcacctatcttttgacttgtctaatcggtttaagactgctctgttctgttagctattgcatgtgttcttgcgcgctgtgatgctaggttaatgaagtgatagcgattgatacttatggctatgaacagaccaatttcttactatagagcatgttcaaaacgtatgatgatccatgctcctggttgcctagtacaatgtctacaatgagcacagcaaaagcacgtctctattgaaatttgctgtgccatgtttttttaggccttatacgtctctacagctaatatcatactatcaacaaaacgatttaataaacagcagatttatatgggtatagacgtataatggtgtttcatatcctaattcatggtgtgctctctcagcccctccattctgagatgcaagatgtttagattttgtcgtaagttgaacttatacttgatcatacagaatttttacaggtacctcaaggaactagtactacagggtacctgttgt

SEQ ID NO: 74721 - DNA, 8845 bp, Oryza sativa
cgattagccgataggtataggttgaacaatcggttgttggagacttggaacccagatgttgataacaattgcagactcgagtctcgggtgtgccaaaagcgtgtgtctgctgatagccgatagcttggtgtagaatcggttgaaggattcggtgccagtacttagcgctgaacgcctttggttgttgatgccaactgatgttaatgggactttggacgattacctgaaagcttgttgtagaattggatcggctggaagtccgatacaaatagattcaaatagttatataagaaatgaagcctttgctacaattggttaaaactaacttatgtataattattagcaaacctttctttatgaaagacaatcttgatagattggacttaaccaagatagtataaaattgaagtcgatatatatagatttatctaacaactacactaatctttataagccaatgtaacacttagaaccagtaaccagataacttatcgactagtactccgatgaaacataagcctaaaaactctcggcttaacaagacttagattatcagtagcaatctaaaagatcaaaactaactgagagagtatgagatataagcaaacgtgatagatataacaaatctatcttaaaatagcattatgtttaaagagacatcaacttgatcataatatcagaccgaaccgaggaagttctaagtcgatgttactctaaacaacaatgcaatcaaaagtagagacaatatatcagatagggaacacttgcttcggcccgaatagtatattggacctaactgaggaagtcctagtcacgccgttgtaagcgaaggtgatgtaacttacttctcgccggaggtcggacttaaccaacgtagcccatgctcgaaactaagaactcgccgggagtaaactagggtgacgatacgccgaaagttgtattgatcaactgatattttacaatgatctaggatgtacatgtttatacacccatgggtagatgagtgttcgaagcacccatgggtagatgagtggtcgaagcaacctcatcctaatgctattgaatgatgagtcttcgttgaatgatgacaatagatttatttttgatatttttgaggtggttcaaataatgtatggtaagtacattgaagaatcgacaggagtgggtctgtctttagacatgaggtgattgatcttgataaattggctgatcattggagaatataccatgactacttttcgaaagaacctatataccttcctctttattttagacgcaggtgcgtaatagtgaatactccctccgtcccataaaaaaccaacctagtatcagatgtgacacatactagtactatgaatctagatatacatatgtccagattcgtaatactagaatatgtcatatccggtcatagattcgttttttatgggacgaagggagtagtattttttcaatcttggtttgaattaccgacttgagtgcgcagtgccgttcaagtgcgcaacgcacgggaagtccgcaagtgcgtcggaacccgggtttcccttaccgtcggtaaccgtgcggttaccgggcttaccgcgggggtacggtaatataaataccgcagtaacctccttaaattcaaataaattttaaaaataatttaattttttgataaattttgcacggtttttcgcggtcaccgcgataaccgtgcttatcactggggcgcggtaaccccggccccgacggtttgggaaaccctggtcggaacacactattgcatcttcgtgccttcgggcttcatcggttcatccatggtccaactgggttcatccatggtccaactgaatcagcaacagccaacatgcaacagattacacatggaatcatagagtaaaggcagcaatcaggcatcagcagaagcagaagtgcagaacgacgggcgtcgccgtcggtcgacggcaacagcaagagaaacctgcgcggctcggacgaagtaattaatttgtttcgtttgatattatggaacggatgaagtaattgtatgcatgcatacatacaattaattaggacctcttctacattaaattagtacttttttaaatcctccatccttaagatgtctaattctattgaatgcatgtattatactctctccattccaaaatataagacacaaccaccctatatccaaagaccaaaaaacaattattatcacctctttgtttcaataatcccaactaatacaatacatgcacccagtagaattaagcatcttgatttaaaaaataataatctaggagagagaatttgcaattaattatcatgcatgcatgcacgccttatattatgaaacatctttaaaaagtagttgcgccctatattttagaacggatggagtatttattagggtgatctaaactaggagatgataataattgtttcttggtttttaggttaagggtggtagtgacttatatttttggaacggagggagtagcaaccggtactcacgaacatgcggactcgcgaagatataggaaaccaacaggtttgctagtggtagttggaaattaacgaagatcggaagatactatgatcatatgatcatatgcaacagtccggtccggttttgaagcctaatccagtacgtttcgctaccgaagctaaacaagatggaacagctagcgcgccgcgtaatactcagatccgatcgatcaaagcaacaactcacaacttcgcgcgcgcggcgcggctcggctgggggcgtccgccattgtcgtcgaccatggagatcgagggctcccgcaagcgcaagcgtactcccgccgccgccgccgccgccgaggaccggctgagcgagctgccggactgcctcctccacgacatcctgtcccacctcaaggcccggcaggtggtgcagacgtgcgtgctgtcgcggcggtggcgccacctctggcgctccgtgccgcgcctcgacgtcgactgcaaggatttctggtcgccgccgccggcgtcgacgcagcagcagcagcagcacgcggctctgttggcggcggagttcgccaggttcgaggacttcgccgacaacctcctgctccgccggagcgccgccgcgccgctggacgccctgcgcctgcgcgtcgacgagcgatgccagcgcaccacctacggcaggtgggtccgccgcgccatggtcatgcacgcgccggcggcgctcgaggtcgtccgccactacggcggcggcggcgccgcggcgccgctcttcgcggcgctgccgctgtccctgccctccggctgccaccgccgcctcacgaggctctgcctcgacggcgtcaccctccccgcggggttcgacgcgatgctcgcctcggggtcggggctccccgtcctggaggacctggagctcagggcagcccactacccgttcgcgcggatcgcctccgccacgctcaagaagctcgccgtcgagcgctgcggcggcggcggcgcgggctacctcaccagcgacgacggcggcgtggtcgtcatctccgccccgcgcctctcctcgctgcgcctcggcatctacctcgagcccaactggcccgccttcgccgtggaggggcccacgccgtccctcgtcgaagcatcgatccaagtcttccacgccaccgccattgatgcacatgcacctgagccgcagattacgcagaggatgagcttgctgaaatctctttgcaatctgcttgctggcatctcccacgtcagtagcctagagctgtcaggccttcatggactggtacgcgtcaaatccttcaattctcaatatatatagggagtggattctaatccctcgaggggatatcccctcgtatacctttttcttctaaattcgatgcaaatagttgtgaaaaaatctgaaaaaaattgacaatgtagagtataatgatacctattagtccaccaaaattcatgttcaaattcgatctacacatcgagaaacaaaaaagacaaatttagatataaacagtacactactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatatatatatatatatatatatatatatatatatatatatatatatatatatatatatatatatatattcctctttccgttttatatttaattctttagttaaactttattaagtttgatcaagtttataaaaaaaattagcaacatctaaaatatcaaatcagtttcattaaaattaacataagatatactttgataatatatttattttgtattgaaaataccactatttttttctataaactctttcaaagttgaagaattttgactagggaaagagtaaaacgacttataatatgaaaatgagggagtacttcgttttgaaacatctgtgccaaaggagtatttcagaaatttcagaacaacattttttttgaattcttaacaaattttggtcaaatttaaatagatttctaccaaatttaaaaacaagaaggaaaattcgggaaaaatagtttcatgccaataccgaggatgcaaacatttacttctggcactgaaaccgaaccgtataaaataaaagagaaatgttactatccttgaggagatatcaaggagtatcatagtcgtatatcgtcctaaagagagatcggacattgagaggtgccgtatatagtatttcgtaaaatttggtgcctcaaggacataacaaagactctagagggattgttcctgttacattatcattgatttggtaattctgaactaattaactgttcctataattaactagctactcctggttttctgtatttcaggtgatgccattgcaaggagagggaaatgatccttacaatcaagcaccagcaggccagcactatcataatccagacaagaacctagctcagtattatcaagcattgcctcccatctttcagtatcaacaaccagttcagtattatgatataccaccactccatcctctctttccaccttataattaccagcatcctaattgggcggcgcaacaccgtcaacctatgcccctgttgcaaacaatgctggatgacaaccatggcggattgccggtgttctctaacctaacaaccatggtgcttcgcgagtgcaatatccatgtaaatgacagcatgaaaatgctgtggcgtttcctgcagaacacccctgcgctggagaagctcactcttcagaattgcaaggtaaacagcatgcaaacttttatttccttttagttaatttaccttgcaatatatgtatacatctttagaattttgactctattaatatttgctttggttttactaattaatatacatttgtcgttgccgaaaatagttctcaaatggtgctgatgttaggaaacatggtcctaagttgaagatctcttccagcttaaagtttgtggatatcatatacaaagatgtgaatcaccatgatggcgaagaagatgagtatgaagacgaagatgaagacaaagatgaacatcctgaggaagttaataaggttttgttcataatgtcaagaaaattgaaagatgttactgtcaaagttaagaaagtagatggatatcaatagtatttttagttgttttccgttgttgggaaaaaccattgtatttaatctatcgcgtacagtttgtctacttcgaaacttaatcgcttactatttttctcgcatgaatcatgaatggataatcacatatactgttcataatagcaaattaaaaccatttgtaacaagttgttttaatgatattcatagatttattagagtgagtagtatgtgagcgtggtggatccaacaatccaaccccaagtcatggatgtaaaattatactccctccgtttcaaaatgtttgacaccgttgactttttagcacatgtttaactgttcgtcttattaaaaaaatttatgaaatatgtaaaactatatatgtacatgaaagtatatctaacaatgaatcaaatgatatgaaaaaaataaataattacttaaattttttttgaataagacgaatggtcaaacatgtgataaaaagtcaacggtgtaaaatattttgaaacggatggagtagtattctactgtaatcaggcaatacgaattacgaagcgcactcgtttatgatccaaccatgggatacaaagctcctgaattcctgatgctaacgaatgcacagcttttgtagcttgatatctattgaatgaaattgacgtgtcgcccgtttgttaaaataaacttttacagcttgatcgttgggcccaaacaaagtgataagtcgtaaacacagagcaacaaaaaataatttatgaatattttttttcatttacggattagcaatttaaaagccagttctgaaaaataagctacgatatgaaaacctcaaaattatctttaaaatcaaaattcggttgcccatgggtttgtaattgagaaaaaaaaatccaagaccattagttttttttggacaaattaagaccatagtacctggtttgtgggcttaaattagattgggccggccgtgctgagaagcctgagatttggccaggcctgactggcgagaaggcccaatttcatgctgggcccactctctgcttcctgggtcgccctcctccgtgacgcaccttgactgcccccggtttttcctaatctccgatttaattaacttttatccccaattatatcccctccttttatctaatttcctttccttattttttttcctctctctctctctctctctctctctctcttttcccccacctcgctctctcctctcttcctcttcccccaatctccgacagttgccaaattcccttcccacccccaaacccaaaccccagcgacgacggcgacgacgcgcagcagacgaaagcgagcgagaggcgagagaaatcccatcgtttcccaaaccctaaccccctcctcctcctcctccagatctcggcggccgcgcggctgatgcgaggtgagccccgtccgccctagggtttgcggcggggtgcgtggtggtggtggttgggccgggggggacggggccctcctgctcgcgggggtgggggttgggtggggatggcggcggcgcgcgcgcacgtgaaggacccggcgcaccggaccaaggtggtgctccggaggctgccgccggcgatcgcgcagcaggccgtcgtggaacaggtcgacgcgcgcttcggcggccggtacgactggtcgtgcttccgccccggcaatgccaggtaacgcgcgattcctctcgccttgctccctccgtgtgcgtcgtgcgggtgcgtgcgtgcgtgcgtgcgtgtggttggggggcgtcgggggcacgtttggtctgtagctagggattgggttcgaagctgtttattagcctgcgaattgtgtacggggaggtaccaccccatgaaatttcgttagtagatttcattggctggttttgattgagtagctgtggccagcaattagcattctataatcgtgcaatttacagatacaagtttggactgtttgcctctatctagtgcatttggttatgtctagcaacaaataggttgctgtgatcaagtagttactgagttttaagtttgcaatcctaactgattgtgggccatttacagttctttcgcgttgttgtgatctcgaagcatagtggattgtgtacttcaaattgtagctaggatattttggaggtgtattttagtttattcttattagatttaatattagctgtgaccaaattattgcttggagatagtgcccaccttcttagttttgttgcataattttagctgtaagtgaactaaatgtgcttttgattgcagctagtataagtgaggtcaatatgttttttttttataaaaaaaattaccttaccttgccattttggctgctggagtaagaggttttgttctgtttgttcatttttatgcttctgtaggattgccttaagacatgctagttatagagaaaatttcctataagaaaacatgcacactgcaaaactacttggcagcattgagccttttttagtttgtgctgagtgatgtgcaacgtactgtggccattcgtatgtagctagtgattcaattgttatgtctgcaattcttaactcattgccgtggaagctaaatgatagtggcattctccacttcatttttattctcatttttctgacaatgttattgcttgtccagccaaaagaatcacagatattctcgactctaccttaacttcaagggcccagaagatgtcgttgaatttgctgaggtcttcaatggtcatgtgtttgtgaatgaaaagggtaactttcacatttatgtaccaacgtttctttttgccatgcaaatttatattcaggattcagaacttatattctgattatgtcaatgttgtcactatcaaaactagatacacatgtagcaatataagcagtgtggatctttgtacaaactaatagtgcaacatagagaatcagaatgaaattgcaattattgagcatttacatagtctttgaattggagattgatcttgtcgaataggattttgggactaaacagtaggttttgcatatttttccctattcaacttattgatgtctagtattatttttccctttttgattagtgcgcagcaaagaaaatattcaactgtaactatataaattccaatattatggaaatagtttaaattgag

SEQ ID NO: 74722 - DNA, 16249 bp, Oryza sativa
ctgcattaaatgcggcgtggggcgctcgtccaacccgcaataaacgcggttaggtgagcgccgttgtgctcacctaacccacacacgtggagccaaacccacagggggtcggggcgccccagccctcggggccgaaacgggagcggcccgacccctcggggagacagagggaggggcggccacatcaccctcgggcccgacccccccccccccccgagggggtcaggccacgtgggtgaccgcggctgccccaaacctctagccaagatacccccggtcccatgtcaccgacaccctctatcctagaaaatagctatttttagttatgtgtatgtatagccaaaagtagctatatattgagacatagagaagtatacaagttcgcaatgatattaataattaaggactaattaactgcttaacaagatctaatttctaactttaacgtttgttctatatttatttatacacaatcattatcctccaaaatcaaattataccaaatgacgcttcgaaaatgccaccaagaacattacccagagcgcatagagaagtgtcactttgcagcgaactgtatttactgtgatactaggccaaagaattgtgagaaagggtagtatatctgactattgaattcaagtccatatcatctatcacttgttgcaagttaattaccttgcaaaattgcttatattttaccacctatatatgatggcatcatattcaggagagagatgaaaaatggattaatgtgttatatggattaccgtgttatattaaaacaacaataaattagagagagataatataactaatgagaagaatatattagtatttgaaatggtaatgatgtttgtttttttaattatctctttcaacgcactttcctttggctagttttatgcaattgattagttggtttgaaagcataactaaaattgtggtaccagtaatgtccaagagtcctaagttacaatcattattatatctgaaattcctatgatggtgcaaaataaaaacatccctaaaatgctaaggcaagtttactagggagggaatacaacgaaagtaattaatagaaaaaaggttttgaactgataaaacttttgatttgcggacccagatatgcaagagggtacaaatcatcttattttagataaagttttgtcagtgttctagattccccatatatgtgaactaggctctgcggagcccaccatattctaaatcatgtaaagaatcaagtctcatatgtatggtaaaagtcctgagtacacaaggaaggagtgccggataaggaaagagaaatagagttctattctggtccgactagtatatcacagatcatgtcatgtacgaaatcaagcctcatatgtatggtaaagtctgtacacaagcgagaagtctcggataaagaaagagaaatagaatcctattctagctcgactagtactacatggataatatccatatttgcttccctagttatacttcgacatggggtacgtaactaagggtataaatacaagcttatgcaagcccaatacaagccaagagggatacaaagccacctccaatctcaccaagttcattctcatggaagccaataacagctagccatcgaccatatacctgagctttacgctaatatacatataatggtaaaactggctccggccaacaaaaatagagctattacccatcatcaggggcccgaacatgtataaaaatccttgtctctcttgctctctttataactttgtttgcattctcatatcagcgcatcccaacgtactctaaacaaatcatataggtacggatcctgtgatcggtgcataatccatcgacaagtttgaactctgaaaatcaacttattgtcaaatggagggaatatatatttgaatgcaacaaacaaattatgtttcttttactcttggaatgtcataaaatccccctcccaaaaaaaaagtgaaattagaaaaataccactactatttatgatatcggctacgtgtcactgaaatttagagaaattggaaccgtgccactcagtcgtgttttccatccacttttctgtcatacccgttaattctattcttgccggccacctccggcggcgagcgacggtgtgggaagcggcggaaggaaacggagatgagcaagagcgcaaggaagcgtttgtgcagggtgctcaactgccggaagctgttggacaaggcgtgcatgcacgcggcgcagaacgagctcctcctgctccgtatggtggtgcaggtgctcttcttaaagcacgcgcgtgcggcggcggtggcgggacggcacgctgcggccaccgagctgccgagcaatatcaaggcgctaccgcagtccaagacccaggtcgcgggaggacgacacggaccgcgtggacgagcagcggctccgcgtgctcgccgccggcgcgtcgccgggggacgactggagcgtggagggcctgcggcacacggcgtccaagatcgccacgctgcggatgaagctggaggaggacgaccacgacggcgccggtgatgacgacgaggagttcgtgcggaggcagcaggccgggctggtgcaaggatagaaattgacggagatgacagaaaagtggatggaaaataggacggagtgatacggttttaatttttctaaatttcagtggcacttagctaacattatgaatattagtggtattttttaaatttcgtatatttgtaatggtatgaatccaattaactttttttatgactctcaaattttccattcatcattctgagatgtcatcacaaaaaagtcgtcatccagattcccaagccaacatactactaatcaaatttagtgttcagttatttgaaacagactattgagccgatagttgctgcagactatttacttgattacggttttttgagattgctgacagatgtgctcatagtgaggaagctgttcgacgcaatgatggcaagggaaaggcacggaggacatagcattgagtaagaaagaagaccaagcacatgaaagaagccaggatagcctaggaaagaagaacaagaagcgcatggcagaatgggaggtactcgcagcaaatcgagaaccgcttcaaccctggcgaaacaaaagtcaaggagaggctcccggctaaaagtggcacctagctagtgtacaaaacaagctcgcactccttggccggctgccatgtctttcacccaaagatgaatcgccagatggcccatccaacggaccagcgagtacgagtcatcgagaacaaatatagcggccccccaagtcttcggatgatgaggatgaggatgactatcctaacgccaatcacagagtggcctatatcttatgaggatcaacatcctacatattcttcctcaagggagtaaaaaaggacgaacgcgatgtttgctccatctcccagggacaagtgacaaagcttctctggtcggatcagtgtggggtcacctagtttgagctcagtaccacaaatatctacacacgatcatctcggattttgatcacacacggattgatatccagaacagttttcgattatttatacaagtatgttttacatcaaactagctattagaattattaaaggtgcaaagatccaaactaagacaaccttcttcaaataaaaagattcaaatctactaaaaattccacaggcaatctcgagtgtagactaggcctagaaaaacttgtcaccgttgaagatttcatcactttctaaggcttcttcatagtattggtcttctatatgttaaattatgtaagagtgagaacttatctacccaacaaaacacaatataaccacgtgtataagagatatgaatagaagtatcttaagcatgcaaaaaaaatatattacctacatcatttttcactgctggggaaggccacattagtcccggttcacaaccccttttagtctcgattgtgcaacagggatacacaatccaggactaaagataagtatttaataacgggactaaaaatccatctttagtaccggtcagtaacacgaacgggtactaatgatttttttattttttttaattctttttattgcttgcgatttttttatgtaatacatatttatatagaagtatattatattcacggtagcgctacgtgaagcgctgcgctctacgcaacacggtggcgcgactcacagcgatgaggatctctgaatttttccttttttcctccaccgaccgcgttttttgtttctccccgcacctgccgtctccaggaccagagcacttcctccaacaggtctccacgtggcctccccaattcctttttcttggtcagtaaaaaatttcctgatcaaaatcacggttaggtcatcaaaaaaaaattcctgataaaaaacaggtttcgaccatcagtaaaaaagtgaaatcaggtttccaccatcagttaaaaaaaaatgagaacggccctgcagtaaaaattttactccccgagcacaattatacgagtacttgttaaggttagtaatatttttactctagtatatttataaatccctttctcaaggtggtcatagtagtatatttataaatcatcgccaatggatacaacccacctcaaggaaggaatggtcatggcggcggctccggaactatgccaccgctcgacgccaacagctggaccacgacacgcgatgccgctctccgccatcaccaacgactccgtgccatccttgagatttggcgattgcgtctactgtagatataaaaaaaggactgaaaaagagaaaaaatggttggatacggtgggatggctggccggagacggtataaatactactccctccatcctaaaatataacaacttttaggtttcaggatttgtcttaaaatataacaacttctccaccaacattctcttcccaaccactcacaaccctccaccatttacttttcccacctacctccactactcatccaatcacaaccctccaccattcacttctatctactttcttagggcctattcactttgatgtcattttcaactgtatcaaattttgataaagttgccaaaaaagtggctacatttagtttgctgctaaatttttgtaactatataagaaatcctgccaaaattttggtaacttattaaaattttagcaactatgccaaaattttggcaatgccaaaatttggtaaggttttttttcatcaaagtgaacaggcccttaataaccgtgtcaaactctaaaacattttatattctgggacggataaagtaacattttattatggtaaaaaattactacctttatcgtttgggtggacaaggacgcacagtgaccagagtcaagtgggattcgtatagcagtaaaaaaattactagcacgttagccggaccctgaggtgttacaaaccgcccgtcgctccaccgccgctgccgccgccggaacgagatcctctgacttagctcgttctaagtcagaggcgcacagtacgctgatgtgggtatttttaaccatccgatccgcagcgaacggacgagattgattgctacagtactttcctgaacagtaaccgtgaccggtatgttgctacagtactatatcggaggcactacagcgcatgactcagattactgtgcgcctctgacttagaacgtgtttaagtcagaggagccggttcatccgccgccaaatcccggatgggaagcactcccctctcccggcttctcccgaatgagtaaaaaagtatggatcatattatctgtagaatattagttatgtcagtaacaaaattgttttattaatcctttgtattattttaccttttattaatattttgtattcttttctccacattcatccggtagtagttcagtacaaataaaatttactgaacaatatacgtcactggatattttttttactgaaggatagttatacggtaactgaacagaaccatctgtatgccgaacaaaaaattgctgtgatagttaaaaatttactcctcaagtgttggtcgttcgatccatataggtgggaagcgggactctatgtgatagtaaaaaaattacccagataaatgaggagtgggtgggtgttgtgaggtgagctatttagttaaacagcacgtacgtagagtagttctatgctgtcgaaaggacaactgcgcacgtcgaaggacgtggttactcaatagtgttggaaacagtagatgtattaatttaatatttttcttaggatcccgcttatatgtccctagggggctatttataattctattacaggttcccccattagggtttaggttttataggggaatttacatggttgtctttatgaaagggacatttacatgggtacacagtgtaatttggatatatgggcctctaataggctaatgggcgaacattggcctaatggcaaacgggcctgatggttcgactggccccttgggcctccttgaagttggacttgttgtgacgaagtctccttccttcggcgtacacccttcgccatttactcttcgcccaaaatgcctttggtctcgcgggataccagcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtgggttatatattcccccccccccccgttttcaccgccgcacccccgtcattttcaccgtgagctttctctttctccgcctctcacttcacagcgctcttgagtcaatagaccattccactgttcccctcttcgccaccgcccacacttttcgccatggcccctcgcaagccaaacccagcctccgcgataggccctgatcccagcaagatagatgacgacaccaccgcctatcttgggacttcgctcgtggacgaggatgagttggcgaagatggttacctccggcttgttggcggaaaatcaggccttcgccccgggaaaggctgtggtgccgaagcccagcgacaaccggacggtggtattcgccgtgttcttcgaggcgggacttcgttttccgtgcaacgtgctgtggctagagatcctttgcctttttcaggtggagctcccccaactgagcccatcggctctcgtccggatcgccatctttcactgggcgtgtcggaccgctaggttcgaaccgagagcggggctgttcgacgctattttttatgccaccgtaaattcgaaaacggtggtcacgcccgcagggatgaaaaagatagcgttcgggagcgtaaacttcaacgttcgtcccaagcactccgatctttggccggtcaacgccgccatgtccaagtgggaccgccactggatgtcgaagtggttctatcactccatccttttcgaggccgggtccgagtcagcgaaagctctccgatggcatcgcagggcgatcgcaccgaaccaaaagcccaaggtcaccgtcgacggcgccatagaagctcggtttgccttgcttcgcaaggtctgctcccgtcttagctgctgtgacctggtgaaagagttttgcatgcttcggatcttccctctctcctagacgtggcaagtcgaggtgagcccagacgaagaggtcgatggcttgacgagactcatcatgccagaaggggcgaacagtgagtctttgatttcctacatttatccgtgcttcgctctttcgtcctgttcggtgcttaatatgataacacgcttcgtttttgcagcgttaactcttgcccaggccgacactgaagctcggaagatgattggcgatgtgtcggtcgccgaatacagccagctgcttatgcggcaggcggccggccgggcgaaccggttgtacgacggcgaacttcctccccgggcgaagcccttcaaggccgatggggatgaagggacttctagaaaatggatgcgcgggcaagtcaaacttgctcctcggaagcaaaaggcccctgccgccaccgactctgacgccgatgactaagacactgccgacgacaatgatggcgaaggggaaggggaggatgaggaggaggtagaggttgcggtctaaacggccgtggacgtgcccaccgacaactgcactgagacgcacggctacaccccaactccaagccccgaccatgccgaaatcggggtggagtcgaacagctcccccctccgcctcaaggatttggagggggcgaagacgctggtctcgattgcagcggccagggtggcgaaggggggttcagttaagaagacctccaaaaagaaagggctcgtcgatgtcgctcgcatctttagcgatgatgagtcctcggatgggacccctacttcgcccgctagtcggagtctgggtctttcgaccgctcctggtgctgcggcagacgcgggcgaaacgggcggtagcactgcagccgggacttcagcttctgctgaccgggttgtgaagtccgcggccaggcttttcggaagccctgtgcgcaaaccggtggcttcgccgctcgccatccaaaaggggaagaaaacggtcgccgaaacatcggtttcagactattctcttgcggcgccccgcttcgcccctgctgatttcgagacttgagcggatctcatccccttcatcgagggggtaagcaatcttgtttctccggctggcagcccaagcctgttcaccgagttgaacgagttcgacgaaggctgttccgccatcaagagcttggcagtccgggtacgtcgttcgtttttccttctttttactcgtcgtttttcgacaacttatgttaacgatcaccctcttttcttttgaactagattcttgtggcccattgttctactgagtgaaccatacgggctcgccttgacggcttcaaataccgtcttcgagctaaagacgacgaattaggccgcaagaacctggagatggagggcctcgccaacacgctcaaggagacgaaggctgggaacaaacggctccaagttgaggtcgagaaggggagcgaggcaaaggccgagatcaagcgtctcaaggccgaactcaaaaaggagaaagaacattccgccgctcttaccgactactataatctcaccgagccgaagatcgaggctcttcgtgaagaggtcagcaagttagaggcgaccgctgagagagacgcacagcggttcgcgcaggaaatggcgaaagccactgaatccgccaagaccgcttgctgtacacttcgccttgccctcactgacatggggggcaaaggtgcgaggagtccctagcgaagatgcctccgcttttgacttctcggagtggactcaacaggccggccttgcggtctctgattgcgtcaccgcgtacggcgattgttgtgcacgtgtgtcggcggctttcaccatgggactgctgcaacagttcgggagcgagcacatcgccgagtttccaaattttgcgaagggggactgggaggtcagttctcaggatgtttcgcctgcactccatgcctggcgtaagtagttctggcaaaaggatggccgatctactgccaaggcgcgtctgcttgagcacttggcgaaggcagaggcagcggatcaggccgaagagcctgcggccaaagagtgtggaggagatgcaggagccagggtggacatcggccaagatcacccagaggtgtgaggccctccgcccgctttttagattttgtagatttcttttggcattttccgtggagggcgaacaatgtaaatttggccaatggccctcctcctttcatattgtagccgaaaacggcgtttttaatatatgaaatagatgtcccaagcttagctaactattatgcttgatgcctttggtacatattcttgcatcgtttcgcatacgaaatggagggttacgcttttcttccactctatgtgttttttctagttttaactttgcactttgccatttgccctttctatactgtcttagcagggtcttcgccgaaaattgtgttcggccctcctttgggaattggcgaagtaaaaatgaaaagtttgtggcggtgaagggtttgccgaaggtccggtgtccatttcggcctgtttaccgcgagatggtcataaacggcaatagttacaaggttttaaaagttgccggctggatgcggacgcaccccgggtggaccctggacgactacgactgtgtccatgtggaacgtcgagaggatatgattcgcttttggcgaaaccattagaggaccgatcgtcaggaagcgattgcccagcgtcgttatagtatagtttgtgtttcgcccccttctcctcttagggtagtgtataatgttagtagtgatgacgagccaagtttgccaaatcacaccttagggagtggtgggtgttttgggggcgaagatgtatttttttgtaagctaggctgtaaagcccgttattttctttcacctgtaccatgttgtatggcatgtattcttcgatatcttttgaagttaataaagatgtgttttgtttcctttccgctattgttcgcatagtcacctttcgtgctttcgttaggtcgaaacatgtcggcccccttgcatatattagcgaaataggtctactgacttttcagttttcgacttccgctttcgatctgtggtattctgtgcagaaagaagcgtttgtgttttcacatagatcgagtataacggtgttcggttatttattccccgaaacaagctgtcgtggtttcaacgttcgacgagcgatgcttcggccgattcatttcgcccccctggcgttttcgctgatcaggcgtttgccttggggtttttccacgaattatcattcacacaagtaaaaaaggcgaaagacacaagaattttatactggttcgggcgtccaggatagataatagccctacatccagttttctttttttttccttttcctcttttttttgtatttttgtgccgtagggcttacataacaagagatgccaaaaggcctatacaatagtatttacatttttacaagttggcaaatggggtgccaccccttctagacatagaaacgcttaagagaagcagcgttccagcagtggtcgaactcttcaccttccaatgtcgccaagcgaaaagagcccgtcctggacctgtgcttgatgaggtatggcccttcccattttgattcaagctttccgaccgccactgggttcgccttcttccttaggacgagatggccaggcaatagcttcgccagtcgaacttttttgttgtaagttgtcgaggtgcttgtggcgtatttacgcatgtgttccagtgcttcgactctcaccccttcgaggagttcgagcgacacctcgcgcccatcttcgcctctagagaacattacccttcgcgaattagcccctatctctgttggggtcattgcttcgtcaccatagagaagcatgaacggcctgaacttggttggccttgtgggtgtcgtccgaagggcccagagaatggatagcatttcgtctggccatttacccttcgccgccccctcaagccttttcttgagcgcctccaggatcttgtcgtttgtacgttcggccgtcccattcgactgtgggtgcgccaccgaggtgaacctgatttccaggtttagccctttgcacatctctctgaacttgtcggagtcgaattgcttaccattgtcagtgataaattcctttggcactccgaaacggcaaacaatgtttttccatacaaatttctgtactgctgccgaagtgattgccccaagcggttcagcttcgatccaacgggagaagtattcgattgctacaattgtaaacttgtacccatttcgtgctaccgggaaagggctgatgatgtctaacccccatctggcgaaaggctagactggtgcgataggttgcagctcataatgggatgctgcttggcttcggctataccgctgacagctttcgtacttcttagcttgctcaacacaaactttcagcacggtgggccaatacaccccctggtgaaacactttggaagcaaccgttcttgcggcttgatgagcaccgcacagccccttgtgtatttctttcgccatttcctcgccttcggcaaaggagatgcagtgaagcaggggttggagcaccccggtgcgatacagctgccctgagaccaacttgtatcttgcggctctgagttgtaggcgcttcgcttctgcttcgtcctccgggagccaaccgttcttgaggtactttatgaacggtgtttgccagtcttcagggtcttcgcccagttctgcctggtcgattgccatgatgtccaggctctctgtgggcacaattggtgtgtacaagacttcaaagatgatgcctggcgaatgtgggcctccacaagcagcggatttcgctagggcgtctgcttccttgttctggcctctaggtaagtgttagaccgttatgccggtgaaacacttttccatagatcgaacaacctccagatacctcttcattccttcttcttttggttcaaaagatttgtcaacatgacttgcctccagcttggagtctgttcggatgagcaagcgtcgaacccccactgctttcgcctttcttaggcccaacagtacagcttcgtattctgccgtgttgttggtcgtgtcgaactgcagccttgcagcgtaccgaatcggcacgccccctggcggagcgacaactgctacggcgctcgcccccttgtgcgaccacgagccgtccgagtacatcacccaaggttgtttggcaggctcgggtttaggggcgaatgctggcgtccattcggccacaaagtcggctaggatttgggacttgatggcagtacgggcgacaaaatgcaggtcgaagggagataactccgccgcccacttgctgagccggccagtaatttccttgccccggagcacttcgcccaaaggatactgtaatggcacagtgactttgtgggcctgaaagtagtgtttaagcttgcgcgaagccatcactagggcgtaagcaagcttttccatttcaatgtatcttattttcgccccttgcaaagcttcggagacgaaatacactggtttctggcctgactctgtctcttggatgaggattgcattgaccgccactggcgaagctgctagatagagtagcagatcgcttcccggtgctgggctgaccaaatcgggtgggctttgcagatattgcttcagctcgtcgaacgctgcttggcattcgggtgtccagctaaactttcccgcgccccggagggtcttgaagaagggcaaacctctttcggctgctgttgagaggaatcgacagagcgccgcaattcggcctgcgagcttttgtacttcgcgtacgctcgataggggcttcatttgctgaatggcatcgattttctcggggttcgcctcgatacccctttcagaaacaagaaaacccaacaacttgcccgcgcgaacaccaaaaacacacttctcagggtttagcttcatacccgccgtgcgtaagttgtcgaaggtcttctataagtcggacacatggttgaaagccttgcggctttttacgatgatatcgtccacataggcctctacatttcaccccaactgcttgtaaaggaccttgcacaccagcttggcgaaggttgctccggtgttcctcagaccgaaaggcatcctgaggtggcaaaaagtgccgaacggcgtgatgaagactgtcttggggatgtcggccggattcatgtggatctggtgatagccggagtacgcatccaaaaagctcatgagttcgcagccagctgtcgaatcaacaagctggtcgatccgcgacaggggggagtcgtctttcaggcacaccttgttgaggtctgtgaaatcgacgcacaagcgccatttgccgttcgacttccacaccaatatggggttcgccaaccactcggggtggtcgatctctcggaccaccccggccttgatcagcttttgcacttcggcttttgctgcctcttggagatcagcggacatcttgcgcagcttctgtttccttggcctggcatccggcttgacagccagatgatgcatgatgaggtccgtcgaaacacctcccacttcgtcggggccccaggcgaagatgtcaatgttctttttgagcaccttcaggatgttctcggcttccctttcacccaggtcgccccctagcagaacaaattttgtgggatcgacgtcgtcgatctgcatcttgaccaccttgccatggggggcaggcttcggcatgtgctttgcacggtcgtgcggttcggcctcaacattgtgcactgccctgttaattgcggccaaatcgccctttgatgtagccgaaggttgaagccccttgatcatgatcacgcctgccggaccaggcatcttgagtttgaggtagttgtggtgggagatggcttcgaacttgtttaaggttgcgcggccaaagatggcgttgtagttgtatgggatgtcgacgatgtcaaagagtatttgctcttcgcgcctattctcatctgtgccgaaagccaccgccagctgtacttggcccaggacttgaactgcttcgccgccgaaaccacgaagggaggttggtgcttgagtgagggctagggttggcaaccccattttggcataagcttcggcgaagatgacattggccgaactgcctccgtcgaccaggatttgccgaacttcaaagccagctacctcggccgagatcaccaagggttcttgatgcgggaatagcactccttcggcatcttccggtccgaaagaaatttgctgattcaagtaccgtggagccccatcgctcgccgaagcgatgttgtgcaccgttcgcagctgcatcttcttttgtcattttgacggttgagctggcggatcggctcttgtaatcacttggattactctgtgcatgtcttggcgctgttcggccgggggtgcttgttcttgaacagcctcgcgaggtgcttcgacaggtgctccttgttgtgacattggatcttgagcattgccgcgttgccaaatgtttcggcattgttcggtggtgtgcgaagagcatccatgataggcgcagtagaggtcttttctaaccttcttgcgaacaggctggtgatggctgcttgcttgttgggcgtcgaactccttgcggagggcttgtacttcttcaacggccatcactgccttgcccgcactggggtgggattggacgactcttgattcccctgctcagcggtagccccttttcgcccccctgccttgttcggcaccagctgtggatacggcgtggtgaagggcaaagtcatggcttgcgcatgaggttgggtcacagcattcggttgcccggctccgaacggcgatgcttggggggccgccatggattggtcgaatgtaggctgggtccatgccatggtgacctggttcggcgcttgattcgttccgaagcctggtgtcgttgcctgtggtcgaatggttggtgattgagtggcagtatttgggtcgaactgcagtccttgagtccacgacaaagcccctggattgggctggttcgacggtagccaactaggtgcaccttgactcatattcccttctggctgggccgaaagagttgcacttgaggtattgtggggttggttgagttgctggaggaaagcttgaaactgcgcttgcaaggctgaggtcccttccgtccttgcttgtggcgcctgaacaggtaccgatgggtgtgcttgggcagcgaccggccgaacttgtgcttgtacgtgaggggtccggtgcgtggttgcggccgaaggctgcccggtgaaccatgttggtacttgcatgacttgctgcgatgagg

SEQ ID NO: 74723 - DNA, 798 bp, Oryza sativa
aatatatcacagtagaaattgataacctaacttgcattttggaggctggagaccatcctacaaacaccaccttttgttactatttattggttactgatgtatgttattgctattctttcttatacacttcatagcattttaacattttcagatgcctattttcagcatgctggtataattgacattcatgttaagttattttcttatttttggtattcaagttaaaaaagaggttgacttttgatggttgcaagcaagcactgcttataatgtgatatattttaggtcggaacataagttaatacttttaatgtaatcaaggtgttgagttttccttcaacagtcgagcacatgcttgtaaatttaattttggactatgcttttttgttttaaattttattgtcatgcatgcggcctatggttcctgtcaggtgctcaatttaaagctcttgtggaatatgcaccatcgcaacaggtccccaagtcaaacacgaagaaagatgctcgtcaaggaactataatgaaaggtcctagacaatcatttaatctcattctccatcctgtaggtgacacaatttcatatttatcattacttcaaacttagctggcatcttttttgggatttaatatccagatccggaatacttggagtttcttgaatcgatttcaaagcctgctgagcatctgccaagtgctgaaattcagctcgaaaggaaagaagctgaaagggcaggtaaagtattgtttgtaatatcagattataattatgcctttcaaagatgccaaggggctgcagga

SEQ ID NO: 74724 - DNA, 1364 bp, Oryza sativa
cttttgtttataaccagactgagccacaaactaagccttagccactagacatgtggaagtacggtagtgctttgcaacagaggcccgaagactggtccttttatggccgaggtgctactatcaaaaccatgcaccccgagcccagcctaaaaccattttgagggttttgaatagagggggaggtgtgaatccaattcccaataatccatccattccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggccactcggcgcggccggcgggaggcggtgcccgcgcccctattgtcaccgacggcggccataggcacggcggagcggcggccgagagaggggaagggaagggggaaaagaggcggcggtccacggctcaccctaggtcgacggcgacgacgaaaaaggcggccggagcggaggaaggcggcggcgcggctcgggtcgacggggtcgacgacgttccggcggtcggcgaactcggcaagggggtggacggggtcgacggcggtgcggcgaagccggaggaggcgacgccggggcgggagacggtcccggcgagcggagaaggccggcc

SEQ ID NO: 74725 - DNA, 9306 bp, Oryza sativa
aaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaagcgtaaataattaatttattacatgggcggcgaaggcccagcacacacaaagacaaacgggaaacagcggaagactagggcgactaccacaggtgcttgacggcaggcacgagctagacaccaaaaccttcatcttctaggaactcctcttctgggtttgggaaaaattgagcaagactgagtacaaccaccgtactcagcaagacatacccacaagtgcagaataaatgcaagggagtacaagggagccataatatagggggttagggattgcagtaaacagcattaaaagtcacttagttgctccaacctactttgtaaacacagtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacaataacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccaacctagccatagacgagagtaccgacccaacccctcctacggccggaacctccgggacaggtaggcaggactgagcccctagcagcaggacactggccctgtgccatgacatcttgactaccgggccgcagctcgtgtagccttcatttgccctagagatgtccatcgacccccgacttcgtccatctccatccgtgtacttttgtttataaccagactgagccacaaactaagccttacccactagatatgtggaagtacggtagtgctttgcaacagaggcccgaagaccggtccttatatggccgaggtgctactatcaaaaccatgcaccccgagtccagcctaaaaccattttgagggttttgaatagagggggaggtgtgaatccaattccgaataatccatccattccatagtgtccaggtgatgagaatattcccgaaatctagagttgtaaaaccacctaatgttacctaattaaccagcgaagcatctacctaaattcatactagtggtaccatgagtagagtgtcaactagctggggttttctttaatctagggtgaacaaggtaataatatcaataacaatagtaataaggtcataacaaaggtaaataggcatggctaaataaaacagtgataacgcgggaatttaaataaagcgataatgcaataatttaaatcaaaataattttataaactgggatttaatatgttcaaggatcatgtgacttgccttactcactttcccaaacatcggcttcaacctccacgaagagcggatcttccgaagctgcagcgtctacacgaccaacggaaaagaaaaggcttttactctaataaactccatataacaagcaggaacaaagcacaaaaatggattcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggaagggggcgcggaccgggtccatgggagtggggcccacgaggcagcctcacggtccacggtggatcgggtgcacccgggctcacaccggccggcgccgtgggtcccacgcgtcacccgcacccgtgggcgcgggcggctgacgaccgggccccacgcggcagccactcggcccgcccgaaggcggccacttggcgcggccggcgggaggcggcgcccgcgcccctatggacgccggcggcggccataatcacggtggagcggcggccgagagaggggaagggaagggggaaaagaggcagcggtccacggctcaccctaggtcgacggcgacgacgaaaaaggcggccggagcggaggaaggcggcggcgcggctcgggtcgacggggtcgacggcgttccggcggtcggcgaactcggcgagggggtggacggggtcgacggcggcgacggaggaaggagagagcgacggcgcgagctcgattccggcgaggaggaagggcggcgagtggcggaaacggacagaggaggtgcggggagggtttaaatagggttggaagggggagagagcggccggaggggaagcaaaccggcgcgggaggtcggccgccatcaatggcgctgccgagatttgcgggggcaaatccgcccgtttgaacacaagagagagagggaaaaatggggggaaagggagaggggatcacggggagtgatttcccccactttattgcacgcggggacggcgggatgcggcggatttggcggcggcggcggcgcttggcgcaggcggagcggcgggaggatggggatgacgggtgggccccacccgtcagcgagggtggcgggcgggcccgcccgtcagcggcgcgcgcgcggggagaggctgagtgggccgcggggagaggagagagagagagggggggaggagagatgggccggcccggcccaagggagggaagggggacttttaaggtttttctttttataaaactttttcaactttgtttatttcttagtaattattatttgtgctctgaaaattccactaaaatttatttacaccttttaggcttttaggaaaaatacaaaaatcccctaagccttatttgacttttaactttgcacattttaattgttggaggctttcacacggattttaattattctaggcataatttaaaggatatattttagagtcgttttgggacatgacaccttgcttgttagattggtctacgtttcgtatatttcatctgtgctaatattgtagtataaagtggtatcggagtaatagtcgatacacgttaggtttgctcaatcggctatgctgtgagcatacataatccctactttgaagcacatttagatattaagtgatttatactgtctcggcatatcgcccgatctatcccaatcacttgatccaaatgtgctttcattggatagattgcgtactgctgacgtctacagccgattgggtagatctaataatttctatgccttatattcccttgctgatctgatgcaagtaacatcggcttggctccgaacaatacgttatcggcaatccagccgatcggctatcgttgatggatttaactttgttcctttttctttcttgctggttgcaggatcaaaccaactagcgcgctcggaacccgaaagcaattttggacctgcgctagagttaagcagatctctcaggccagtacgtgtgttttccgcatcaacacactttttggcatgcccggtgggaccgactttcgtaaaattttcttcatggcaagcctcaagtagagagaagttgatccagaaaatgtcatcccaataacaatggacaagctgaccctggagcagaaggcagaatttgaaaagatgagagatgacttgcaaaacgattcctgcattcattcgcacagactcgttccgacaccatggtccagaaatataaggtagttctgtcgaacaacgatgacgcggaaacaagttctggcaaagacgacaaagccaagggcaacaatcaggaggaagatctcgaggcgctcagatgtatgcaagaccaggttgattatgccgttcatcatgctttggtcaaccaatcaggagtacttgtcaacatgttgaccaacatgatcaaatatgtggttgacggcacgatagctgagcatcaagccaaaggtccagtttttctgcctggagggtttttccaaactacaaaactgtcagcatggacaggcatcaacccatctcgagtgccgccccagaacagccgatggcttcagttgtgccccctgggggcaaggtccatcaacatcggcacaagggcagccaggattcaatccttacgttctgatcaggccacaaccgcaacatgcagggcataacatccctcggatctctccagaacaagtcgcatctatgttcagaccaagacagccgatagttgagacgattccgcaaataaccatgggacaactttcgcctatcccacaacaacagccaactatcggcacctagtttaaccctgatcaacacatcgtacaccaaactcctcaacctcacctaaggggcaaccttaattttcagtaccagccccactcacctcagatacagtatcggctaggaggagcgcctcagccccagtacctgcctcaatacaaccaactggatcaggtgccgcagtagatccagggagcacctcagcagaagccttgggcagatatgatagccaatgtgatgagggaacaattcgggcacaagcctaaggatagtgagaacttgtatcggcatccatacccagaatattttgagagagtaccattatcgaacaggtataaggtcccagatttctcgaagttctcaggacaggacaatgtgacaacatatgaacatgtcagctgattcttagtccagtgcagggagtcatcagctaccgatgctttaagggtcagattgtttcctctgtctctgtcaagattggccttcacgtggttttcatcattgccatataattttgtacaaagttgggccgatctggagaaacagttccataagtacttttatagcagttccataagtacttttatagcgggattcattagatgaagttgtccgatttaacgtcaatcaaacagaagcatgacaaatcggttcaagattatatccagagattcagagatatgaggaacaggtgctttagtttggctttaacagattcccagcttgccgatctcgctttccaaggcctactggtgccaatcaaggagaagttctcagcccaggaattcgagagtctagctcacctagctcagaaggtgacggcacacgagcaaaggtttcttgaggctagaaaggcatataaaaaggtgaacaatgttagcacatatgtctctgaaaccgaagaggatgaggaccctgaggtagcaatagctgaatgggcaaggaacaaatgagtggtcacgtgccaatgggtcaaggactctggaaaggaggaaaaaattgatttcgacatcaccaaagacgataggatcttcgatttattgcttcgggagaaacaaatccaccttcctgctggtcatgtaattccatctgctacagagctagggaagagaaaatactgcaagtggcataacacaaggtctcacaacaccaatgagtgcacagtcttcaggcagcagatccaatccgccattgagcagggaagaatcaagttcgacgacccaaagaaatccatggagatcgacggcaatccttttcctgtcacaatggtccacacaagcgaggggatagccaatagaagaagctatcggcccaatgccgctatgatcatcagcaaatatcaagggaagcttgagaggcagaaagaggagtgttacaaagacaacaacaatttcgatcctcattgggactacaaattctttagattctactaaaacgaagggatgaggttaccctcgaaggaaggttgcccgtgatgcagtgatgccgacgaaaaccacgtcggtagttcaagccaatttcgtcccggaaaggaaaatcggtcggtgcagaagaagctgcctgttgatcagagattgggacttgctagccgattggtttctattggattatattgctatactatattatcatcagctgattgccttcatatcattatatacattggacatatagccgattgctcaaaaccctatcgccatcggctggtatcggcatcggctggaattactccatgggcttgtcaactgatcggctcattgatctgctatttgcatatcttgtcagttgcaggatcaaactgactggcacgcccacatctcaccaaactttggacctgcactggagctaagcagatctcccaggccagtgtgtgtttttcgcgtcaacaggttgttaacgattatagagtgttttattgagtagttcagctactagcttggtggtatcagtgattagtagcttttttttgagagttttattaagtttgtttctaaaccatgtagatgaaataacagaattggaacttgtttggtcaagtatatcagttattaattctatgacaccagaaaattacattgtttcatcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcctgtgcatgtcaaaggttctgaatagatacacttcaccatttccttttattgcaggataacatttttagctattgttttcggttaattttcaacatatatagattcatctaggttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaattctgtattgttgaagatca

SEQ ID NO: 74726 - DNA, 19831 bp, Oryza sativa
aggactaaagatctcggggggcctgacaaggcctgacagatttagaaccgggactaaagatcatttttagtcccggttggtaacaccaaccgggactaaagatcaaatatgcccgctgtagccaccaaccgggacttaagatcatttttagtcccggtttttagtggaactaagattattgtggatttcgggcgaccgaccaaagacggtttctccaccagtgatgataactataacacaattcgtcttgttgtttataatgcacattcttccatctagcaacaactgtggtttagctgtcctccatctaattgacccccttgtgattttaaaagaaaaaattgataccaaatgtttgcccccgaagcttctatgcccatttgcgggagatttacttcgatccagcaaaaaatatatcgaggtacgatcctcatggtattaaatcgtttccgatccttaaatccagctgggcagaatggcattgttagatccaacaattggaaacaatttggtatcgcgagatatttgtacctcgagatactttttgttggaccggagcaaatctccatttgcttatatgccaaaccatggagatacagacaattcatcactgatctgccagggttgaaaacaaggaattccagttcgatctacggtgtttgtatccctccacatccattcatatacaatagccagtgtcttcgtcgtatacgtggatattgtctgccgtttacgtccgttgccttcttattcaattccatccattttattttctctgaccaattggctcaattggctagccaattggaacatggccttaggtgctatgttaagattgacgagaggacccaaagagttcacgagggtcagtctttcggccagggacaaaacttcttcgttttttatctctgcaataattgttatttaatgttaacttgtttcaattgcaaagagagagggtgacattttcttttaagaggcaaaagctttgtcattttatattgatagataagagtaaagtcataacaagctaagtactacctccttgtacaaatgtttgacgttggctagtacaattttgagctaacaaattaaacgtcaaacgaaaaagaatggatggagtaatatttatagggcgaaatcgaggtaggacactactctccacagggaatggtctctgtaagcctaacagctctcgtcatgatccaggttctcgcctcctccttgattttggccacgatcatggctggcgttgtggctaggcgccgaaaaattctggcattacgctcgcaccagagctcccaagtcacgaggatgatcaccaactttaacgctttccgcatgacgtatggcgtgtttgaaactttgtaccaccaatcttcttcattggcgtaggctttccatttgtttatgcggagatcgatttttgtccaactctgtagtgtgctccagattctctttgaaatcctacggttggcgagaagataaagagccgattctagcgaggcacagcagagtgggaaaaagtggtggttcgtccatcccctcttctacagcctgtctaccgtcgaaactctatttttgattacgagccatgagaagactttgcactttggcggctcccaacatttccttattgattggttgaagattgttcatgctgcccccatgaattgcattctataagccaaattacttgagtagactccattagccataaacttccaagtgatggtatcccgttgcgcgttgagaggagccatgcactggatcattgtccacagttagacaaattggcatagatggactgttgtgcactgatatattcttgcgcttggaggctgcgaagatggccggcgccaatttgtttcgggtcttatcttccaaccaatgtgagtgccgaaatctcgccatattaccgtcccccaaagtgatggtcgttgctgctgcaaagagatctctatcctcttggtcacaggggaccgtggtgccactccatggttgtctggatcggtccactcgtaccacagccatataattctcagagccctagcgaaacgatcgagatcaaacacccctagtccacccaaatctttgggtctacagaccttgtcccagctaactctgcatttttttccccctgaaatttcctcacctcctacccaaaggaatttgcgtctcgtctttcgagggagtgcaggaccccgtccgagttctttattgccgtgaaggagcaaatctacggtccttgaggaggtactatgaggtaccaaaaattcagtataaaatttggtacctcatgataccttatagtacctaggtaccaagaggtaccaaatttacaatagaaaaagtggtacctcctcaagaggtagatggattgcaccgtaaggactaacttggtcagggtcgttctgcctgccgccgacatcagtttgccttgccaaggagctagccgcgtgcgacatttaccaaggagtggttgaacatggaccattttaagcttggagatcgatcgcaagcagtaggctatgttacttcattgggaagctagtgatgtttgcatggaaggcctgtaggatgccctggaggtctctcccattgcaacggatgggcacaatttgtctttttggcacgttggttcggagccctggcacctctccgaaagaatatagtatgcgaaccaggtatcccatgtcgcacatcgtcgggcatgagacatatcctcgtacaaatctgaatagatagtttgtccaaatttatagtataatatattccatactccaattcatcttaaatcctttatatattaggggaggagggagcatgtgtctttatcaatagtttgtatatgatggacctaatttctcttccttgataatatatatactacctatttctgaaaaatccgcgagaaggcgtagggtaaccttttagtaataatatttctcactccgtttctaaatatttgacaccgactttttagcatatatttgaccgttcgtcttattcaaaaacttttgtgaaatatgtaaaactatatgtacacatataagtatatttaacaatgaatcaaatgataggaaaagaattaataattaattaaattttttgaatacgatgaacggttaaacatatttaaaaaagttaacggcgtcaaatatttagaaacggagggagtactttgtgctgaaaaaacatgatttctttcgtctctatccaaaagagtcgtctctctatctcctcttcctaacagagaaatagtgatgatttgtagcctgtacaaacaagactagctaggaatcttttgggagcgctctaaactaagacgtgcctaatgacatgtctttatttatgctgcttaattaattaaggctgctgatagcctggtagaggaaactgaaccaaaacaattagcaattcggcacctatgggccaatcattatgtaatttctcggtatcacgagcctctagatccatgcgacaagttcctaagctagtctatataaagggatgagtcatatacgagctatgagcatcacattcatcctacacacctactgcagaaagctagtgagaacttggtaatctcccttgttcctgctatatacataatggcgccgacgcaggtgatactctcttatcctatcataatatatgggtgatcgagtgattttgttactctctctgttctatacattctggtctaacgttttggtttcaccttccctcctctatattcactgacatatactccctccatcccaaaatatttgacgccgttgactcttttaaacatgtatcaaatgatagaaaaagaattaataattacataaatttatatcatttgaagttacgtatattagtgatgagcatatgtgtgtgatatactaatgtaactatcaactatgcacccatctaaagatgttatgattaatcatcattataaatttaagcttattattactgccagaatctatagacacatttaaaagaaagagagttgtgcaaatgcgcaacttaatatactagtttgtctgatcaagggcggacgtcggattggctcaactccttctggaccagccgaccaacctatggttgtgtggttgtgtttagtcccttcaaacttccaaaaattccatcacatcaaatgtttggacacatgcatggagcattaaatgtagatgaaaaaaatcaattgtacagtttgcatgtaaattgtgagacggatcttttgagcctaattacgccatgatttgacaatgtggtgatagagtaaacatttgctaatgatggattaattaggcttaataaatccgtctcgtagtttacaggtggaatctataatttgttttgttattagtctacgtttaatactttaaatgtgtgttcatatacttaaaaataatttggaggaggaactaaactgtaacgctccgcttttcgtgagtcgttaaaaactaactcggcaaaatcctaattgcgaaaattttcgttcttttgtgagagtctaagttgtgccaaggatttcaatttaatcccgttgttccccctcatcgcaatcaaaatcctccacctcgaaaattcctcttctgattcgagtctctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgacttctccttgaattccccttgatacatccctaaaccctcgagttcgaatatcaaatttgaactcgaatccaaaccctaaatctctccaatcctatccaaatcagttctctcagaaaaagtctaaatagcgtccctcttggctgtgggccgtttctcccttgctcggcccattctcccctctcggctgctcctcctcctccccgcacgtgcgctgcatgcgccgagagagaggcatcgcctctcttctttctctctcgttttctcgctccctctctgttctctctcgcgccgacaccgcttcccgccgtcgccgcccaaaacctccaccgccttcgcccattcccacgcgcgcctagcgaggtggccgaccggccggtcgccgccaacgccagcgctgccgccatcgccgatttttcccgctgccgccattcgattttcggccgtgccgctcgttcccgcgcacgcgcgctcgctcgaggccagccgctcggtcgccgccgcgtcagccctgacgccgcccgtgaccacgcgtcgcctagccccgcctgtgcgcatgcgtccaagggagggaggcagagccccagtctcgctccctctccctttcctttatcctgaaacagcaaggagcagagctccctttcttctccacctttttccttttgcccgaccaccatcggcgtcaccgcctgccaccaccttgaccacgccagctcgtcgtccttgcacccttgaccgcctatgtcggttccccctcccaaaccgcctcttctccatctataaagcccaggccgagcctccctatctcattctctctcggcatctctcttccaccgccaccgcgcctttgttgccgccttgcagctgccgaccctcccttcgccgtcgcgcgtgctggtgaagccggcgtgtgcgcgaggagccgaagaggactccggccacccttcttcttccccttccctggcccaaggccggagaactcgccccgcgccgtcgaccgcccatcactgcccgcccggttcggtagtgcctcctcccgtttcccttcctcgctctccctcgccccctctagtctgcgtgatagctcggtggcactcccgaacacgcgtagacgccgcccctagacccgccgccgcccggcctggcctcgccgccgttgccgcccgctcccggaagccgccgctcgtcgccagccctccttggtgctcttccgccccatccgacgccggaagtggactccttgaaccccggagatgcttccaccgcctcgaattgaatcctcgtcgcccctccaccgggtttgccctttttctcaccgccggcgagggccgccgcgattcgtcgtcgccggtctccccgccgcgaatccgagccggtggcacactttatctcctccgtctcattattgcggtgtgctccctccctctcgaatcatcgcgacaagcttctgagaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtaggcccgccgcctctcggtccatccggcgcaccgcccgtgcgccatcttcaccaaaccctagcgccgcccccgcgtgaacccattcctccatgaacccagccgccgacaggtgggcccgtcccgggaccccgcatggtggacagcggtccacccggttggtctcctccccctcccacgccccattgggccgccctcctcgcggccgtgccggcccattaggctcgcccgagctgcgcaagtccctcgggccgcgccaatgccacccgagacaagtctgattcacatccctcgtccatttcctttttccaaaggatttaataaatccttttcctttagacagaaaatccaaataatcttaggaaatccatatctcctcaaccgctcgtccgattgaccccgttccacttccagtaattccgtaaaattgagatctatataatggcactactaattagtctaaataggatccttcttttggtcttttgtttaggtttttgattgtttgcgtatagttgcggttaccggattttcgtcgatcgcgggttttcttgaaggttcgtgaagcttcgtgaagaccttgagcaaggcaagtcaccctttgatcaattgcccctataattgaaaagtcattattattttgtttgaaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccctcaaaacccgacatgtggtgtcggtgtgttggaaaataaaatgaattgtgaaaactcgcgatgcgggggttgcgcctatgtggcactgtcccgtattcgcatgtaaggaccgattcctgtgggaaactcatcgaacataatcaaagtgcaaccacaaggtggaatgggacaccctgtctaagtaactagtcggttcagggaaaccacgcatgccaatattgggaacgccggggcggggtcggttggagccaaaccgggttcctggtaatgcaagaacgagaagcttgctgaattaccgatcgaggtggttggagtttgatttgtgaacgcctaaaatggcctatgtttctgtgaggatttgatccttctatgtggcatgaggtatccctgggtcggcttgggaaaggttttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttttggtgtgggaatcgtaaccagaatcagcctatgtggcagatggatgacctgagtggtcagaaacgaatctgtgtgattcgggatgtctgtgggcatcatagactaggcttcccgagtggaagcggattgctttgctgctgggcagcaggactctaggagtccgagaaaatgaaaaaggctctgggagccgattaatcaagtggaatggctctgggagccgagaagtaatgatctgacccaggaggtcggtacatttccaattgagctgttgaaaagcatctcttaagtcgatttgagacgcaagtctcttttcgacccaaacttaaaagaaataaatcacttagtgatttcaaaatgtcttcaaacaaaagatttgcaaaacaaccttgcctctcttccaagcttggattaaacacctaagttcccgtgacttgctgagtacgaaagtactcacccttgctctatataaatatatatatatatagttcctccgccctgaagagaagataaagtgaagtgaagattagggtttcgtcctatttcccagccgtcgcctgtggtgttgggtgttagaccgttggtttcgctactgctgttgttgttgatgttcgcctcgtccgtgtcgtcggttgtattctcgggctgtctgagctgcaacctaagttaaggtaaataagtcccctatttattttaaggattgctatgattcatatttgtctccgtgggtaccagcactatgtcctaggactggtaccgagatcgcggtttcgtaggaagcggttcgcgccgttttccctacgacacactcctgtcaggtgccgttgtacagcggtatcagattggggtgtgacataaacacggcctatatatactgcagtactacccctactatactagggtagattagctactatggataaacatttttttttgcggggatactatagttaaacttgagatgatgggctttcacattcaggccttaggacatggcccaaagtgaccagtgagacctatcccaccttcagattctgtgtaaattaatatatgtctatgaaattattggttactgcctactataaagacacttaaatttggagcaaatttatagtccttgatgaggtatatcactttttctaatataaatttgatacttcttaatacctgctccctccgtcccaaaaaaaatccaatcctaagtttgaatctggacagtgtcttcatttgtaggattatattgggtttttttagacggagggagtaggtattaggaggtacaaaattttacactaaatttttggtatctcatgttatctcctcaatgactgtaaaattgctctaaatttatattctttttgaaaaaaaaatgaagacactacatatgagaaatttaatttcttttccgtgaaacaacttaaatgcatttggatttattaacggtcaaattgatgcatgcatatgtttcccgcttaaaaaatatgcttgtttactgtctcttctttctgaaatgccatacattgcttacatatatacatattataattaggaaaagaaggaagtatgtttcgttttacatatgaatacgtattcaaatgaacattattaactgtttaataatataatagatgttcaagaaaggcttaaataaatcagcaccctaccgttgtgatgtatatataggctgctgggaaggtgacgctgcgcagcgaaccaaaggagaaggcgatcccgagtaacgaagagcgcaaggaatggcctgtcctggtgcacgtggtggcgccggcgaaaacggagcgtttccccatcgacctggtggcggtgctggacgtgagcggcagcatgacgaaggcgacgtcgatgcacgggtggacgaggctggacctggttaagggcgccatgaagatggtcaccaacaagctcggcgccggtgaccgcctcgccatcgtgccgttcaacggcaaggtcgtcgccgccggcgcgacgcggctgatggagatgaccacgaaaggccgcgcggatgccaatgcgaaggtgaaccagctcaaggccggtggcgacaccaagttcctgccagccctgaagcatgcctcgggcctcctggacagccgtcccgccggcgacaagcagtaccggccaggcttcatcttcctgctctccgacggccaggacaacggcgtccttgacgacaagctgggcggcgtccggtacccagcacacactttcggcatgtgccagagccggtgcaaccccaagtcgatggtgcacattgccaccgccaccaaaagggagctaccaccccatcgacgacaaactctccaacgtcgcgcaagcgcttgccgtcttcctcagcggaatcacgtccgccgtcgccgtcaacgcgcgcgtccaactgcacgtcgccgacaactccggcgtgctcatcaacaagatcgactccggagcctacgacaagacgatcgagagcgggaacgggaaggcgtcgtccaagggcaccatcaacgtcggcgtcttgtccgctgaggaggacaagaagttcatcgtctacctcgatgtgccaaagctggagaacgctcaggcgaagccgccgcagctgctgctaacggtggccggtgagtatagcacaccggctggcggacggaaggtggagaatatggaggagtccagcgtacaagtcgagaggcctgcgcctgcgggcggcgcaacgaaaaccggcgatcatctcgtgacgtggtcggaggcggtcatggtggagatggtgagggtcaaggtggtcagcatcgtgaaggaggtgttgaagaagcacgagcacgacgaggagccggaccagaagcagatggccaaggatctcatggaggaatgggacaagttcatcaaggagaccccagccgggaaggacgcagcggagcgcctcaaggagaagcttcccaagcatcacgtcgaggatatgcgcaggagcctgaccaaggaggagcacgacggcgtgctgtacctctactcgtggctggcgagccaccagacgcagcaggccaccaccatggcgtcgtcgccgccggccggcgtcagcggatggttccaccagcagtacatgaagcaggtggccgtcgacgcggagttcgacgcgtgcggcatccagcccggggtagagacgaccgagatcgacgcgacggcggactgcggctgcgtcgtgggccttcaggacaggatcgaccgccggctggagctctggtccaacctcaagcgcgaggcgccgctcatgttccagccgtccgaggacgccgagtcgcaccacctcaccgccgttttccgcgaggcgtcgctcgatgccatcaaccgtgccatgcaccacgacatgtacctggtacgtacgattacacgtacccaccttactagctactcctccgtctcaaaatatatgaacatatgaccgaacaaggacatttcctagaatctatactcctccgtctcaaaatatataaacctatgactgaacaagacatttcctagaatatgtactccatcatctcaaaatataagaacctataaccgaatatggcattccctataatctagacagatagatggcctatctaaatttgtagtatttggaaatgtttcatctagttatatatatgtttctatagaaaaaatgcccgtgcgttgcaacgggtaaaattatttttgatcgtatacatttactctttttgggccaaaagattatttcttcgttccatttatgttccagcccagcccgctacctctctctacttggcctgagtctctttgacctagctttgacctagcccagaagtgaagctataggccatcctccccatcaaatcgtatcgaacctttctcgatctcccattaaatcgtatcgaatctttatcgatctcccctaattggttaagggtttctgatgcacttgatctactcttttgtttttatcaaaatctaagcgaatctataaaactcaagatataaacgctgacttttaaatagagattagatccgataaactaaagcggaattgaaaggaaaaattatggggaaaataataagggagtagtggggaatcgatttttacgaccaattgaaggaaggaatgcggagaaaaaggaaaaaaaaaagagaacaggaaaaggaggaaaaaacggcgggtgaaaaaaaggaaaaaagaagcgaaggcaaaaaaaaatggaggaacggtaaaaacggaaaaaaaaaggcgaaaataacaaaaaaaaaagtgacggacgaaaaaaaatacaaaaaccttacgtatttttataataggtatagatatagatatagattttccttattttacggaagacggaaactcttttgtcgcaccttttttgggatcgggcagaacaaaatttttgcccttttctcgcgcttgattttttttcatacagtaatttttctttcctttttttcaacggaatttccaagtgagtcggaagttttgtttttaatgggaatcggaccttttttttcgtttttttctcagcgttttatttttcacggacgacggaagcaggttttactttttaagtagtagtagatatcctgagacggaagtagtaagtagcgagttactctcctcatcccaaaataaataacaccgtggaatatttgaactcattttattatatacgtgcaggccgtcgtgcatgcgagcaacctgaggcgatgctactccggcgccgggaagcagcagctgcatggatacggctcgtcggagctgcctgcacatgatgatgaagcgctgccggcgacgcgtgctgttgaaaaacacagcgagtgaatgatcgagccaccgtgcaagctatggcgtaacggtggacgatcgattgaataagccggcgacggcgaggtttatcaattcctccactttgatttcagtattgttatggggagaaaagagtcaagaaaaataataagatagacgaccacctcgtcccccatgggacgagtgccagtctgcttgtgcgcttttccttacgcaagtgtgctcgtgtctttgtgatcaatcaatcaagtcaaatttatttcgtcaatcgcgcatgtattcgtcattctggctaattgcattgtgtgtaacataactcttttcttctaatacagtgacgtgcaatccttttgcgcgttcgcgaaaaaaaaaacgcatgtattcgtcgtcagtttgctcaagtttaatgaacgaatgtttaataattcgaatctttatccgtactgctcaccgtattataatgttatcaatatttgatatttgtattactccctacatccaattttaagcgtagccatgagttttcttatccaactttgatcgttcatcttttttaatctttttatgattagtatttttattgttactagaaaaaatgcccatacgttgcaccggataacaactttttttaaactgagcaatgaattgaaacattatggtcgctatgtattatgattaaaaaagttaataaaaattattctttggttttaggcctaaagcccattctttctttcttggttttcctatgctcgcacggccctccgtcgtcttcaacctctacctagtcccgtgcctgtataccagagctgatcctccccacaagatcccttctttccatttttttctctgatcgaattcgcaaaatttatcaattgaaggagaaaatacatggggagaccgatcgaagtgcaggcagcactagggtttggtccggcgatgatgagataaaaaccggatggaaaaaccgggtttggtccggcgacgatgagataaaaaaccagcgaaaaacaaaccaaataaaaaaaggggggaaaaaccagcgaaaaaacaaaccaaataaaaaaaggggggaaaaaggaaatcggataaaaaaagtagcgaaaaacagaaaataaaaatgaatcataaaataaaaagagagacggagcaaaagattaaccggaagccttgcgtattttttaattaggtatagaattgttttgatgattgggctaccactttagcatacctggagcaagttgaaccgccacatcaaaaaaaatattgttttcaaacactgaaggagtccatttgaattgattgttgaaattgggggagatgttatattcggttgtgcggttaagggatgcgatttgatcaagggcaagagaggagggataataaatatacttacgattttgctatatctcactcgaaagattttttcttatctctcactcgattttctcacttaaatttatagtgcattttcttgtaatctacagtgtaatttatgaaacttacactataacttttgtaagttacactgtaattttttaatcttcacatgtaaattttaaattttgtattggatttggtctttttcttgaggatatggtaatttagtgtccattatggtgtttcttaattgcttttttccttttattatatctatcggattttaatccaaagattaaaaatctgtgtgatacgatcataaaaatctttcgaaagatatataggtactcccatatacttatgaagatttgggacatttctggtccatctttcttttttttttcacatgccagcccacttctcctctcctgggccactcttctttctcctcctcggcccaacatatgtctggcccatcaagctagctcaggttgcctttctccctttctctaactggcgcgtcgggcccgctggcagcgtcatcgtcttcctctagatgggatagaaatcccgttgccgcacagggtcgaagtcgatgcccttctcaaatataatttctccactgcttctccttccaaattggatgcgaaaatggaatcccctcaatctcctctccgttttcgctcaaccaattttggttaagcccaacgaaatcccgcggattttgagtcgtttctatccttcgcacggacaatatcaatataaatccctttttatccttcgcgcagagaacgtcgatatgaatcggattagtgaatccgacgacggacgaaaaacccataccggaagccttacatattttttaagtaggtatagattagataataaaacatgaataatactttctgcgtgacttatatttttaatttttttttaaaaaaaattatcgaataagatggacgattaatggttgctctgaaaataggatggagggagtatttgtttagtacatttttattaaactttactgaaggttataggtaaatttatttcaaaaatttgtgagtataaaataattttatttgattcatattttctaaaagaatattgttgattaaaaatacatataaaatatatcttaatatttaatatattaatttattttatatgtatttttaaccaacaatattcttttaggaagtagtatgaatcaaataaaattaatatattttttgcaaggataaaataattttatttatatgaatgaaataaaattatttccagcctaccatctattgtttctagatacacacgttcttgtaattcgatacccttaaaatagtgtaaggtgaggtatctttatgcttgtggatttatatgtaacaataaccaataccaactatatgatcaactaaaaaatccaggcatgggtaatatttcacctcaaaactcgtgcagatcaatgttgactcaggcacatgtttatctgaaaccaatttacactatttttatgtcatgtaaagctgtctgcctctagattatatacttacatatttatatatttatatggagacatataatatgctagctaagtcaaagataatatatatagagaggttggagaaagctcgctgcttgtttaagagagaaattaacatgcgttggactggatatcaagcccaatcaaccagcgctccgaatcttcgatgctaggagggcgagccgccttcaacacttacgtgatcacttctccagcccaactaaattgggatgttaggagggatcagagagcttaatttgcagaggcagcaagcacatccatgggatgctggtgatcatgcatgcatgagtagatcatatggcatcatgcgttcggctacaaaattgtgtgatcatgcatacaggcatttacaagaccaaccagcacttctcagcccaactaaattttggcgcccacacacttgccatatgggcattgtcgtcgccgaagctggtgatgcgcaatgctagaccgagatcacgatcgagaatcaggagaccaagattaacgagtagggaagtttaacaagatctggtgatttgtctttaattagcaattttttttcgtccggtatatctcatgaatagaactaattatcaaacattttacctttgtcgttaatagtagtcacttttatctaatctatctatatattattaagaaccttgaaatgagacatcacatttatcgtatattagaaattcccatattaataggagaaaaaggaaacaaaaatttaccattaaatcatgttgggcatggattataattggattataatggcatagattaattggtatagttgtatgtaaagtataattcattactattataaaaattgaagatgtttttgccggtactttagtacgtcatccgtatataagtcagtttttaatttcgttcacttttggaaatacatattcatatttgagtcgatttttaaattcgttcacttttggaactacagagggagtcgtacaagaaatctctttaaaaaactagcatgctaacttgagacgattggattcctaattgcagcccatgattttctaaaacacatgtatatttaagcgaattcccgtagtgaatttaatcttaactaaaccatataacaataataagattaaaataactttcacccgttgcaacacatgagcattttttctagtatatctataaatatagaagttttagttgtgtatgaaatctaagagttgtatataaaatttggaccttacaaatatgaaaactaagagttatatatgaaatccaaatatacttctatatataaaggttcctatacaaataactataatttaaacatgaaatcggatgaaatacgtatgagtataattggtaaattaataacagtcgaacaaacatgagtacggacggatgaagattgcagataactcaggaacatcatccaaatcttatcaagtattaaatatatccaaatcttatccaatgttaaatatattttatagggttaaaatgggatgatccattagggatagaattaatgttaaatgattttgctgcagaagataccgattatgttgcagccgcatatctattcctggttagaggtataacaaaattgataggtaaaatcagataaggccatttaaatttgtttcaccccaataactcacttctaaccatacatctgctagcatgatatatggaaagttattttcaatggaaaattatgtctgtgaggttgttctcagattttgcagtgttgggtgaaaagatagaacatcgaaagaaagtaactaatacacacgatcgatccatctcaaaaagaaaacaagaaatttttttaaaaaagcatggaccattcatgtttctatactggtcagacatgcacaatacgtgtgttcctatgcccgtgtaattattttgcattcaaatatcagaaatagagtttgatcattttacagtcttttaactgaacgcccaatactgcaaggcttttaactgaacgctcaatgcaaactatttgattgagctccatttggcaaatgtccttacacggccaacaaggcaacaactgatatgcatacataggcccaacaattcatcttgtccctgattgagttattcatgcatgctaggtaagtcctatgttactttcagtaggaataagttcactttgactcccttaaaagtgacccgaatctaatccgtgaccctcaaccccaaaaccggataggataactccccgaactattaaaaccaatgcaatttgactccctcggcggttttggagagcggtttcgctgacatgtcgtctacgtggcagtgtgttgacgaaaaaatcgaacacaccggcctgggagatctgcttaactcctgtgcaggtccaaagattgatgagatgcgggagtgccagtcagtttgatcctgcaactgacaagatatacaaacagcaaatcaatgagccgatcggctgacaagccgatggagtagttccagccgatgccgataccagccgatagtgatagagtttggagctatcggctatatgtccaatgtagatgatgatataaaggcaatcggctgatgataattaatatgattaaacaatataatccagtagaaaccagtcggctaataatggtatgatagaaaaagcactgatccaaaggttaaagcatacatcggccgtaggtccgatgtcataaaatccacaagattagatcaacagtaaaacctttgttgcgatcggctaaatccaatatgtatgtatatgcaatccttacaagccgatgcaacgtccagataactcatcggctgaaaccccgatgaaacccttattggcagtcaaaaagcagactagagattatggttctaagtacgagttagtagatcaaactcaactaatgcagcactaagtatgaaaagaaacacaatatctagataatcaagccgttgactgagttttcagggtggtagatatctaagctaatctaatctagcaaggcgatttagccgataccggcagaaaccctaaaacaagaagcagccgatagagctaaattgatatgctaagactagattaacagagacatatgataaataggtaggcaagtatatcatccaaaccagagcaatccaagaagtcgaatgtcctgatgcagccttgaacgacgccgacgtagacgatataattgcctgggccgacggaacattggacttaccccttagccggagatcgaacaccgatgcagccccgcgtcaggtgccaagttccgccggaacgtagaaacaaaagtaaaagtaaaaagggtggtgatgcgccgaattgtattgatcgtagagatagattacatagaccccaagtgtacatatttatacccatgggttgatacaagtccttgtcggacaagaaagaaattttcctaaagataaaaggaaaagataaagtccttataggacactaaacacacttttctaaagataaaaggtaactaacaaactattcctaattaatagataaactgccatgccgcatcctctttaaactcggtcacttagggataagcttcctttagtagatttatttccttaaccgaatatagcaggaatccgactattggcgactagataactcccatcggctgattccgagatactgcagccgataatgattctaagccgatgacgtctttgccgattaccactgttaacacagtgttgacccggtctgctgttgacgtggcgcttaggtggcattagaattaaaaatatacatgtgggacccatttgtcattcacacaaaggaaaaatttgtggggcccactgacatgtgggtctatcccttcttcctcctcgctctctctccctcctatctctctttcccccccttccgcagttcggcgagcaggggccagtacagcggcggagtggtgtgctgcgggcgggagggcggcggagtggcgggtggcgggcggcgggcgggagggcagcggcgttggggagacgagtcggacctcgagggagccgtaggcacgcgcggcggcgacctaggacttgcccgttggcccgcttattgtggacttctgcccttggacgatggcgccgccccacgcttgcgggagctgcatccggacgacgacgggaaggagcagacgccagcaagccatgctctaggggctctaggaggcagccgcaagatggagctcggcgagggggctttagggcagcggcgccggcagtgatggggatggctctctgtctctctcgtcttctcc

SEQ ID NO: 74727 - DNA, 2696 bp, Oryza sativa
caagacaggacagaatgtctgcttggaggaagctgcaacaagctgcagttcaaaagaaaacacgtccatttttcagggcagtggataagcatggtcggatgtatgcaggtatgtattgtttctttttgaatgattctgatgatctgatcagcaggtaaattggcaggatcaataagtagtggcttgttttactaaaaacaacttgattaggattagcaacagacattgacttcttatgtcaatagatactaccatcaatggagctccttagaattaagattagtgttgcttctcgttttgcttctttttattaataatttctgatttaatgcccatctcttctgagttaaggtattttttgaactaccacaaggccttagaaaactatatacaaaaatataagttcaataagatccatgttttcctgcttgtctaagcattggtgtctccttttgtcttacaggtggtctagatcggcctattcagaggcccttcatattgcgggattggagatttggtcactataaaatggaaggcttgcaggatcctttgagttgctttataagatgcatttttgcaccattttcacgccaaaagaagattcactacatagaagatgatgttatttcttattctattaactgatgccctgctactatagttgctactttaagttcagtttcttatgttgcaaccaaaaacacatccatgttttggtgagtcaagagcaacaatgcattttgcttttcgattctttgtgcatgttacctatttagaacatctagtttggaatcttttgtaggttattacttttttcttgatgaagtaaataaaaagagtcttggaaatggaaagttcaacttcttcaggtaattactacatgggtttactatttgtataatagtacacatttagattccatacacttattttattctcatctcctttttttggtttaagatgtgtttgatctaatgtcatgtagattgtattctaaatatcttctaagccaaaatatcttttgtggatctacttttgctggctcatagctatgtcctgcacttcttaattgaagatgcttcctgggaagtgtttgggtgaacagatgggcacctgcctaccttatttagatctctgaccctccaggctacatccagatctgtgcgtgtagacacgttcaagtagtgagttaatggttcctattgtttcctcatatagatttttttacttttctattgtaaaaaaaaacacttttcacccactgtatataggaaatgaataaattcttttcatttatagtgtaagattcagtcttaattcatggagctgaggcataagtagtagaaggaaatgaataagatttgcaaattgcagcagaggaattcaagggttttgttatcccataacttgtgtacgtgagttttcatattaaacagtggtactacatttttgacatgcaaagcctagctgcctaagccatcagatgcatttggagggatcattgcagatgtatcctcctgcatgacctcatggaatcatgcacgtttcacatttccaaatttcacacagccagattttattggaaaaattactggtttgttaactggccttccaaacctttttttatgggcatggcatgcattttatttactaggatgtggcatgtattctttagtggaactagccactaacttctttattcatgctgcattacaatctaaaaagaactaaactttatatgcacacagccctatattcataatctggaatgtggtattttttatccacaaccccgtaatcactaaccacacctctcctgtacagtttttctaatatatataattaaccataggggcctccctactgttcttcattcaaagaaactggtgtcatgatgtcggtcttttgactagggatcttaactagggcgaatatcaaaagaccatacatctttagtacaattgtcatgcaaatttattctcatgtggtgtcatttattttcagtgaaacaaaaacagggggaaaagaaagtatctcacaggagaaacaagggagcatataatcatatgattttttatattatggcgcatattgcgttacatgagctatttagtacagaacaggaagttgtttagttgccttacagggctattgatgccattgcaatcatacgtaagcagtatatatttaggaaagacttttgtgttatcgccttttgaagtacataagcaaatagtagatcatcagtgttcattatttcagtattataggattgcagagctggtaatgatctgtggaccaagggatggcagaatgatcaattgttcttgataacttgatgagctctctccattagtaccactggttttggtatggcacaggtaatcttctcctccttctctggtatctggaaagctgatgcagggaaggttttcgtaatcccagcaatgctcttgcagatgagtttcccagtcttttgttcatcaagggcaatctcctctactggtacccacaccatgagctccctagtcttgatccctttgactttcttgatcctccccttctctgcaaaagcagtgatctcagtgccataagataccaaccttcctaagctttggaagacatggtctatcctcttcttttgcttgagccacacaaatccagtttcctcaacatagccacactccattatgtcc

SEQ ID NO: 74728 - DNA, 6327 bp, Oryza sativa
ccgctgaacttttatataggtcggaatcaatcaggaccgtctataagatgggacggctccaacttctcccgcattgggccgggcgccgttcccagccgcccacactattgggccgcgtgtaatctcacagaataagttcactttatgtccctaaagttatccctgaatctgttcctaggccgcacacaccattgggccacgtgtaatctcctcacagaataagttcactttatgtccctaaagttgtccctgaatttgttcccaggcctcctacactattggtcacctcatgggccgcgtgcacgctccgcatggaataagttcacttgaggtcccttaagttgaactttttttatttcattaggaatagattttcttaaagagctcatatcatctaaaactaaaccctaatcatttaatattttaatatttggtataatttatgtttacccgttgcaatgtacgggggtattttttttagtatacatatatgtgatcacggtctctgtttggatagacactaaaaaaaaattgtctagacgagcaaaactgatcacggattttctgcccgcctttacacaaacgactggaaatcgacatttccacaggtgccctgcgtgatcatttccttgttcactgacagccatggaaatcactactgataggcattaaagtgtatagtacctccttgtcaaaatgtatgaggccgttaattttatgcagaccattcaacaagtaataacaaaaataaatgatatttaggcacggggccgggaagcacaacgggggtggcaccactggacgtcggcgtccacggcgctccggcttacctcgggcgaaacagaggcgaggccggtggagagggggcggctgcgaggcttggcgcggctccagtcgacggggaggtgcggccggaactcgccggtgcggtggagagaggaggtggcgcgggaagacgtttgggagggctcggcttgctgggaggaggcaaaaggggaagaacgggaggggcggcgccattttataggccgagaggaggagggaacggccggagggagctcgccggccggccatccatggcggccaatcaaggaggattaaatccggcgaatttaatccgaattaagaggggaaatcaagggggaattgatgatgaggaggagaggaaccgattttcgcaatcactttggaggagaaaccactggggagggagatcaagaggcggccgcgcttctgttcagccgtgagaagaacaggcgacggctcggctggaggaggaagacgacccagcggctgggccagctgggccacgcggaggattagaaacagactttatccgcggagagtgaggaaggttgggccgagcaagggaggcgaggagatgggctaaggagaaggaaaaaggcccacgagggagggagagagagagagagaggaggaaggggaggaggggggcgctgatacgcgatcagccgcgcgcgcgcggtcagtcgctccccctctagtctcttctctgtatctactatacttatgtatatactacatatacacacatatatacatatgtatatatgtgtgtatatatatatatttataaatatatttttaatatataaaaaatatatacacatatatacaaactttgtatccgatgtatacgaattttatatacatatgtattaaaaaattaaaaaaataagaaattacatcacgtatacaaagtttgtatacacgtatgtaaagtttgtatacgcgtatataaactttgcatacgcgtatacaaactttgcatacgtacgaatacaaactagcttggtatacatacgaatacaaactttgtattcatacatcttaaaaaaaactaaaaaaacagaagagaaaccgaaaaaaaaagaaaaactaaactgaaccgaaaccaaaaaaagggaaaaaaaaaagggcaaaccgaacagaaacggaaaacatggaaaaaacaaaaaaaaacagaaaactcgctctcccgtgcggcgcgtccgccgccccctctcctcgcgcgacacgtgtccagtcatgcggggaggggcgcgcgcgagtaatagccttctcgaggggaggaggacaataagacttctgccatgggctgagagagagggaggactttgggccgaaaatgacccaaagggagagaggatttatttttaggttttctatttttagttaactctgaaattggtttttgttgcttaataaatatttttgctgctctgaaaatttgagtaaaaattgagggctcctctttgaccatggagaatttaagaaaaatactccaggccacatttgaatttttcttgtacgcattttaatgtttgccatttcctttttgaattttaattaatttattatttcttttagagaatgatttttaaaacgggatgaatttatcaggttgtgacattaaaggagtccgactacttgaagacctcatttatcactccgttcggtgcgtactgctacatcatgatgccttttggcctgaagaacgctgaagctatgttaccaacgcataattaagagatgtttgcagtcacagctcgagcgcaatgtggagccatatatcgatgatgttgtcatcatcaagacctagcaaaaggtcaacttgattgctgacctggaagaaaccttccaaaacatacgtgcctttaggatgaagttgaacccgtagaagtaccgtcagggaagctgcttggtttcatggtgtcgtatcgcggcatcgaggccaacctggagaagatcaacgctatacgcgatataaaaccaccgaccactcggaaggatgtcaaaaactcaccgagtgcttggcggttctcagttgatttatttccaaggtggagaacgaggcatgcccttcttcaagttgctaaagaagacaaacgatttctaatggacgcccgaaacccaacgagcttttgaagattttagatttcaatagtttcctcacaatatatttctcgtgctggcttcacctcatccataggagcctttgctactttatgcattggcgagaataggagcgagacattcaaaaagctcaaaggcctatttatttcatcggtgaagttttggccgaccgcaaaatgtggtatccacaagtctagaagttattgtatggagtgctgatcacggtcaggaagcaagcacattattttcaaagtcacttggtcactatggtcacgtcttttccactcggtgacgttcttcacaatcgtgaagctttcggcaaattacaaagtgggctctagagataatggcattcgatatagccttcaaagcccgaacatcaattaagtcacaggtcttagcagattttgttgccgagtgaatggaaattcaagaagggacaccaatggagaagctggagtactggactatgtattttgatgagtctccatctctggcgtgctccaaatccatcccctttcccccatactagcccgtccagtttggccatcttgtgacagcaaagcaccgctgcaagaggaccgatgcttggaaaggaaatcgccgcagccttcaacgcccatctcatggcgctaccatcatcattgcaacatgctacgtggttgctttgccgtcgcctacccgtcctcccaccacggtggcctcgccgccacgccactctagccttgccgtcctcctaccatgccaagctcgctgccacaccactgtaggctgcgcaccatgcttgacgaccacgagcctccgtgccaccctcgctgaccgcacttgtccccgcgttgccgacgcctcctctatcgacctttgcgcctccgtgatgtgggctccagccgcacaggcggtgcctccgaccacgccagtccactgtgccacttgctgcttctgcctcacacaggcctcacgttgccgtggcctcaccgtgttggtcttctcggcagtccgcgccacgccggccatgccgcctcgccgccagcccgcctccacgctacgctggttgtccgccgacacatcctctcccggcaacactccctgcgccgggcacccactgccttgcgcaacagccagatccaaccaagagagggttggatccgggtgtgaaggtgttagatccgcccctccaatggccatggtgactgtcgccgtgcattgcctactcttcctgtgccaagaggggtttctgccgaagatgtggccttggctccaccttcctagctcaccaccggctttttcgtcagtgagctccggcggtggctaggtagaggaggggcagcgcgggtggctagggttccatccctgagccgcccacacatgggcgacgcagaggaaaaagtctggttccgtctcagaaatattgcgtcaatttccggatgtgaccaaacgcctatgtaaatgacttatgtgctgcctggaaaaatgtttccattaagtagtgagtataatttctaaaattactgatattagagtgcatgacatgaacgattatacgatatctttatctttatctttacctacttaaaaaacaaaatctgcttcaaacaaaaaaaattatttctccgttggtcctcctggtccgacgacttctcctgctcgagtcgtccatggcgccacacgggcaccatgtcgccaccacatcgacctatctttccatgtgttttctcctctaattaattgcaaaaatcgattgttcactcctccctcatcctttcctttgtgattttctttttcaattcggatttaattcactagatttaatctcggtttaacggttatcaatgatggttagacagctatcttcccccggttgttcctatcccaagttttgcggattcactccgattttggaaaaaacggaaagaggagatcgagtggatccaaagctctcaatcaattttgggagatcatagatttgatagggatgattggctccggtaccatacaggcacataactgtctactggaagttaagagagacaggctatgaagggaggtaggtaggagacgccttttcaattttaaagtatagcgatactaatgttttaatttaattattcatcagctcataatagctattttattactggaaaaaagtttttacccgttgcaacgcacatttatttttttttctagtaataataaaaatacaaaactgccggcagggcaaatgcgctacacagtaagataaattttagcatgacctttttttgccatgtttttattgtcatcaacactttatttaaattttccatacaataaacgagtatatatatctcatacggtccaacagtaactaggtgacgatgaggggcacagccttgagaggggtagccataacaaggatatcgttgcttgtgtaccgctcggtgacgtccacctcctcagccgacatgcctttgggcaggtgccactcgaacgcatgcagcaatgacgcgactgtaaatggcacgacgagctctaccattggcaaagcagggcacagccttcggccagacccaagcggaataaacttggcctgcttcccccacaagtccagctccgtcttgcccaagaaacggtccggcaagaagtcgtccggtctctcccatgcggtagagtcacgcattatcgcccatgagttgaagatcaccgtcgtgcccttggacacggcgtagccgccgatcctcacgccgtcctcgaccaccaggtgcggcaacaggaggggtgccacagggtgcagccgcatcgactccttcactgcggcctggaggtacggaaggttcaccacatcggcctccgtgatcgtcccattgcctccaagtgcggccttcatctctgctcgcgtggtggccatcacattagggttgcgcagcagttctgccatggcccactccaccgtgatcttggtcgtctcggtccctgctgcaaggatgtcaaacaaaaggattttcacgtcacggcgagagagcttgccggtggacatgagcacaaggagagagtccagcacatccttgcactggtcgtcggtgccctgggctaaacggcagtcaattatgctgtccaggatatggaggactcgactcatgtgtatggccgtccagtggcgaatgccttgcaaatctagcggccggagcagcgggaagaaatcggacgcgttcggcttcgcaagtattgcaacgatatcctccataagatcccttaaattggggtgggcatcgacggagagaagcacgttcgccaggaggtcgaacatgccatggtacaggacctggccgatatcaacctcctgcccagcgcggcgacggaagctgtccaccatgtcgaaacaccttacgctcgcgggcgctgcgcgccacgccg

SEQ ID NO: 74729 - DNA, 3435 bp, Oryza sativa
gcgagaagacgtgcgttaccgagatcctgcgcagggtcttccatagaggatcgtagctcggcagccaaaccattgatcgttccgcgtgcgcgagcgcacgtctcgtgtccgggaccgtgcgcgccgcaaggcgccgatcgtgcttggcgaatgcttcccacgcagcgtcgcgcgaggagatgaacacggtggtgacgaggccaagcttgagcgtcatcacggggccatgggcgtgagccaggcttgcgagtttgtggtggaggttgccgccgcgcaggtcgagtaggttaccgactatgggcagcgtcctggggccaggcggccgctgcccatcaccccttctgtttgttcccacgtaacagagtagtaggacagcaagtgatatccccagaaaccacaacccacttgccattttgtgcgttgcagacttgtagttaatttgaaaccataagaatggtacccgccctatatatatagttatatacctcgagctttccaaggccagtttcgtccgttcctcaaccttccgctatcaccgtgggagattttttttgtcactatggccccgttcttttctccgacaaaagttagatattcgtggcacacttttcaaactgctaaacggtgcgtttcatgtaaaacttaattaatcataagttaatagcacctcattttacgtaaaacacttaattttcatcttcatttacatgagtttcaaacaccaccaatagctaacattcagccccctcctcccacttgtcagatatggatccaacagtagaattcgctcttagggctcctttggaacaaagcaaaaatagaggatttttataggattgaaatcctatgcaaaataatggaatgagcattatatttgagattcctacaaaattccaatagaatggcttgattcataggaattttggaggatttctaacacgaggttagaccacatggaaaacttttcttaggtctatctttctccttaaatcttatacttttccaatgaagcgtacaaacaaataagtttcacaaaattcctgcattttgaaattcctagttatcaattaaacatgccaactctcaattcctacgttttcatgtttctatgttttttaattcatgtgttccaaaggagccctttatttggtgtggttttgcttgatgttacattttaaaatacaaagatgtatcaatattcgagtatgcaatttgatttaagagaaattatattatttggcaccggcatgcgctcaattaattttcaaactagttatcaaccctgtataccgcacgggccaatgattatacaaaacatttatctattttttacaattataacattcaaataaagtttaatttatttgatcactatttttaattatattttcatttcagtgttatataattacgctccaatttcaggacagtgatttcaatgcatgctattgacttcaacagaaaaaactatgcgtgcaatgtcatgagtagatctatactgaaacaatgaaggaccgtctatattagtccttctggataatatcgctaccaagatgctataattataacaaacaattctagatagatttttatcataagagtggaaagtgtggacgctttttcgtggccaacataagatcactaacaatttgtggtgtaaacaacagagtcgccaaattcgatagatcaaaacctgctagcaaagccgatttcaagattaattcactttcgtggaattacacgactaatttacaagcaaattagcaaagaagataaatatcgtacttacgtgacgacgaacgagtagtttccgagcaaactaccaaagcataatcttctcggtttcgtggagaagcacgattatttttcagcgcaaaaggcaaagattaactaaattctaggattgctagaactcagccatgaaaacgaaatagaaaataacaggaaagtaaagaacgggaaaatagtatattgacaattgtttggggtccccattaaccgtacatccgcatatacatatatagatatatatatatatatatatatatatatatatatatatatatatatatatatatatatatagaaagtaatgaaagggccacgtaatctgaaaaacaatggccatcggatgaatgtttggataaaagatgaccatccgatcatagatatccatgcagcaaaagaaaatacttttagcgtcttctagcgtctcccctttgacacatgaataaaagaggcacttccctccggtttcttctagcgtctcccctttgacacatggcaaggaaaaaagagtccacaacatgaaaaatacactataggatattgatttgcatggaaaatgactacactactgtttgatctcgtgctgattaattaaatttgagaagtgaaataagtaaaacaaacatacatgaattggtgttgtgtaaaaaaaataaagatattgctgtagtagtatgtaatttatgggctacttcgcagtagtaacatttaggggcaagacagcaagaccactataattgtaaaaaaaaaatttaagatctttaacaaagatgcatctcatggtcgcacaaatgcacaactttgagtggctaatatgtaatggaaacctataaaaatactgtaggatgtaaaaatagacgtataaattaaatttgtacatgtcataccaagtaaaacttttactcctaaattaaaccataagtaaaagtttcagttaggatgacgtagataaatctcaaacatccatttttcatcctacaatagataaacaaagtcaagaatgatgtcccatgcatttacacaacaattttttatctaagggtttgtgtttaagaggaggagaacagagaagatcgaaaaaaaatacacaaaacgagttgtactattacgcatgattaattgagtattttttaaaaaagatttaaaaatgaattaatacaattttttaataaaattttctatagaacttcttttgaaaaaaaatacatcatttagcagttcgaaaaacgtgcgcacgaataacaatgaagattttctcccaaatcactattgccgaacacagccatgtttttattcaaatagaagttactgaaggattttcaatttgaaattcttgtggaaaaaacttctaaattattatatttttcaatccaaattgcaattaatcttatgatgtattaattagttaatcctaaattgcatttgatatgttctttctggtttattgagaccaacattgagctgggctgcaaaggaaattaatatggaattatgaatgtgccttttttcgctatttcaataatatgatttatagtagaacgatgttaaaagaaaactagtatatatatatatatatatatgtatatgtatatgtatatgtatatgtatatatatgtatatatatatggatatatatgtatatatatg

SEQ ID NO: 74730 - DNA, 2564 bp, Oryza sativa
ccgaccccatgtggaaagggagagggtatcacgggaaatatttccccccgctttattgcacgcggggacgacgggaggcggcgggattcgcggcggcggcggcgctagggcgcgggcgaggcggcgggagcggcgggaggtcggggaagacgggtgggccccacccgtcagcgagggtggcgggcgggcccgcccgtcagcggcgcgcgcgcgggaagaggccgagtgggccgcggggagaggagagagagagagggggggaggagagattggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataatttaaaggatatattttagagttattttgggacgtgacagctgtggttcatgctcttaaaatctggcggcattatctcattggaaatcgctgcgaaatatattccgatcataagagtttgaaatacatcttcactcagtcggatctgaatcttcggcagagaagatggttagagctcatcaaggattatgatgtgggaatccactatcaccctagtaaggccaacgtggtcacagacgcgctgagtcgaaaaagccgttgcaacactcttggcatccgtggcattccaccggagcttaatcaacagttggaagccctgaacctaagcatcgttagccatggattcttggctacgctagaagccaagcctaccttgctcgatcaaatccgtgaggctcagaagaatgatccagatatgcatgggatcctcaagaatatgaaacagggtaaagccgctggtttcacagaagatgaacaaggaaccctctggaacggaaatcgtgtatgcgttccggacgacaaggaacttaaacagttgatacttcaggaagctcacgaaagtccttattccatccaccctagcagcacgaagatgtacttggacttgaaagagaaatactggtgggttagtatgaagcgggaaattgcagagctcgtggctttgtgatgtgtgccagcgtgtcaaagcagagcaccaacgatcggccggacttcttcaacctctccaagtaccagaatggaaatgggatgaaattgggatggatttcatcaccggacttccaaaaacccaaggcggatatgattctatatgggtagtcgtggaccgactaaccaaggtagctcggtttattcctgtgaagaccacctatggagggaacaaactagctgaactctacttcgctaggatcgtcagtctccatgacgttcctaagaaaattgtatctgataggggaagccaattcacctctcacttctggaagaagatccaagaagagttgggtacccgattaaatttcagcaccgcgtatcacccgcaaaccgatggacagaccaagcgtctaaatcagatcctagaagatatgctccgtgcctgtgttctagattttgggaagacctgggataagagtctcccctatgccgagttctcctacaataacagctaccaagccagcatacaaatggcaccttatgaagcgttgtatggccgcaaatgccgaacaccactattgtgggaccaagtcggggaaagccaagtgttcgggactgatatcctgagagaagctgaagctaaagtcagatccattcgggataatctaaaggtggcacagtcccagcagaagagttatgcagataaccgacgccgtaacctggaattcgcagtggacgattttgtgtaccttcgggtcacgccattgcggggtgtacacaggttccagacgaaagggaagctcgcacctaggtttgtgggtcctttccgcatcattgctcgacgcggagaagtagcttaccagttggagctgcccacctcattgggcaacgtgcatgatgtgttccatgtgtcgcaactcaagaaatgtcttcgaatgccatccgagcaggccgattcagagcaaattgaagttcgcgaagacttgacctatgtagagaagccggtgaagattctggacaccatggagctgggaattggaccgttcaagtctctaatttttccttaagaagtcaagaacccatttttgtgctttgttcctgcttgttatatggagtttattagagtaaaagctttttcttttccgttggtcgtgtagaagctgcagcttcggaagatccactctacgtggaggctgaagccgacgtttcgaaaagcgagcaaggcaagtcacatcatccttgaacatattgaatcccagtttataaaattattttgatttaaattattgcattatcgctttatttatattcccgcgttatcactgttttatttagccatgcctattcacctttgttatgaccttattattattgttattgttattattaacttgttcaccctag

SEQ ID NO: 74731 - DNA, 1802 bp, Oryza sativa
ctgcaccccccgctctgggcgtccccagccgaagttcccttaggttcctcagagactttgtcaagacggcgtaaagggacattaggttaggtttcaacgctaggtgtctttcgtggtaagggatctctgggtaaaacacttggcgatattgtgcacctgatatcaacattgttgaagtagaggtaatgggagaatcgctacacctctggtcaagaaccaggtagtagtcgtaactcaaccactagaagtgaatgtacgagagatcggtacgattgactggttgagaaccagtgagtaggtgtctctcgatcatttgaagttgtggtgcatggactgctgcgttattgctgtagccgtacctcgaccatctgaggttgcggtgcgagagattgctacgcactggttcgaggaccagcggacaagtagaattatctcttggacaccaatagaggttgcggtttgagagattgctacgcactagttcgaggaccagcgaacgtgtagaattatctctcaaacaccaatgaaggttgaggtgtgggagattgctacgtactggttcgagaaccagcgagcgagtagaatcatctctcgaacaccaatggaagtggcgggagattgctacgtactggttcgagaaccagcgagcaagtagaatcatctctcgaacaccaatggaagtttgcggtgcgggagattgctacgtactggttcgaggaccagtgagcgagtagaatcatctctcgaacaccaatggaagttgcggtgcgggagattgctacgtactggttcgagaaccagcgagcgagtagaatcatctctcgaacaccaatggaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccttaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaataataattgttaagaaataaacaaagttaaaatgattttataaaaagaaaaactctagaaagtcccctatccctccctctccctcttgggccggctcggcccatctctctccccctctctcctctcccccgcggcccatccggcctctccccgcgcgcgccgctgacgggcgggaccgcccgccaccctcgctgacgggtggggcccacccgtcatccccttcctcccgccg

SEQ ID NO: 74732 - DNA, 587 bp, Oryza sativa
atgcagaatgtgcattaaaatccccgtccaggaccggccggggtacacaaacgacaatgttgacattcagatccacgtcttacaaacatcataaaagtcttacataaatgcagcggaaaaaggaagacaacaggagctaagccttgactagaactgcagcgggaacaccactccacaagcaccctcgatggcacggacgaagcctactcctcggagaaacctccatctgacacatactcgaactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattattattaactatccactgtccaacgctatcccacgttacgacaggcccaaccatccacctaaactatccaaattcaaaagattacactagggtgagactaatcacggtgaatctggttgaccgcctataaccacgggaacggctactcgaatagttttactctga

SEQ ID NO: 74733 - DNA, 2079 bp, Oryza sativa
ttcaattgaaagcgatttttgttgtccatccttcctgacaagatgtagtgtacaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgcatcaacggaacaataaaaagcacttggcataccataattttgtcattcttgttgaaattttgtaacataaaatgcatgaggccacacgaccttaatgttcaacgtgtcatgcattagtgaaataatagctcacaaaacataacaaatatagctagataacggttgcaatccttaccaaactaacgtataaagcgagcgatgagtcatatcattatctttctagcctgctaaccatcacgtacactttccgatcccaaaaaatgacaacttctatggatgaacctggacaatgtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaatagaacatatgtccaaatgacatgactcacttggatcctaataggacatgaaagcaaaactagcactccaaagcaaccaatgaggaattgaaagaaaataagtgccatcgcatctataaatagacaatgaaaaccctccccatcgttcacacagttcaagcattatacagtaaaaaagaaagatctagtgtcctgtcgcaatgaagatcattttcatctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgag

SEQ ID NO: 74734 - DNA, 961 bp, Oryza sativa
tgttataatccccttgtactccccttgcatttattctgcacttgtgggtgtgtcttgttgagtacggtggttgtactcagtcttgcacaatttttcccaaacccagaagaggagttcctggaagatgaaggctttggtgtctagctcgtgcctgccgtcaagcgcctgtggtcgtcgccctagtcttccgctatttttcgtttgtcttcatgtgtgctgggccttcgccgcccatgtaataaattaactatttacgcttccgcttgttaaactctgaattgtatcaacttttggtgtaccttgcctcctgggacaaggaataatgcacgcacgtaaggaatgcccgttgggttaattccggtcgtgacaatatgttatctaccctaggtactatggtgcacccagtaccattaccacccttggttgtgtcttgtaatgagttttaacagtatagtggttcggaagttaaaaataagctcagatatcatcatatgtgacatgtgaaactttgggtgatataaatggaaaaaagttgtctttcatatttaaatactatgcctctataaggatatatcctagtacgttgtcgtgactaattaccatcatcggtactctacaattttattgtgtgcttacattcgatccgaagctactttgtttttaagatataaatggagcgtataaaggatgtccgtccttttattccaataagaacaaacacaaagcacatatggcaaatactaaatccactacaacaaaatcatagaccatacaaagcaggtaaagatgtagcaatccacattgattcttcatccactactacaacaagcgcatatgaaaggcggcatatgcatgatcattgtgaatatgacatgcccttgtcgagcaacgtgtcacttcatgcaaatatgttgtttcaagcgacatcaatatatggttacaaaattttaaacattggtat

SEQ ID NO: 74735 - DNA, 18794 bp, Oryza sativa
cctctttcgatccctgaaggggtttttgccttctagatgtctaggggttcaaagaggaccagaggagatatatatgtgtttggatatgttgatatatgagctgatatatgccttactatatatatactccagaattgcactgaggattacatatccaattcagacatgcaaaccttaccagttgcaatattgtaaattacatgtccaattttgtagtttcatcttcctcatcataaaaaaattatgttgtgtcatgtgcatctactttgttttccccatgtcaactagattatttctccaacacatgtggaacagtgtggaaaatacatcctcatcaacagtaataagcacagtgctaacaaattaagaaaaaagtcttttcatgtgttctccaaaaccctaatcacacttgagaaaagagagctgcaacaagaattgatagattgtacgatccatcgccgtcaacaaatgtggaacgaataaaaaatttgctttgggagctcatcacagctaaagtctccagaacaaaaaccgtacatgacattattgcagcacttgatcatatcaaacgtatggaccagaaaggctgcaggcacatgtatgtcatgtgtaagctttttcaaactgagtactgtatctaattaacagcagaaactgaaaggaaatcctatgaattcctcaaagataatatcaattttttaaacgaaagtcagctttatatagactatacaggggttaggaagaaagtctatattcagtacctcgactattcatatagtttgatttccattgctcaacaatattggataaaactcacttgtccattattaaaactatgaaaatgataacttggctaggcttatacgtggctttatgttaatatatatgcttctgggtggcgaaccaaaagaagaagacccattaggttatccatgtagtactatgattctagtcttctaggcatattctccccgcctcaatttttttctgtttaaaaggaaagaggacttgagatgcagagaatgtagcagatgagattgctaagaaaatgatgatgaggcaagccaccttacccaaaactttttacaaaaaagggggatgtcgaagagatgaaaacccaagttctctcctacagctgctcgtggcaccaaaagcctcagggatcgtgttgcgtgacgctaaacaggactagctgtgagcgaggccaaggacctaaccctcaatttaggcgaaccacgccgtgtactcgggacactagctcgaagcaggccttgagcacgctatattaatatggtaggacgtggcacgtctctccctcgtgtcgcacacctgatcttgcatttaatgcgaaggatgcaaatccgatggccacgcgcatggagaggagtggatgacaagacgacgcatgctgaccgtggaacaagcatcatcacccctaaaaagttgggagcgtgggttgtcagctgacataggtccttaacccggtgtactcgttgttagaggccgacgagtgggccaggctagcgccacccttggtttcgtcaccaactcctaggccacgcatcgagaccaggtgcaatgggctagcttgtagttggccacccatcatcgagcgatgggactagcctttcctaactcatgtgtacatgaagcccacttgtaagcgactgcccaatgtggtgcccctcgggctataaggggattcacaccttgaaaacccattaaggatagaaaccctcgcgagctttagagaaagaaacaatgcactttatgcatattgcagtaaataatccagttaagaacttaataggagtaggcttcactgctccctgctattggagctcgggctttgactagggaacattaattatctaagaattttttttttcagaagatcagtgcatttattgagaagaagacaaccattttatataaagcacaatattttattttgagacaatattcctttgactaagaatatctataaaaataagatgttttaaatgaaaatagtcatatattatgatagttgtttaataataaatctagtaacatcaattttatatgattgattttttttatttttatactatttcttgtcaaagttaaaaatatttgacttgacaatattataaaaatacttatattttgagctgaatagaatatttggctaacggggatatgaccatcattcgcaagcagcttacgatataaaatggagagagcatatatatatatatatatatttggtagtgatcattattctcatttggaaagtagtgtgtgaatatttaatactagcctccaagttggtgcagtgacagctagctagcaaatggtgtgaaataaacccacggctgcagttcatgcaccggcggccgccgccgccggcgtgcgagagatcgagccaggcggtgggccccaccgtctcgttgttaagtagctatctcgcacgtgcccgaaattcgatccaaagccgatcgagaagttgatcaagcaagcgaagctggcgattgaccgatcggatcgagtcgtcgtggtcctctggtcggcgacacgtcagctagccacgtcaccggtagtcacgcgcctatcacgggggatgtgggccccacccgctctgccgtccacgtcagcttcagctaccgtcaccggccgttagataactgtccgccgtctgttaatgcgtgattagctgcgttataggttagtgtacactacaccaacagtgtgcgttgttccatctgaacggttgctacggccggctacttggattttggatagtgctattgctataagcctacaatatatagtatcaaatagtatataacacgatgcatgatatatgcatttaaatctcaccaaataatgctataatagtatcgaattaatatatatatgtgtacatatagtagttgcagaaacaacaaatttctatataatagcatctccatccgataatgaccgcattcagttgttcacaacagtgataataaaactaatgattactctggggactagctagtcggagtcgacgttgtgcacgcacgcacgtttagttaattaatcggtcattacgtcacaagccaacaatagaacttactactccgtaaatatgaaaaattgtaatacttcccttttcataaatataaaaaattttggacttctctattcaccctaaaatgtaaggaaattttgagtgctacatttttctaatctatcttggttgttgcatcgctaaacttagataattttcaatcaagcgagctcttaaacatcaaagtagtttttccgcaacattaaactttggcaagcaatccggaatcaaatgtgttaattacttgtgaacatagagagcaatattactacatccgtcttaaaatatactccctccgtttctaaatatttgatgccattgattttttttaaatatgtttgaccgttcgtcttattaaaaataaataaataattattaattttttcctatcatttgattcattgttaattatactttaatgtatacatatagttttacatatttaaaaaaattgaataagacgaacggttaaatatgtgctaaacagtcaacgatgttaaatactactccctccgtattttaatatatgataccgttgactttttgataaacgtttgacctttcgtcttattcaaaaaatttatgtaaatataatttattttattgtaacttgatttatcaacaaatgttcttacataagtatttttatatttgcataaaaattttaaataagacgagtggtcaaacgttggttaaaaagtcaacggcgttatacattaaaattaaaatacggagggagaggaagtataataattttagatatgcacgtgcaggtatatagattttagtacgagaggaatttattatggatgatgatgaaaaagaggggaaaagtagcatggtattacgtggcggtcggcgagcggcgacgttgggccagggccagggcggcgatcgactgactgactggtcgatactcatggttgtgtcgtggtcgtaacttgcgtacaaaagtctgaccgtttacctaagcagctggcactgatggcgccacactgctacactgttatttttctttctttctttctttctttctttctttctttcccacagtttattaggaggagctgcgtaccactggcactgcactatgcatatatactttactaggatatatgtactgctcactcttccgtctcttaatatatatgtattttttatgacttaagatttataccataattaactaaaagaatatcggtgcgtcacaacatgtaaagacatttttttcaatggtacaataactgttaggagctaagaaaaaaattgaaacattacgatcactacacactataattgaaaaaacttaattataagcattgcttggttttgggccgaaagtctgttcattcatttctttttaactaggtgataccccgcgcattgctgcgggaattttaaaaaaatggttacagaaagaataatagtggtacagttatagtatatcacctctaaagcaaataataatactgaaagcttgacctatcaagcttagtgatcaaacgataacattacgatgaagtatcagaaaaatatttaggcagtacatgcaaatcttgtcatgcatcacttttacctaactcaacagatgctaatctacatacatatcatatggaactattgacttacttttcctgtagaatagtacatatatgttcaacgaaaatcatgttaaactcttacgatgattgcattgatatcaaaaggaaagactggttaatgaaaaatgacaaatggtctgtgccaagactgctaaagtaaacaaaattgtctgtcaagcaacctgtaagtgacaaacacgatgagaaaattatatagtgcatttagaaattttactattgctcacacataatttcattaatatatctcggaacagatttgttcaacctcaaagagtgcttgttgtgaatacggttgatatacctattgtaacggagaggctttactgctagtaaaatttcctcgtaaaagaatgagtaacttattgaataattaaagaagactaaactactttttttagagaggaggccatacggcccggatttttttgaaagccacacacggcagagcagaagactaaactattctagaaaataaattagtgaattgaacattgaacaccaaaccgaccgtttcttgtaatgtgtgcgaagaaacagaaaggtaagggagtgattttaccatagtttgcaatagatcttatactgctaaaaaatacaatgtcaattcaaagagggaaaaagaccaatatatttgctatcttcagtggcgagaaaaaaaatcaagtatagacattagagcacacacataaggcgatagaaaaaccaagctcctgtattctttaaaaaaaacacaaaataaattcagttgatattgtagtagtatataagataaaggaaggagttacctgggacaacgattggatcaacgatgacatggcaaatcaatgaaaataacagtggcgaggtgatccagaaatcaggaaagcacaacacatctgtatgttaagaactgcaactgatgaattgcattagcggataatcatgccgatgaaatcatgaaatccattgacaatatgaaatctcgcttttcatagatatgccaatggtgtgaactgtgtgaacaaaaatataaatgggcatatggccacaatagctgaatcaacaggattgaagactcaggcaaaaaaaactactcaaataaatcgacaatattcaaaaagagatgatggaggtcgcaggctcgtagccgaacaggtgcaaagaaggcgagatgctgcacgacacactggcggaaggggatcaggtgcactcgtattaacaaagagaaagaaacggctgagcccctgctggaggaagatgatccgtcggcggcgctgcttcatattctcatgagtcagtgtctgttggggttcaggggcagcggtcgcctgattttgacagtttctaatgtaaatgcttgtgattaagtgaggcgaatgagaagtgattaccatctctgctggtggttgaggatgagggaggggccatttgatttcaccatggatggcgtcagggctcccgacgtttctccccatcggcgcatcgctacatggatcgctccagtcgtttctcccgcgactgaggcgaacgaatgccgcaccactctccccattggcgcatcgctgcatggatcgctcccgatgtttctcccgcgacccaggcgaacggatgccgcaccacacctcgccgtgcactgtccctaccaactcctgcgcgcgaccgtgcgcgccgcaccaggcggttcgccgcactacgccgtcgccgctccgattcaggaagtcgggctcgggaggatgagagagacacatcgaaccctaaatcactcattgggccgcgggctgcgatacactgatatgggtctccttcgctgcctcacgcctgtgaagtccctcgcttcctcacgtctgcgaagtcagccttttcatgaaaacgactgagatgcgatgtaatcatccgatccaacggctgccaattaatgatgacgtggaacactgaggtttgagatttaggagattaattgcacttagtgggggataactttataggaagaagggattagtcccagaacacatgcctcttatctccattcgctcgtcctgcctcccttcggcccaatcgacaagtgaattcgtaggcctagctagcacatgctcccttctctcgttgccaggccagaaccacgcgctacattagcgtcttcaatctccaaaggatagtcctgtgctcctatcctccccatcaaatataatcgaatcttcctcatatctcgaaattggttgagggttctcctctttcagtccccccaaaccggagtgaatctgcattcaatttcgcaaaactctaggataaaaaggatcaggtaagctattggttggtcattgttggcgaccgttaaatagagattaaggctgacgaattaaagccaaattaaaaggaaaaatcatgaggaaaatgatgagggaggagtggggaatcgatttttaaaagcacatagagggcagaccgacgtgacgacggcgctagtgttccaccaggagagaagagcggggcatcatttgaaggcacgcactgcgaagcaggccgagacgagtgatggctaggccgagctctaacgaactgactgagagacgacgacggacagaaaaaagagctacagaagccttacatatttttaattaggtatggatataaatataaacatttttaggcgtgtaatgattctaatgcatagaaatataagcatttttcaacaatcagaagctcataaagataagaaattcaaaattctgaatttctaccagttacgcgattggaagaaatatttttattcatctttaatctttgttcaacaatctagaaatacttattttagaacgacagggggagtcgtttttgttctgtgtatgatatttatgcttttctacacgttcctgaaaggatggaccatagttccagcgacttaaattcattcggcccatcaaactgcgacccaaatacggcctactaaactctgcacaaaaggccttagaatcgagcccagataattaattaagcctatcaccgaagcaaattagaattttattaatttattttttaaaaaaagatttacactcctcccagacaatcttttaaaaaataaatataaataaatttcagcaaattaaggtcgagagatcacctctcactagttagcaagtcctacctatgcggccatccaagcacaagcttcttccatccaatcaaaaacaaaaacaagatggatggtcatcttccttccatgcatgggagcatccaaattaatctaccaagaacaccctataatatatatgcatcgccatgatcgaagcgaggaagaagaagaagaagaagctgcagttgcagcagcagcagcagcaactagtaactaataaagtgatgacgatggatcgtcccaacgtcgccgtggccgcggtggggctgctagtggcggcggtggcggcgacgctgccggcgccgtcgtgggggcagcagcagccagccaacaagctcatcaccagcacctccggctccggcaaagggttgtccaagtggctggcgatgaaccaggaggagtacgtggagaagaaggcgctgcacaccatggccaccgcggaggagctcggcgggaagaagctggacgcgaacctgacggcggcggaggaggccaaggtgacgtgggtgatcgaccccaaggggacgccgggcgacaccaccttcaccaccatcacggcggcgctggagaaggtccccgaggggaacaagaagcgcgtcatcctcgacctcaagcccggcgccgagttccgggagaagatcttcctcaacctcagcaagcccttcatcaccttcaagtccgaccccaagaacccggcggtgatcgcctggagcgacacggcggcgaccaggggcaaggacggcaagcccgtcggcaccgtggggagcaccaccgtcgccatcgagtccgactacttcgtggcgcatggcgtcgtgttcaagaacgacgcgccgatggccaagcccggcgccgagggcggccaggcggtggcgctccgcctcttcggcaccaaggcggccatctacaactgcaccatcgacggcggccaggacacgctgtacgaccacaagggcctccactacatcaaggattgcctcatcatgggcagcgtcgacttcatcttcgggttcgggagatcgtactacgagggctgcaccatcgtctccgtcaccaaggaggtgtccgtgctgacggcgcagcagaggagcaagaccatcgagggcgccctcgagagcggcttctccttcaagaactgcagcatcaagggagaagggcagatctacctggggcgagcatggggggaatcgtcgcgggtggtgtacgcctacaccgacatgtccaaggaggtggtgcccgtgggttgggacggctggaacatcgccaagccggagagcagcgggatctactacggcgagttcaagtgcaccggccccggctccgacgccaagaagagggtgggttgggcgctcgacctcaccgaggagcaggccaagcccttcatcggcacgcactacatctacggcgactcctggctcatcccaccagagtaattaattactacttttgtttttacatcgattaattaattaacactctctctttttcatattatgaatcgctttgatttcttttgcatttttttcaagtttaaccaaattttattggaaaacatatcaacacaattttttaagaaaagaacaaacatattataaaaatatattcaactttacatttagttaaactattttttaaaaatgctgctaaattttttgaaaaaaaattgatcaaatataaataagtttgacaaaaaaaatcaaaacaaagttacattttatatgaaatggaaggtgtaatcaattaattatgctagtacaaattaatatattctaattgttggtgtaacatcaaatagcgggacatcaacgtcatctagctcagcttcaacgtcgagcaactcaaccgcggaagcaccgacggcgagtagtaactcaactgcatcggctaataaaaaggaaagcaattcaactgcagaagcgccgacggcgactagctactcaactgcgtcagcgacgacgagtaattccactgcgtcagcgaaggcgactaattactcgagttcaagtccaccggcaaaaggcaagtagttaatacaagtgcagcggcgacgacggcgccgacgcgatgaatcgcgttcattggggccaaccaattctgttttggaagcccgtttaattgttcattctttgtgtcaatttgggccggattaatcaatcggccggctacttagatgtttcacgtacgtgtaacagttgtattttcttcccatttcgtttgggtcttttatcagtgtacgcatcttcaaaactatagtgaattttacacatgttttccttttgaaaatgactcttgaagacttgtgctctatacttatgttgcaattaactttcgggaacgaaaacgatcaacagaataggcatcttaccgtgattaaaacgggggtaacaagtacatcccacttgttccatggctaataagtcgtgcaaaggtaaggagcttattaactggttagatttcttgtgatggaaccaatccacccgagttcaatgtcaatacaagtaccgaaaagaacgtgtttgcctattgcaatatcgtgtacgtggggataagattgctcactaggtaggcacacagttattctttgcacctctgtctcattaagtttctctagatttcagcattcaaactgtgatttaaacttttaagcacatttgctagaagcaacattgaagccttgatggtgtggtacgtacatttgtttgcagaagacgataatttcttatttgggggggtgtttggacgatccaggggctaaactttaatccctgtcatatcggatgaatttggaatattaaacaaagactacttataaaactaattacataaataagagctaattcacgtgataaatttttttaagcctaattaatccataattagcgtatgtttactgtagcatcacgtaggctaatcatggattaattagtctcaatagattcgtctcgcgaattagtccagggttatagaatgggttttatcaataatctacgtttaatatttataattagtgtccaaacatccaatgtgataaggattaaaaagttttagttctatccaaacagggcctaggctagcaacagcgcctgcgcataagttgagaacatgctagaagaagctcggttccagtttgcaatgggcaaaagaaaaaaaatattataatatatcataacaaaatattttttatcaaatatgtacttaattgtttgcttattttaagatctgttaccacttgtttaaataaaatgttggactattaattccataatattcgaaaataaaaagaagacaaattataaaaactgcaagagcaatagtgggtggcatattccccaccaaaggcttttaaagtagttagattgttttcctttcattcagttactgtattaattgtgtgtatatactccaatgtacgatagtataatttagtgatcagtagtacactacaagtacatagtttttttttctgaggattttatgttcataatatatagtactttctgtgtatgatatttatgcattttgacacgttccagaaaaggctggatcataatagctaattttagccccacaaatacactcttacttgctccatatttcagaatttaagatgttttggttttgtcagaaatcaaatttattcaagtttgatcaggtttataaaataatgtattccatattcatttctcgttggcatgttcgaaattacttcaatgagatgttttctttgtctaccttttatcaatgcagtaatattattctcaccagaaaaatataatgtttgctttaagaaaagttattaggatgtaataattagtgtagcaatataatttgccgcatattctattttagtgcatgtgagatttgttacagcaacaaagtagattgaaatgggaaacggatcgagtagtaacatatagaacgccaaattaattttattaaatctagctaccatgaaatgtatttttataataggttttcttttttacaaatattgctatgttttttattaaattaacttggttaaacatcttacattagggaatatagagtaccagcgaccaaaattgggcgcatcaaatgaactgcgacccaaaatgcaacctctaaatcctgcacaaaaggccttaaaatcgagccaagatatcatcgaagcaaattaaggtcgagagatcgccggtcaccaaattagcaagaagtgcttgctacctatccggccatccaagcacgaacattttccccaaaaatggatggccagccatgtcccttccatccatggaagttccaaattaatccgccaagatcgatcaccctatatacgcatcgcgccatgatgggcagggacagaacgaattagctgcatactgcagcaactaataaacgatggatcgtcccaacctcgccgtggccgtggtggggctactggcggtggtggcggcgacgctgccggcgccgtcatggcagttcttcgacctattcctccccgccggccccagccaccgctcctccggcggagggtttggcaagtgggtgctgatgaaccacgaggagtacgtcgagaagaagtcgctgtacgccatgaaggccgccggcgacatcggcgggaagaccatcgacgcgagcctctcggcggcggaggaggccaaggtgacgtgggtggttgaccccaaggggacgccgggcgacaccaccttcaccaccatcgcggcggcgctcgagaaggtccccgaggggaacaccaagcgcgtcatcctcgacctcaagcccggcgccgagttccgggagaagctcctcctcaacatcactaagccctacatcaccttcaagtccgaccctgccaacccggcggtgatcgcctggaacgacatggctgccaccaggggcaaggacggcaagcccgtcggcaccgtcgggagcaccaccgtcgccgtcgagtccgactacttcatggcctacggcgtcgtcttcaagaacgacgcgccgctggccaagccgggtgccgagggtggccaggcggtggcgctccgcctgttcggcaccaaggcagccatctacaactgcaccatcgacggcgggcaggacaccctatacgatcacaagggactccactacatcaaggatagcctcatcatgggcagcgtcgacttcatctttggattcgggagatcactctacgagggctgcaccatcgtctccgtcaccaaggaggtgtccgtgctgacggcgcagcagaggaccaagaccatcgagggcgccatagaaagtggcttctccttcaagaactgcagcatcaaaggacaagggcagatctacctcggccgggcatggggggattcgtcgcgggtggtgtactcctacacggacatgtccaaggaggtggtgccgatagggtgggatggctggaacatcgccaagccggagagcagcgggatctactacggcgagttcaagtgcaccggccccggctccgacgccaagaagagggtgggttgggcgcttgacctcaccgcggatcaggccaagcccttcatcggcacgcactacatctatggcgactcatggatcctcccgccaccagagtaattactcctctctccatttcaaaacatagggcgtattttgtgttgttaggagataagggtttaaccaatgattgcttctccaatatattatatttgtgccgcaaaagtataatacttttgaagacgaatctaaataatatttcttatgcttcacaaaagttatattataaaagagtaatggtctatagaaaacagagtagtggttggttaaaatcttgttctaacaaagtaaaataaaccctataacgtgaaacatagggagtactatttttacattaactttctttggtatttcgattttggggtaacatcgaatagcgggaaatcagcggcatctacctcgacggcgagtaaatcaaccgcatcggcgatacccaggaactcaactgcaccggcgacggcaacggaaagtaactcaactgcaccggcgacacccagcaactcaactgcaccggtgacggcaagtaattcaactgcaccggcgacggcgagtagttcaaacccacctgccacgaagagttactcgggtccaccggcgacgccaagtgcttcaagcacaccggcaaaggcgagtagataagtgcagcggcggcgcggtgagtcacaacttcatctacggcaattgaaggatcctcccgccaccaaagtgattcaaatatttcggagtaactattaccaatttaattgggcccaatcaattctgttttggaggcccgtttgttctttgtgttgtgttaattgggccggattggtcggccggccacatagatgtgtaacatttgtatttttttcccaattcatttttggtcttctatcagtgtacgcaccttcaaaatggtgaatttttacagaagtttttgaagaagacttgtgctctgtatgcgtggcaatttactttaacgatcgacacgacggcatctaattctgacgaaaacgagagataaccaatacatacacatagtattaggctatgttcggcaccctgggttgggaacccatgtcccacgcacaaaaaagatagcgatccattagcgtgtatttaattaagtattagctttttttttcaaaaatagatcaatatgatttttttaagcaactttcgtattgaaactttttataaaaaaaatatactatttagcagtttgaaagacgtgtgcgcgaaaaacgagagggggagttgggaacctggggcaaagaacaaagcctagtaaagctagcagttcgtacaagagtgtggtaattgtgaattatccagggtctgcataaaatcgagtttaattcttcgtgtggttctgataagttccttgctgtacagtgtataatttggtttttagagaacgacaaatggataaacagcgtgttctagaactgtacatagaacagtgactcaaattaaggatgagaaatgggtggatcagggacgacacatgctatacatctctccaaattgttatccatttcgtctgtgttcagcatcagttggcctaattaaaactgataatcaacaactttaaaaaataacttatggcttatatatatataatcctgagcgatttaatgccaatacgaaccccaaaaaatcaattgaaaaactaaaataaaagttccaattttaacaatggcttatatttaagcaatcggtgcttctcttgctacacatttataggagtagagtatggattttgcagtgacaattaaagccaaacacacaaaattcacgataaaattaagaaaaccacacaaaaaaaaagtgagccatgcatagcgagagccaagtggcaatcctctagtacactcgcagctgtggcccccgcaaaatctgccacgagccaccaaaccccgccacgtgtcgaggtgggccccaccaacgaccggactactcccgcctcctcatccggttcccgccactcctatttatttcccaaaaaaataataaaaacaaaattcgacgaagaaaaaaaaaataaaattcggcggtaaataagcggggcgaaggaagaagaaaatcacggaaatgccactaccggcgttcgtggcggcggcggcgaggctcgccgtcctcgtggccgcggcggcgacggcggccaatgccgcctcctacgcgcggtaccggcggcgccacctccgccgcatccccagccccatcgacgagtccgccgatcccctcgccgacttccgcgcctttccctcctccgacgctgacgactcaggttcgtctcactcactttcgtttccctctgtaaagccctagccatgtaagcgctaatcgttgaggtcaatggattattgcattggggttgggagattatgtatttgattagtctttgtggatgcccagttgggaggttttaggttttatcaatttttgagatggggaattgttggcataatcgatttgaatttaatcaattaatccttatattcaattagttttttgatcaattagtcaatgtcaatacgagagtactgaaaagaactttgtttgcccattgcaaatgtcctgttacatcatacatggggataagattactcactataggcacagttatgctttgcacctctctctcattaattttctctataaattcgagcattcaaactgtgttttaacatttaaggccatcactggctggaagcaacaattgtcaaggcaatatggaagccctgatggtgtggcatatttgtttgcagaggaggataatttcttctttgggctagcaacagcgcctgcgcatgttgaggacaggctagaagatgcttggctccagtttgcaactgaaacttcctgcgatgacaatggaaacgtgcgcgaccagaggccagtagatgcactgatggcatctgctgctggtgatggaggctcccagcaatcttggaggtcaacaggtggggaaaatattggtgatagagagcagaggaaaccacttagggtagccatggaggctatgctcagggggtttgaaattcttgctgagagtggagaatctgctggcggcgataactgcagccacaatgttgctgcttggcataatgttccatgcccgtaagtacatgagtatagaatctctaatgagctaatttatctcagttctgtactccaaagaacaaatctccttgcctgtaaagtcacctagagtcacttctcatcttaactatctctccaggaagagttgttgtctttcaatattgtagcttctttccaagtctagatatgacttcgatagtgctactatgtagtggtgggtcccaaggataaaaaacgaatgcatgcttttaaaaaaagtaattcaagattctagctttccttccaaatgtagatgtctttggatgttgtatgttagcaaactctgatcatttttttttcaggcaagaaaggcttagattttggtctgatcctgatgctgagttgaaacttgctaaggagaccggcatcagcgttttccgcatgggggtagattgggcaaggttaatgcctgaggaaccaaccgaagaattgaagagctcagtaagttcatagttatgcacgtgcctctttttacctttatattcatccttctttttccagcatgatgatctcagtaccggtgaaataagatagacatctctttctctaggttaattttgcagcacttgagcggtatagatggatcattcaaagggttcgcgaatatggaatgaaagtaatgcttactctgtttcatcactcacttccaccttgggctggaaaatatggcgggtggaagatggaaaaaactgtcacctatttcatggattttgtgaggtaccttttgagggcagtcaaattgacctgccaatacattctctccattgggaattgttcaataatttattagattttgatagttggggctgtgcaggcttgttgttgatcgtgtatccaatttagtggactactgggtgattttcaatgaacctcacgtttttgtgatgctaacttattgtgccggtgcttggcctggtggagaccctaatgcaattgaagtagcaacatctactctgccaactggtgtatacaatcaggctttgcattggatggctattgcacattctgaagcctatgactacatacattcgaaaaggttggttctacataatgtattatttgcagtgcccttattccagtgattacctggtattttttattcgataatcaaggagttggtttcctctggttttcttattatttatttcttgattaacagcaagaacgaaaggaagccaatagttggtgttgcacaccatgtatcgtttacaaggccatatgggctatttgatgttgctgctgtcgcgctagctaactcattgaccctttttccttacgtggatagcatatgtgataaattggacttcattggaatcaactactatggacaggtaagcaaattatttgctgcttaatgaatggctatgtaagtgaccgagttaattctcccatttccatgcaggaggttatatcaggacctggtctaaagcttgtggataatgatgagtatagtgaatctggtcgtggggtttatcctgatgggctgttccgcatcctgattcaattcaatgaacgatataagagattaaatataccttttgtcattactgaaaatggagtttctgatgagactgatctgatacggaaaccatatatactggaacacttgttagccacatacgctgccatcattatggtcctttcttaacctttaagcaaacatgttttagtctgtgctcatggagatggaacttccaacacttaaacaacataatgttttatagggtgtccgtgtacttggttatttgttttggacaacatcagataattgggaatgggcggatggctatggtcccaagtttgggcttgttgctgttgaccgtgctaataacctagcacggaaacctcggccttcatactttttattctccagggtaactttttcgttttagcaaatcatgaaaccatggtacattgtttacctattatctcagtctcttacgttgtctaactcctaggtgaatttttgtcttctgttgaaatattgaaaactaactagatctactccttgtttctgaagtttaaagttcattcattttcttttatcagagtaattttatggctagataaagcactaaacgtgtctagacctgagattacctccagcattttttttgccactttttacgttcatgcatgtggtggctatataactagcatgataagatgcatctgaactccaggttgttacaactggaaaaattacaagacaggacagaatgtctgcttggagggagctgcaacaagctgcagttcaaaagaaaacacgtccatttttcagggcagtggataagcatggtcggatgtatgcaggtatgtattgttt

SEQ ID NO: 74736 - DNA, 6630 bp, Oryza sativa
cccttacatatgtaatttatatgaatttacaatgtaaatatatggtgactattttttggtaaaaaatatagcgccataaatatagctactactaaaaaaatagagatttcttagagttgttaagagggtaagtttgcttacatggaaaagagagaaagataatggcgacatcgactcatagcaatttataaaaggaaactatttgttgaaggaaacttagcattctccgtagccatattttaatcggctatttctcaatcctttaaagatgagttactcgtgaaggattgtggatgtctgaatctgtagtagcgactactactcatagctagcttgctgagtactgactagtataggcctgtttagttcccacataaaaacttttcatcctgccacattgaatgtttggacacatggagtattaaatataaaaaaaggtgtaaaatacaagacgaatcttttaagcctaattacgccataatttaacaatgtggtgctacagtaaacatttgctaatgatggattaattagtcttaataaattcatctcgcaatttatagacagaatttgtaatttgttttgttattagactacgtttaataatttaaatgtgtatgtgtccatatatatgatgtgatatgccaaaacttttcatctctggatgtaaaattgtaaacacagccatatacaatgtgtcgttgcctgcatgcacgcagatcctggatggtcgcggcaaggaggagaagaagaagcgcgtgggattcatcctcctcctgtccgacggagtggatcagttccaatactcgaggatcaattgggagaaggtggcgaagagcaccgacgtcgaccactccgaagttggcgccatgctccgcaagtacgcggtgcacacgttcggcttcagcgcgtcccacgaccccgtgccactgagacagatctccgcgctctcctacggcctctactccttcgtctgcaagaacctcgacaacatcacagaggccttcgcccgctgcctaggaggcctccgcacggtcgtcgccgccgaaatccgcgtcgatctcaagcccaaaagcagtgataagcagcagcagcagcagccggtgctcatcaagagcatcgattctgggggctatgagagtcaagtcatcggcggcggaacctccggcaagatcctcatcccggtactctacgtcgacgaggtgaagaagttcatcgtccacctgaaggtgcccaaggtgtcggccaccaccgtcaataaccagcaggagattctcacagccgacggcgacgccaactcggtggacgggaagacagtccgcattaaggaacacaaactggccatccggaggccgccagaggtcgtcgaccaggccgacctccggccagcaccacaggtcgtggagcaggtggtggtgttcaagctgctggacatggtacccaagacgttccagcagcgtagagaagatgatcacaagggcgtgaagaataccaaggtggccgtgcagctgctgcagcggaacatggacgagataaggcgctccgatgcctggacagacctggatgtgggcacgaggcgacgcatcgacgaacaggtgaaagagattgcggaccacgttgagaaaggagaagggccagcctatgtcaactcgtgggtgtcgagccaggagatgcagcgcgccaacaccatgggctcgcccaacaaggtggtggccggccgagttcgcgacgccggcgatgaagacaatagtggaggaggtgaaaaagccactggaggagaagatcgttgagggtgagcccagcacgcctaccagtaccaagactacaccttcttcagctgatccaaatccagctccggctcatccggctcccactcctatcaaacaatattctccacgtcctgatgaaaaaccagctgattatccgaaatctggtcagaatccacgtccggtggtcctgccttctgaagatctagctccgattcagcctccggtactttcttctaaacaagtcgtaccagctcatgtggtcgtccctccaagctgttcagaggaaattagcttgaggtgcccgcagtgcgtggagttggactttgtcgacgagcacctcgcttactggtccaacgtgaaacgcgacctgctgcgcgtgctagacgacgcggaagccgccgcagggctccgccacggcgtggcatgcttccatgacctgtcgctcggagccatcaaccaagccatgtatcagagcgtgtgccaggtaattcctccgtgtcccacggtacctgtctttctagcattaaaagataccattttcaattcaaatttcttcctatatattctactctcaaccaccatcccatatctaactatacattatttattaagagtactatagttcttttctttgaaccttaatgcatgctaaataatctagaaaaacaagtattctgaaatggatatagcatgtactctctctgtctaaaaaaaccaatctagtattaggatgtgacaatgaatctggacatagattagtatgtccatattcattgtatcgagatgtgtcatgtctaataataggttggctttcattttttaggaccgaggaagtactacgcaatccatagtagtagtatcttgcatatatagcttaacctgactttgtgtgtaggccgtcgagcaagcccggagcctgagcaagtactagcgagctgccatgccagccacatatatgcactcatgctgcaaggaagaatctcagcaaggacgactactaccatcatccatccacattaattatctagcctacttgctcccttccggttgataatatacgttgtggacaaggtctatttgtaaactttcactattaataacgactaaaatatatttgagttagaaatatgtatgtacgtacgtacgtatacagattactcttaaaaatacttcatccgttttacaatgcaagtcattctgtcataaatataaatgtgcattgtaaaacggagggagtactttaataaaattatatatttattggtgtttctataaactgtaaaaatgtttgtgctttgcacgcaaccgataacggtggagaatcataaaaatcgacataagcactaaggctacatccttttctgcgttttcgaaggagctaccttttcgttctctgtgaccatattttccaaactgttaaattgtatgttttgtgtaaaaaaatacatatgtttcttcaaaaagtcaaataaatatgtactttaattaatacttaattaattatatgctaatagtttttctcatttcacataaaattctcgctattctgctagcttgaacggaacctaagaatttggtgttggcgaaactacatgtttacatgtaactacatgtttacatgtttgggatcgtgacatcaccttgtttatgtgtagtatttgggtgtaatggatcttgtagcgttgactcgatcgtatagttagctatcacgtcgcactcactttatttcgcccctcgcctcgccactgctcgagcgaggtgccggcaaagctggaggctcatcaggactacggcggcggggctcgcagctcccacctctccagatctagacgggcggatctcaagttagaggtcgacggcgacacttcggcagtgggcagagaaggccgacgcttgggagcaaggcggcggctcgcggccgggtcacacggccagatccggtgaggggctgcgacgagaggggagaggctgcggctggacggcgggtggcgtcgaggaggacgcatgcgacgggtggccggcggcggcattgacggtgatggcttcatggcggtggtggtggaggacgcggatccgacacagtcgcgccagatctggctccaggtctggccccggcatggaactagtcgatgacggcgcgacagcatcggcgatgacataagcaatgggaggacggtgccgcagggtaggctggagcggtgatggatggcacaggcggcggggaaggggccgtgcaggcggtgtgcggccagtgtccctttggccagatccggtctctctctctctctccctctctctttctctctctctctctgccctggcctagtgtcggcccagcttcgtcattgtccttgagcgcggccgcaccgcgtgtaggacgggtgcgaaacaggagggtgaggcagcagccggtggtgtgcgaggtggcggccggcgaagcatgagcgtggctttgaccagagcgacgcatggacatggccagtggtggtctacatgaggaggacgctagcgtgactcgcgcttggtcactcgggtgctagcggtggtggtccaacgatggttgttgtgcatgatggttgtgtggggttttgattgggactcattggtaaaagccttgctaggccatgggccagcatgactacgacgacgccattaggtgtcgtttcccttcttggaggcgtcgttctggcattgacctctcgtagcagcaagaaccttccgcgtgcaacgatagcattggtggactcctgcaatgcctctgatcccctacaagcctagggtgtttgacgaggccttcgctgccttggttctgttccttgctctacggcgggtgttcatcattcttatttgtgtactgctgggtagagtcggagctgcttcgttgtaggggtgcgacaaaacttggcaacggtgacacactccaatctttttataggattgttgatgctagctgcgtgcaggaactggttccttggtagcttaggctgatgtccttcatcgatatcgtttatgtttgctccttttggagttggggtagcatcgtagtgaagtcgaaactgctgtgtcgcttgggtggcaagcttggcaacgataacatgtgtgggctattgtgtcacctatatgttaagcttggccagagtcttgtgtcgggctccatcgtggtaccttaggttaggttagctgttggtgtggtgttgtaattgtggttttcgcttagttttcccaaattaactaggcactgtaagatttggtctcatttacttcttaaaatgggacatgcgtcttcttctaaatataaaacgtcggcaatagcttgaccgtttaaaaaatattaatttaaggatcctaaaattaaggaggaagggaaaatactataacaccccttattaaattaaaggtctgttgagagtgggaaggtggttggagtatgattgggtaaaaaaataaataagagatagttggatgggataggtagtgctctaaaatccctgtttttttttataaaatttgaatactcagatttatgggatggaggaaatataagtaaatataagtttatctttcgttagatgaagtagtgctattaagcatatttttaatagaaaatatcaccaaccaatatatcctaaaatatagaaagacatatgtatacagtatataagaaaaagatgttacttaaagttagaaactccaaaaataagatatcctaaatattctaaaaaataaacaaatacaacacaaatgatatatagtttcgtagaaacaactctattagtgcgacactatattttctcatagatttaaaactgcgtgatttcgagtaattttagttcagaaaattatatttagaatagagtaaaaaataattcaataaaaatgcatccacacataaataggtatctgccaatgtgaacgggctaccttttaattttctctctacttgcatcgtgtgattacattgtatctatgtactagctagtatgcactggtggataaggggtttttactcccggttcgtaacccccatgtagtcctggttttccaaccgggactacgaatccgggactaaagatcgttatctttagtcccgggtaaaaaaaccgggagtaaaaatccatttttagtcccggttggtgttaccaaccgggactaaagattatctatcttaccaaccgggactaaaaagactagatccggttgctctttattattttcttttcttcattgtttttaatatatattgatttcaccccatcccatccccaaaatcccaaatcaatcatcctcaaattgcctccaaatccacaatcgatcatctcaaatactcaaatacatcacaaaatctcaaaaaaaaaaatacatcaagcataacaaaatacatccccaatacatccacatccacaatccacaaatcaatcacaatccacaaattaatcacaaaatcatccctaaatcaaccaacaaaatgctccaccaaaatatacaaatcattcaaaaaaattcgcagtcgccgccgcccggccgtgggccgccggccgccttgcgcctgactgccgcgcgggtcaccgccgcccggccgccacccaccgccttgcgcccggccaccaccgcccgccgccttgcggccagccctccgcgctggcctccgccgccgccgccgcgctagcctccgccgccgctgcttggggcggccctccgcatgcgacggccgccgccctctgccaccgccacccggccgcctcccctcccggatccgacgaaggggaggccaccgccgccgcctggccgcctcccgccgccggaggggagccggaggggaggggaggggggagagaatgagggggaggagagggttgagaggaga

SEQ ID NO: 74737 - DNA, 7841 bp, Oryza sativa
acgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggaggctagtgatagtcaaccctccgttggacagaagagggcacgcgggcaacgaggtgcagcgaagaagcttgagggtcggcacatcataacggaagtgcaagaagatggacgtcctagtgccccggccgaagcagccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctggtcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttagtcccggttggtgttaccaaccgggactaaagatcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttctttgtgtaacaccttgcctgtaatgattaggatgaagcctggtataaatctaaccagggctaacgtgccatctctaagagataacacgctagctccggcttgagacgagttgccttga

SEQ ID NO: 74738 - DNA, 1755 bp, Oryza sativa
catccagttgatccgtcgaaaccgtgccgagtggttggaggatgacgccgacttccctgaagctaggcgaaatcggtgttgaagccgacttccgcctaggcctacgggatggagacgctgtcgtgatggagatggccgccaaatcgtcggggagcttcatcaggattggtgggtaagccccatcatcttgatctggtgtcgttggagaagatgcgatcttgcccgagtggtttgaagccgactcgattgagatggtcttgaagtaactttcagccgcgtttgggagtccaaacgggactgaaatccggttctctcccgactggtttgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacagtagcccccgagacctttgcagtcaaccatcatagccttctcaaagataataatctgagtgcttcaaacctttcatgccaagatctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcattctagccgactgctttttagccataataaaagaaatccgagtggttaacactataaaaggttcacgaatgaacacacttgacaggcatccgaataaaaaactctaaagattacccaccaagtattataaaaattatggtaatgaataagtctaatagcctaggctatgactatttaccataatgaaaacaggcatataacataccaaggaaatgactatggtaaaaacaagtcattccaagttaacccagacagcttttgtagcctaataaagctgacaaaaacagtataacacctttctgtcgggcaccttttaatttgcattgcaataattccaaagaattatatgaccgcataaaaaggattttatcagcattgggcaacactattgtgcgcataaattgccaaagcaaaaaatgcctaagtccctaaggaacacaatgggccacgctgttaaaaatactgagctgaggtactgttcaggcctaagcccatttgcacctccgatacccttaacaagaaatcccgagatccaagcgtcactt

SEQ ID NO: 74739 - DNA, 1870 bp, Oryza sativa
tgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaatggattccattactgttgtccttatcagcagattattaaagtttggtaggaaaggtatgtagaacaaagtagatcacctaaacctttaaaggaattttttttacaataaaaagcagagacactgagaaagcacaaggtaaaaccagtgataaatcaacccagtggattatctgaaattttcttcctatggcaataagtgatgtggaattgtggatagtctgagaattcactaaaacagcatgacttattctgtagatttaattacagctttccaatttactgaagtaggtccctaaccagttaaacaaaaatatctagagaaacgttttatggaaaggagttgaactatttggctggatacattaattagcagcaagaatatgtgcaatcaattactagtaaataagaatgctaagcatccttgacagcttgacctgtatcactcaacataagtatggtcaatgaacactcaataaaaatgaattgaagcccatgtggaagtgaacatgcatgatggttttcgaacacgtattagatggaggttacctaggggttcaggtgatataatgtagatattggaccacacagtattttttttattccaagtggaaattttgtttgtccctatgtgattaacatataattgagtgagagatgcactttctgtaaaagtacaccatatttttaccataggcatagttttaggcccatgaaattgtagcgggcccagtggctaaattggttgtgcagagaaaggaaatctagatctgaacagcaaattctatttaacagatcgattcattcagtttcaccagaagacacactgacacacaggtaataccagctgggttaattaagaacgtcaatactagaaatggtttcacagttgatagtctctctacctctcttaatcctgctacagcctatgaccacacaagaattcctgttctgttgtttatgctacttaaaaaaggtaaaactctttacgaaagagagctcagttgcataattagcgcaaacaaactaccctatatcatcggcaacaccgacaatccaaaggggaaacctgtcgattatcgatctagcattctagccaccgctgaaggctagatggaaactcatcagtagctgttggccacggaagacaattttctcgttggccttctcccccgtgtttgtcagattcacggccaaaatgttatatgatatttcctatcagctctgtcaggtcttgacaacacatcgaggggcttcatccggcaccccaatttcaatcgaaccccaaatcctccgacggctaaatggcagactcgtgctcaacccaagaaacagcctaaaatcaactgggtagaaagcaaagaagcgcacatacacgacacaattcgcagcgcaaaaagaagacggatacctttgaaggcaccacggatgattgcagccggctgccaagaaacccgaatccgactcccacgacccaagaatgacccgggggcagcaatgcaggtttgcagggtgggacggggggctgctccgatcgcttcgttcgtt

SEQ ID NO: 74740 - DNA, 5758 bp, Oryza sativa
ggatccccctttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccacttccacgacgagcaccggcctgccaatctcggtgaccttgtgcgccgccaccccgccaagcctctcgcacctctccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactacttcgtctacaaggtgcactctcactctgaaagcgcaaagctgcaccgtctcccgagcccacgtggccgtggctttgcagacgacaacattgccatactgagctgcggcaacgacgacgacgactcctacgctgtggccgctcttcaacccttgcatcatgtccacttcaggcttcacctgtgtcgctctacccccgatggaaagccagggagttggacctcccatcagttgacagtggaggagccgctgaggggaacggtgtgccccgtccctgactcagcactgaggaggatcttccatgccaccaccaaggtgattacgcttggaggtgctaaaggtacagttggctgggttgatctctggcgaggcatccttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgttacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaaatagagcaagactgagtactacccactgtactcagcaagtcataccggaatagaggtatgatgcagggaatcatcaaagaagagctaaagtggttcatttgcataaagcgagcatttataaacagagattgaaaaactccccagttgtagattaagcagtattatcatcaagaccacgacaccagtgcacaggcccaccaccacgaaccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgattttccccattgtgatctagttgaactaagcaaggctaagcaattcctagtccaaactctaatcatgttataacccaagctaacaaaggagcatggtatccaaaaagcatggctgtaacaataggtaaccatcccatagtaatattataaaacaatgcaatatttgaaaggaaacaattgagcatttgcaatataggatcaacatgttcaagtgacaagcatgacttgccttgctctgctgctgggggaacctcggcgactatctcgaagtacaccggagcgtcggagggatcggaatctagcggcatacaaagcaaacattgcaaacaggctataagactactgaaacagagaacaaaaccatttttaatggattctacacatttttcttgatttactgagacttgagtgcttgcctccttattggtaaaggatgcaacggtacgagcctatagaacagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattagtctcgttttccaattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaatggagatcagaacaaaagcagtttta

SEQ ID NO: 74741 - DNA, 892 bp, Oryza sativa
atatctttccggactcggcatttccttttctcattttgattcctctgtcctggcactggagttaggctgaaactgtaatcttggcgaggatttgtgttgccttgatgcttctttccgttgaaactggcgggttggttggccatcttcttcgtcagcagaaaactgaattgaaaatcttttggtacatgatcagttccttcacaaaagaaacaattgatcctgctcgttggacaccggtcgggtggatggtcttcctcacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcaatcactcgggagcttgaggtaccaatgtcctgacttctgaccttattgcctttctcattgtcag

SEQ ID NO: 74742 - DNA, 5482 bp, Oryza sativa
ccaagcccagaagaggagctccttgaagatgaaggttttggtgtctagctcgtgcctgccgtcaagcgcctgtggtcgtcgccctagtcttccgctggttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgacacaacgtcaccttcagccatatgagtgaggtgattgacggctacgacaagctgctcgccatgctccacaaggcgaccaagaggctcaacgatcagaagcttgtgaggatcgctgagttgcaggataagaacgctcgccccaagaaggaggttgccaggcttcagggacgtccaccgcctggaggagcccgcatccgcaccatgtcgaggaagtcgaccatagctctactgcgcatccagcttacacccaggaacccgccgctgcctccacctccagcacctcccgtagctccagctccagcccttgttccaatgccagctctagagtccgccctctcctttgtgccaaattcagcctacaagggtccagcaggtggcagtggaggatggttgccagcatctcccagtggtggtcgtgtgatcatcagcagttccagctcagaggcaggcagcggtgacacctatgagcaggagtactccaggagccgctcagagggatcggacgacgagcaggaggacgccttcgactccacctaccgcaggagccgttccgagcattaggctcgctttccctagtttatcgactgcttagtagttgtttgttagtttgtgtgtttagggttgttcgcttgtgggttagtcgatggtcgatatcatgtacctatgatatggctgtcctaataaggatttgcttgctgttttaagtgttttaattcatatcagaacaattgcagtctaaattcctatataataaagcttagttcctaagcatctgtttttcttcttttctatcccctccgtctgttcttccttcagatggtcaacaccaggaatggcggtcgtgcagctggtaacagaagcaacagcgaagaacgcatcgatggtgggcaccccaatagcgcctgcggcaatggtccgccaccgctccccgagaacccgatgctcgcacaagtgatggcccatcagacccagatgatgatggccatgatgcacagatgcagcagcagcccctccagatgcaccagaggatgcagcagcaggccgatcagcagcaacaacagtttggtccccctcccccttagtccaagctgcttgaatttatgcgcgtcaggccacccaccttctctagtactaccaaccccatggaggcaaatgactagctccatgccatagaaaagaagctcaaccttctacagtgcaatgatcaggagaaggttgccttcgccacacaccagctctagggtcctgctcagcttggtgggacaaccacatggctacccgtccgccaggcacagatgtcacttgggcggagttctatcgcagcttcaagaaggcgcaggtgccagacgggctcgtggcacagaagaagagagaattccgggcactcaaccagggcagcaagacagtgacttagtacctgcacgagttcaaccgcctagcgtgatacgcaccggaagatgtccgcactgacgcagagaaacaagagaagttcctggtaggcttggatgacgagctcaccaaccagctgatctccagggattacgcggactttgagaagctggtagacaaggcaatccgacaggaggatcagcgcaacaagatggatagaaagaggaaggccgctcagttcagggcccatcagggaggtcaccagaggccacgcttcactcccggacagcagggtggacctaccaccatgattgtccgacagcaccaccccaacccttccggcaacttccaccagggtgctagtggcagccaaaaccatcagggaggtcagcccaaccatagtgcagctccacgcccgccaatggcaccagcacagccagctccatcagctcaagccaagaaggagaccagagcaaagccagggccctgctacaactgtggcaagcacggccactttgctgacaagtgcccaaagccaaggcgtgccgggccaaggttttttcaagcccggcgtcaaccatgcgtccgcagaggaggcacaagcagcaccagaggtcgtactgggtacgtttcctgttaactcaatccctgctacagtaattttcgattctggtgcaacacattcgttcatttccaagaagtttgtggggacacatgggttgagaaaagaagagcttagcacacccatgagggttcataccccaggaaatagctcgacttctgtcagttatagccctttagtgctaatagaaatccaaagatcacaatttcttgccaacctcatccttcttgaatccaaagacctagatgtcattcttgggatggactgacttaccaagttcaagggtgtcattgattgtgcaaatcgtacgatcaccttgatcaatgagaagggagaaacagtggtgtacaagtctctcgcctcaccaaagcaaggagcctcactgaatcagattgaggtggaaaattcagtgaacgcaaaggagaagagttcgaggaaattggaagatattcctattgtctgcgagtatccagaagtgttccccgaggacctcactaccatgccacccaagagagagattgagttccggattgatttggcaccggtaaccgctccaatctacaagagaccgtatagaatggcggccaacgagctagcagaggtcaagaagtaggtagacgaacagctgcagaaaggatacatccgaccgagtacttcaccttggggtgctccggttatttattttgagaagaaggacaagacgaagaaaatgtgcgtcgcttatcgcgcactcaatgagttcacaatcaagaacaagtatcccttgctgagtattgatgatctgtttgatcaattgaaaggagctaaagtgttttccaagatagacctgcgatcaggccatcaccagttgagaattcgggaagaggatatttccaagacagccttcactactcggtatgggttgtttgagtgcactattgtcctttggactcaccaatgcaccggccttcttcatgaacctgatgaacaaagtgttcatggaatttttggacaagtttgttgtggtattcattgatgacatccttgtttattccaagtccgaagaagatcatgaacaacatcttcgtctggtactcgagaagttgcaagagcaccagctttatgccaagttcagcaagtgtgacttctggttgtcggaagtcaaattccttggtcacgtcattactgttcaaggtgtggcagtggacccgtcgaatgtggagttggttacaaagtggaccccacctaagacagtgacccagattcggagtttccatggacttgctggttattaccgtcagttcattgaaaatttctccaggattgccaggcctatgactcagttgcttaagaaagacgagaaattcaagtggacagctgtaacaccctgaaaattcgacaaataaaatgaaacccgaaattgagtactttcaaaaacttctaaataagtttgcatcatgccgatgttatttcttttgttgtgcatcatgatggatgttatggtcgttattgcttgccaaaccataaaacgtcacaattgaaaattaagctaaagctatacaactacataacaattataaaaataagatatttattatgaaccctgtaaatatttatgcacaacacaataaagccatacaaagagaaggttaattagtaatttaatttataggtcacattagaatattccaattaattttagaaatattaaagccaccgagttatataggatgaatttaggatgatataaagtaaagccaatttcatttgggaaatgatgaataatcaaataaacaaatatttaaataaaatatttgaattccccaaaccaaaaagtataggttacatctcaattcaaattccaatcccattcacttttgcagtttagcccctccctattctcgtttttcctgtttttccttctctctcttccactcggttactgttcatgggccaccaaccgttcgatctgggattagcccagaccgaactcttcccaacccagcgccgctcctcccggtcgctactaagccgcgcacgcaccttcccaacctgtgcgaagcattttgtgtgaccgtgcgccgcactgcgtcgcgccacgcccgcgtggtcccaccgcccgaccgagccaccgggttcccgcgaaagctgcgctgccttgagcaatggcatcatctcatcccatcgcgagtcgcatcgaagttgagggataatggccgccacgtcgcccggcgtcactgtagaaaataggcctgcacctccctatcggcggccgttaccactgcccgtcgccgccaatcatgttgccatcgcatcgccatctcgtcgcccctagctgagaccgctggataaagcggtgcccctttctccagctagcgatccctctcctgcgatactaccgcgtaggcaatcatgtcgcgcctgtacattgaactggaacctaggtgagatcgaacctaggccgagtcatcgattatgcttatccataagggatcgccttcctctcactggtataagctcacccctagctcgtcctcatccaaaatcaacccctcatttgcttcccttctccccaaagctcttgctccatctcagagaaacgaaatcatgctgccgccgggtgtcgaacacttggtgggcgagggctgccccgccgccacaaggcctctcagcctgagttggtgcggggtgtgaaggtaaggtgcttgcgcttctgatgccgccgtgaaggagccaggagccgctggacgaggaggaccgggagtcgagtacctacaagcgtcgtcgatcgccgtcgtcgatcgtcgtcggtgaggcctcccctcctccctttttctctctctcccgtgccgctaagccgttgcctagccgcctagccgcgccgccgccgcgtcgccgccatcggccgctcgccgttggtcgcgcctccggtcatcgcccctagcgccgagccgccgtgcgccatggctgccgggccggcttaagctgcccgcgcgtgtgcccttgctgtgcgccgcatctgccgtccgagggtagatcggggccgtccatcgccgccggcatggcagcccacgtgtccgccacgtcggcgccacgtggtgctcccttcccctctcctgtggactcggtccaatgtgggccgccttgtcgcgaccggaaaaattgccttttcccgaacgctagtgtattaatccccgtcccaggaaaagccggggtacacc

SEQ ID NO: 74743 - DNA, 4597 bp, Oryza sativa
ccgccaccgtgtccgccagctcgaagtgctcggcgatggtcttgggctccttggaggcaatcttctctagcatgcagttgtgtcgcacgccgttctagaacacataaacgaccgcgtgggccggtatgcagggaatagtgttgcggacctggcagaagcgctgtatgtatgagcggagggactcgtcgtccttccgttgtatagcgtgcaggtctgcctcctctcctgggcggggatacgtgccttgaaagttcgtaatgaactgctggcacaggtcctcccaggagtggatggagtcggggggctgagtcataagccagccgcgcacctgacctttaagagccatggggaagtaattcgccatgacctagtcgtcgccccccgcatcatgatgatcgtgctgccatcatatttctccgtgaggttggggcgaaacttcgggggccaccggactctggagactcgccttgaaggccctgcaactggtccctccaggggtaaatgtgaggggcgggccgcctcgcgtggaggagcggggcactccggatgaggaggcgccctccccatgcgggccgcccagtgctcgtccctgtgttgctcaatgttgattcgagcgtccctcctcgtagaggccaccatgacgtccccggcttcccgagatcctcgatgacgttggggccgtcgaccacctcgaagtcagggccgaccgacgggccctccttcttgctgacgaggaaagagcggtgggttacgcgaggtaccagaggcggcgggtcggccacccgcagcctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtgtgagagctgggattgtacaggttcgggccgctagggagcgtaataccctactcctgtgcgtgggatttagggttgagtgttacaaaggtttctaaactccagggagaactcttactcttcttcctctggggcttaggctaagtgagagtcatccccccttttcagtgggcaaggtcctccttttatagttcaaggggataccacatgcaccgcctctacctactccttcaagggagggggcccacgccgcttggagcggaccaccattcgtgccttcaccggaagctaagcagccgtccgtcctcgagtggggcccagcgccgtcccctgcctgacacgggggacgcccttgtcattcccctttaagtgaatggagacttttggcggttcacctcacgtggagggggctctagacgatgcattgatgggacggggcatacctgcccccactccgccgagcacagggcggaacgtgggggcaccgccgcccgtccgattggatgtgatcggccacagaccggtcacgcccgattgacgcgggtcaatcgggcagcgccgcacgtccgccctcaccgcattaaatgcggtgtgggacggttggggtgctattcattgatggcggctcagattcggccaccgccccactcactccccccgccacgtggcggccgggcgagggcctcggggcgaggcagcctgagggtcaaaggggcgtgacgtggcaccccgaggccccctggctgcctctgcgtcgtccgagatgtggggggagggccaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttgagcagtgattggttaatattgattaaatactacaactgtttttactgctttcaactactgcttttaaatgcaagcattatgcaaatgaaccgctagcctcctttggttatatcttgcatcatacctcctcttccggtatgacttgttgagtacagtgggaagtacttagtcttgctctctcttccccacaccagagttgaagttcttcttagttggagatgtctcgaagaaattggtttcgtcgctgccgtcaaggatgcatgtggagtcaagtcttcaggcttagctggctttcatcttttccgctgcatttgtaatcttttatatttttgtaaaacgtggatctgtatttcaacaattgtcgtttgtataccctggctggttctggacatgggtttaatgcacattcagcttagaaattctggttcgtgaatttctgggcgtgacagttgtccatcattcttgacaagatgtagtgtacaaggcattctttagttgagcctcgctcactttgcatcacagaagtataacctagacataactaattcagtatagaagcaaaatgtgcagcagcaacaataagggtgaaaactagaaagaaggatttatgatgcttcttagtttattcagtcacgaaagagtgactttaaataaatgtacacttcttccaaagtgaaaattatgagatgtcttacttatggaatgctcctacacactaaggttgtgtaatgccccgagtttcgaattagtatatttcggggaatattagaacaaatgcgcaaaagttcaatttttttaaaccgttgttcgaataggcgatcaggaaccatggatgtatagagctcgtcaagtagtgcaaaatatactaagtcccggggattgaaacaatgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaaactgtcgacagcacactagctagtccctttcttgggactagctattctatgagaagttcattctaacatagcaagtcgatagtttactgcaaacaaaatggataataaacatgatgtttcaacaaaactagaggaactcacgcatgatgtacccaaaggaaaccggttcttgacacactacaaatctgtggtagttcttttctatctcgaaaacgaatcaaggctgtgtttggaatcagctgttcccaacatgcaaagtgcgcatggaaaacggagcggtccattagagcttgattagttaagtattagcttttttttttcaaaaaatggattaatatgattttttaagcaacttttgtatagaaactttttgcaaaaaaacacaccgtttagcagtttgaaaagcgtgcgcgtggaatataatggagatgggttgggtaccctggattccgaacacagtccaagtctatccaaaaagtttagacaagaaaacacgtaacaagttagtttacaagaatacgaattacgtcaatcctgcactacaagtagagcaaaatggtgatttcttgtaaatctctcgaatggtgatttaagaattcagtgcaaacctaattcttgctataaaatcaaatgttcggtaccgtatcaacggaacaataaaaagcacttggcgtaccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagtgagcgatgagtcatatcatt

SEQ ID NO: 74744 - DNA, 25207 bp, Oryza sativa
ggggggagggggggagccgacggcctcccgtggggcaggagtttttgcgtatttggttgttctcatgttggtgtgctggtgctccttggtgtcaaattctactgcctccttgggttgccttggcgtcatgcagtagattcgtttgccgaagatatggtcggtaggtatgagatggagttgtgggattggtgcatacaaggagggtttttggatatgcttgctttgggggataatgtggtttgagtggggccggcagtattgatccgttacgccacgccaaggacttatgtttctggctgttcattagcttgtttggtcaaattgggtgttgagagtgatgagcattatgtagtttattatggaaaagagggtttggctgatcgacgaaagcaggaaagtaatgagtctttttgttggcccttttttttaattactctgaatgttttcctgtcaaataaccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccataggcatcaccgtgaaagaagagaacacagagatcgctctgatgatcatgatcgccacagaagccgtgattctgaaaggtattctttgttaagggagttctgttttatatgcaccttatttcttacaaaccatgcatccttgcaatgaatgcattttatcaaatgtgttaaatgcttttagatttagagctattcaactgtcttatacatgcctacatgattagtcaaatgcccacaccaatcttgtggtttatatttaatacaggagaagagaccatgaacgggatgggcgtcgcaggcatcggtctcgctcacgctctcgttctaggggcagggatcgcagatctaggtctcgctctcgttcaaaaaggtatgtaaaggaagctccttgcatagtcttccatttgcatcttctttagctgccgtgcacatactatgttttccgtcatggttagttaaattgtttattccatatagtagcaattttggacatactttatatatgctttctctgcatggattattttcctgatattttctttgtgtattatcaaattcagacatgtacaattcgtatttgaatatgtatggcagtatggtttactggcttagtcttcttaatctggttctcattgatgaccggtttataacttgttaaatatgctaattttatgtgttattcagctttactttttaagttttattttatcactaaccactaatatctactaaactatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcattctacacataatagtaagaggacaggagaacaagcaaattgttattttatagtagtctacatgatgcatttggagagacattggtgctttaattaaaggataaaaaagaataccaaccagtgggctccgtaagcacccctcaggcacctatctgctgcagatgcacttcatgtgatagttactaatatgaataagtgaataacttgtaagtttccattttattattacttggtaactggaaactgagcaaaacttttttgcttgtgttcttttgttgtttgtctgttttgtgtatgtgtatggtaagaaggcaatcttgggttacttgcccccactgctgccaatggaatgagctgcctactgtagctttaatgtacaaggaggaatcagtgctctggtttgataccatcttattcgtcttcaactagcaagtattactggttgctagcattatgtctattatatttgtccttgcacatattttgttcattcttaggcttggatactgaacagctagatctattttagacccagactgatggtgagaactagtcagttctaatggtggaatttttttccttgctaattgtttatgctctgtactagaaatttattgataaattgcaggtcagtttccgggcactgctattcctggaatgtttccaaacatgctcccgatgggtgttggacaggtaacctgtcagtattttaatgtattataagtgccaaaagaatcatttttttatttatgtttgtaaataatttttatttgcctgtaataataaattttgtttgaagcagttcaatccccttgttatccagccgcaagcaatgacgcaacaggtatgagttgttgtgacatctactgcatctattattgataaggatgtcaacaaaataatgtgttaacacctttttctctcaggctactcgacacgcgagacgtgtttatgttggtggacttcctccaactgctaatgaacaggtctgtgtatttaatcactcattctttcttactgcccatttcccatacccaaaccaaaagccgtatgggagtgcacgagtgtgtacccgcatgcaacatattactgtggaattgttacattagtttcctttactgcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctggagggctagaaggcccagatcgtattttcgtgggtggccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagcctgtgctgctctgaatggcatcaagatgggagacaaaaccctaactgttagaagggcaaaccagggagcggctcagcctagaccagaacaggaaagtatcctgttgcaggcacagcaacaagtgcaattacaggtataggtctcaactatttttcatccagtatcagataattttactttcttatgccaactattttgtagctgtattgtgattcttgcattttgactctgtgcttcttaacagaaacttgtatatcaagttggagcactccctacaaaggttgtgtgcctgacccaggtggtttcggctgatgaattaaaagatgacgaggagtatgaagacattatggaggacatgagattggaagcaggcaaatatggtaatttccaacttctcacccgcaatttcctcccttgcctctaaactccggtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttgggggatcactcgatcccttgcaactccagaacataagattctgcaatgccgggcgatcttgttcctgttccttgtcgcaaccgtctcctgtcaaccagcttgggtatatcacaccaccgtaatccctgatgcaaagtactgtaatccccgacggtggacggagcccctcaagaacctcctcctgaagttctggaggttgatgttgcttgatctctgttacaggtggaaagaacagcttcttgtatgactccaacgctttcttcgagcagcgttcgtcagtgccaccccaccgtagcgtcagctcagtgagatataccttgtcagatagcctggctcgaacagcttcctccttgctctgaacattctcgatgcagtcgatgaacagcttgccacgaaggttgttcaggtgctccagctgctgtatctcgtatcctttctccttcctcacgtagaagtgatacagagctcggagagatgtcagcttcccaacatcaggaatgttcaggccataccatgtcagcatgtacctcaggttgatcaggttggcgatcttcagctgggatggacaatgcaagcgagtgttaggattgacagagagctcctgaagatggtaaagcttggaaaattcagccggcagaatcaggctgtggggaggaggtgacatgatgccaagataacgaagatgtttcagtccaccgatgcatggtggcaccctgctcaaatgtctcaaatccaagtgcaccaccctcaactttgttagcttcttcagcacacgctcaaaatcatcttggttcattccctctactgaatagcacatgataagagttctcaagtttttaagctccaaaatcttctctgggaacaatatttcactgtgactcgatgcaaagatgtcgaacgtgtttagtgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggttgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcacttggaacgtgcgactcggcgatggatccgtggtccggatcgcaggacggggcacaattctctttgcctgcaagaatggtgagcaccgcactctgtcgaacacctattttcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctccaccaaagatgcggcgccggctgccatcaagcgtattcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaataccgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcggctatgatccggctactcggcgtgttcacatctcccgtgacatcgtcttcgatgaagcggcccagtgggactgggatgctgaggcggccgctgatctcgacaccgacttcgtcgttgagtacaccacggtgtaccatcctggctcgctgtcaggaacacgccaagacgctggggagccgcctgctcgatcttcatcatcgccgcgaacgccatcagactcaccgacagccggccgaacaccttcggtgcatggcgatgcgccggcggttgaatttgtgtcgccaccaactggagcagctgctaatcttgatgcagaccacgacgacgcaccactccgtttccgcacgatggacaatgtgctggggctggccatgctgccaggtctcgctaatcgtgaggtccaggaagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagagggctggaattgactttgatgaggtattcgctcctgttgctcgtcttgattctgttcgtttgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggacttcgccaagcacccagagcttggaacaccaagctagactgcacactgaagaaacttggcttcaagcagagcccgttggagcatgggctgtacgcgcgcggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaattacatttcattcgtgaagccgtggagaatggggaaatcacaccgagttacatcggcacagaagggcaacttgcagatatcctgacgaagccgctttctcgaatcaagtttcaggagctgtgggaacaaattggtatgtttcctgtataatcggcacatcaagcttagggagagttttgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgtgttgtgttcgtctggtttcctgctagtgatcgctggggaaattcctaacatttaggaagatgttccgtgatgcttttctcgatcttgacgcagtcgcttcccgcgatcgtcttcgctaattcatggaacatgtcatgaactgtgaagtactcaccggtgctaatgtcagagggactgaccaacatcttctacgtcctcattgtttccatcattgtccttcacaaattcttgcgctatccacatacgaacaagattgtcacgttcaagctcataccttctggggaagatgctacagtactggaagcatctcctgacatccacaacaagttgattatagctccaccaaagagctcccttggtcttattcagcacatcgaggttcgcggttgtttgccaaaatctgatatctgggtttctccagagctgacctgccactgtcactgctgcaataggtgatctgttcagcttcttagcgattttcctcccaatcggtatgtattctcgatcatcgaaaattgtactgtcaagtgcataatgcatgaacattgagaagtattgctcctcttccagatcagatattggaataagcctattagagcctagagctgcctctttactctgggctgtcaccaggattctgcttcctgacttcccaacattgagtggagaaagcagcttctcatgattctcatcattgacccacagatcatccagtaccaacaagaaccgtttgcctctcaaattctccaccaattttgcttccaaacctctgcagtcactaatttcagaatgccggctttgcgtgatctcctcgagcatatcacgaaatatatcttccagtctgtaagtcttagaaacataaattagcatgactgtgtcaaagtatctatctttatcctccttttcatactcacaaacatactgtgccagtgtagtctttccagaccctggaatgccatatatgcaaattacagaataacatttcctgctactggagcttggtaaagaatcatcctcacgaagcatacttcttatcatatcacgctcccggtctctaccgaataccttgcgtgtactactcgatgtaatgcttctcctgttcatgttgacaatatcattccaggcaccactgcttgtctgtgttaaatagggagagttctccacgtttgtgacagtgttttctagtttctctattcttttcctcaatttccatctagcaatagcaggcatgaaagaatatactgctgtaccatcctccagctggaagaataaagaacaaaaaaaatgattagaatggaatggtggaggaatgtgcatactttccaagctcctaaatggtgcattttttgcgaacactttctatatacgaatttattaggaaactcttttaaatccatttccactttatagtatcaattcaattcgtatgtacacttgaataattatctttaatcattgagctattcaaccaatttagccattcagcacaaaagaacaggaccatgtgagctacatactgaacttccttaaaaaatatatatatactgaactagttctactctctgacgactgttgtcccctgattaataatagatgttgttttcttctaaattagtgcttctgtttagaacatggaaattttttcttgttacttcaaaaattgaactattagatgtagtaacattagtggtgtctcaaacactaagaccctttaacacattccagcaactattgatttccgaataaaattgaggagcgcgacataaattttaccaagatcatagcccgtgcattgtaactccttttgcatagtgtattagtgttgatgcaaaataggaacattcccctagattgagagaagatgcattgctagattggggtggggtgtgtgtgtgttagggggcagagaagtggtaaccaacctggtaacctgtggctgtgatgccagttgcatcataaaaccaatctcgataagagcgagcaacctcaaaccagttgactgaccagatgaacagggattggcagcatctgatgaaatcaaattgcctggacaagcaactaagccgctccagcaaggagtcagaagctgacccgcagcatctgctacaagaaatcggtagcagcgcagctgatctgctgcgtagcgatcgatacaaaccctgtgcccactccagtagagtggttatgcatctcccaatccagctcgtcttgcaagcgtggatggcatcgtcgatgtgcggatgccatttgctgctgcttccctgtggctcgtcatcgccgatgacatccttctcgatctggtgataagcaatgagatcgaggacgtcttctgcttcgtacaaggcagacttgaccagcttcgccagcgtgtcgagattttgcacggctgatctctccttcttcgctttcctgtgcatcctctcttcctctatctttcgcagcatctgctccagcttcgggacagtctgaatctccagctcttggatctttggcgaagcgtcgaagaggtaggagatgaacctgttcacgagcaagctgatgataggcgacagcaaccaacctagcacggttatgacagagcccatggctgcaatcctccatggatttgccatggaatgcaagcttttcgatctccttcacaaaggggacaaagttaaggagcagtgggaagaagaatggagctctactactgtcttggtagcaatctatctatcagcaaactatgcaaagcatctgtcttctagcgagctcagtacagtgcaaaacttaattaagcagaaatttcacccgaaatttcttgcgaatcatcatttttttttcctgcaagtgtcattactgaaaatgacttgaccacatagcatgtggctaaccgactaataacatagtcagacttgttttcgaactaatgcatatggttagtacattgcattacatagcttccccgagtttgcagctggctgtctgatatgatgtagtgtaacctgcacgtgagtccatgtgacatgacaatcacaacactatattatgactattattaacacaaggatcagtaatacgaagagtgacagcagtaattggccaatgattcctctctgggttgtcaaactaatgttggcctgattccactctcttcaatttgttgtaatgattcgttcaaaaaaaatgttgtagcaatgaataaagaagagccaggctcttgtttcgaattagagaaatatatataaaaaaacagctcgttaaggagtcacattagatcgttccttttggaatcaataataatcattgactattaaatcatagtcatgaggtacagaatattaatttagcctaaataagtactgttggatttgtctattggtaccaagttttttctggcagtctgcatctatttatttactagcaaaatacccgtgcttcgctacggtgtattaaaactaaaaatatttattttcatctaaagttattttcacactgttttggtactttcgctcactagaaaaggtctcaaataatagagagaaatataatagctcataataaattattattgcaacggaataattttaactaaaatcacaataaatattttaacatgttgaaaacaatatatttcttgtttaccagatttaacattaactaaggttttatagcaattaaaaaaaagactaactttctcttggtggctaatttttatttttagttttttttctatgaattagattggagagaaaaggaaaagggaaaagaacagtagatgataaccagaaaaaagaaagctaaccaaagtgatcaaggaatcggacccatgacctgtcggcacaggttttctaggctaaccaattgagaatcatggacgttttgacatgcactgcattatatagatattcacctgaacagcaaagaaaaatatcaccccacctcctctcgaaccttatctcttctctaggagaaattagacattctgccactcctaagagtgggtttcgccacaatgccattctgcggaatggcatcgtaaaataccactttcaaccgatgccaaaccgttgctttgccatattcgccatttcataagattttcaccttttttgcacttcaaccgaccaaaatacccctctctggtttctttctcttctccggtaaacatgtgggatgaggagaagaccacgacggcaggggtggcactaacctcaggctcggcgccgccaccgccggagctctcctcctcgtcgtccttatcttgctctacaaattcaagaacgcaatcttttagctcaaaccacacacaatccggagagctagcgagggcgagcgcgagggttccggctcacctcccgccgccttggtcgccagcgagggcttcggctcacctcccgccgccttggtcgccggctcgtcggtctccatccccgccgcagtcaccgtgccaaccaagcccgagacggcgacgcaggtctcgtcctgccatgagctcctcctggagctagccttcttgggccatggtggcgggcagcctgcgacgcgcggcggagacgacggcggaggagatggtggcgagcggcgcacggtggtcaacgggagaggagcagcgtggtgaccggcgggcgagacgatgcaggagattgtggctcatgacgcggtggccggcttagggtttccttctctttctccgatgtgctggcagcgggcttcgaccatgggggcgggacgtcgctggcggtgagcttgggcgtcggcggcgcgccggcggcacgaacgactcggttgtgacgaccggaggggtattttagtcagcctgggtggaaaaataggtggaaatggagagaattggcctaaatggcaaaacaaatgtttggcatctcttgtgagtggcattttaacgacgctattccggggaatggcattgtggcgaaacccactattggcagtggcataatgtccaatttctccatctctagaatcctccgccttcgcttctctctcgtcgctctctctgtctcccagtttctcctccccagcgacagcgacaaggcgcccgctccctccgtctcgcctccctggccccctcctctcccatctccccctcttcctcccgtctcctggcaaggcgcggcgacgggaaggggacccaccgccagcgccgtttccccacagctattccctccccttcctccaccctcatccctcccgcggcaggcagatctggcggtggcggtggcctcgcgacagctgcgggtggtggcagcagtggctccctccgcccccagcagccgcgggtggcgtcagcggcggctccctccgtcccctgttgcctcccccctcggttgaaatgacggcggtagcgggcgccggcggcgcagctcggcaagccactgccagcggccactcgcgggatgtggccataggaggaggcggcggcagcagcaaactccactcgatttttcattgatttggtttttttatctccgtttgctgttcttctattcttgtatttgggatctaacacggattaaaactttttgtgttatttgacgcggactcatgtgtatatgcttctatttgtgtgattgaattccgattaggattttttttggttgggggatgatagaattccgactgagattttgggtggggggttggatgaacgaaaaatttgggtaccgatgatgtgacgaacagaaaattacgaatttaagattttaccctcgttgccggagcgtgctaggcgaggcagccgccgccttcgtcttcgacgtcctctttagacgagtgatttggaatggccttcggcccagcccaactccctacgtaatgggcccttcttttatgaacgggattgggctgtgttttacaggccgagccaaatgcagtttggaataagttcatataaggtccgttaactttacaccgaatacgattttcgtccttaacctaaaacaagatacaaccggtccatgaactgttaaaaccggtgcaaacgaggttcctcggtggtttggaagacggttttggctgacgctgcgcctaagtgctgatctgactcggtcttcgtcccacgtggcattgacgtgacgcttacgtgactattttatcctagaaaaataataaaaacggtggtcccacatattagctacaccaatttttttaaaggtggagcccacatgggccccacataatcattcacaccccctcttcttcctcctctccccagctcccctttctagtttcttctctgtgtcctattcctccccagagccggcggcattcatcgtagcaccacggcaccctctctccctgctctacctcttcggcttctcctctccccgagattccctgacttggtgccaccgacgaccacatcgagccaccatctgagccccatgggagcactgcatcccaaggcgtcaacgacctgcataatcccgatctataccagcaaggatcctcggatccatacaagcagtgcctcatatttttatccatctctccttccaactattttttctctctatttttcttccgatctcttctcaagatttgttatatttcttctaatctgatctgacatgtgggtctcattattttttaatctgacatgtgggccaaaatattttgttttattttttaaaatattaaattttgcttcgtgtgtcacgttaatgccacgtcagatgaagaccgaatcaaattagccatgtaggcgccatgttagctaataccgccatctaaacggacctatattgcacagttgaaggaccagttgtatctgattttcggttgattgacgaaaatcggattcgttaataagttaaggaactcaaatgaacttattccaatggaatttctgcaagtcgtccgagggaaaagttcgataattttatgggccgatatagatcgacgtggaccaactttgtcaactttgtgggccgatatagatcgatatacatgggctagttagttagccgtggtaatgggctgggcttgggttatactaactgagaatcctttttatctcttaaatatctgtctcttctctacttatctctactattataaaaatttaaaatgctttaactggtactttagtgtgttattcgtgtatgagtcggtttttaagtttgttcgcttttataaatacagatccgtatttgagtcgggttttaagttcgttcgtttttagaaatatagaaggagacgtataagaaatcctttttaaaaaaaaaactcgcatgctaactttaaatgatcataatcctaattacagctcatgattttttagaaaaatatatatctaagtgaattatcatagtgaatttcactttaactaaaccatataataataataaaattaaaattagccttcaactgttgaaacgcacgggcatttttctagtattataaaaattaaagatgtttccgctgatattttggtacatcgttcgtatttaagttggtttttaagttctttcacttttaggaatgtataaggagttgtataagaaatccttttaaaaaacatgcatgttaacttaggacgagagtcggagtcctagttgcttcagaattcttaccaaactataagaaatcaacgtatatgatatgaccatcatcccaataaaaattccaaattagatatcaatactatcaaaataaatatcccatatactttttagaaaaagaaaatataacaacaatatgattaaaaatagtctttatccgttacaacacacgaatattttttctactaaacgaaaacaaagaaatctacgtaacgggagggatcccctcccgtgcaagtacgtatccatgttcccttgcttcccataggcaactgctccttctccctcttacttttagtggaagctactcccgctactaaccatgggtataaaaaataaagattaaataaagaattatcgtaaaattataggtttagtgtcaatttaatcacaaaactataacgcttcactggtggagtaaccatctttcgtcggtcggccgatttccacaatagtcccggttgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccccctgggatctttagtcccggttggtaacaccaaccgggactaaaaatcgtaactttagtcccggttggtaataccaaccggaactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttacaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaaatagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacaggatgctgagacaccccgccgatggttcgcagtggcgaaacatcgagagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtaccccacgcaatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaagtaaagtatgtttcaatgcttggagagcatcaaggtaccatctggatactccacgaatattaagccaataataagcacgaagaagaagaagttcacaaacctaaagtctcatgactgtcacgtgttgatgacacagcttctaccaattataataaggggtatcctcccagtcaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataataatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggatgttgttaaagataagatctttactcgcggttgttgatacgaaccgggagtaaagataactctcaccaaccgggagtaaagatctgggggtatatatattcccagtgcgccctcgtcttctctaccaacattagacgtttttcctccgatcggcttctagctccttcgccgccactgcctaggcatccccgtaccgacaccgccgtcgtttttcgccatcgtctcgaggtcctcgccgcctccgccgccgacgccgccgccgccgcatctctcgggtgagagccgccgctgcctccctctcttttgatctcgatctcgatctctctctctctccaaaccgccaccgtctagctcgttgccgacgccgccgacgacgtagacgcgccgatgccgacccctactccgcctgccgccgatgccaaccccgacttccacgcaaccgtcaccgacgacgcc

SEQ ID NO: 74745 - DNA, 33481 bp, Oryza sativa
  unsure (1)..(33481): unsure at all n locations
taactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtatgtacatacatatcttaattagagtttttaccaacataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatccttagtcccggttgttctcaacaaccgagagtaaagatcttttctttactcccggttgttctaaacaaccgggactaaagatatctttagtcccggttgttgagaacaaccgggagtaaagatccggggtatatatattctcggtgcgccctcgtcttcttcaccagcacttagacgttttcggccgatcgatctctctcggcctctctccttcgccgccacgagacgctcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcatttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctcaatgacattccgacacgaagaatggcagtaattaaagtgctccctttttccccttggcaatgtgctttcgttgtactcttggaaatgatatgttatacccttgtatggtgctagataacccggcctatttgggtatcccgagtctacgagataaaactttcctggaggtggctttggaaacttggcactaaatctagtatgtgcatcattgaataccctcatgtcatgaaccgaaccaggccacccagcaagcacgaaagtaaatctcatatcgaagtcacagacacacataacattctgactcttctccttatgtctattcctatgttgaacagcagctgaatttggcaccacaacttggatgtgagtaccatctattgctccaatgcaattatccaaatatggtgtgtactgaggagaaagcaatttcttatggaatgttgtgaataagggatcttttggcctaatgatatcttgtgcaagtttcagtagagcggtcaaaactgctttgaacttactatgtactgttttaagagacctaacaaatctgtcttgggcttgcctaactgattggggagcacctactatccataaaaaaagacccaaacactccatggaatccatgttgtttgtggacttcaactcatatgattccacaagcacagaatgtaacctctcaaaaactggcctgtgcatcctaaacatgttgtaacaagcagttctattagctaatgttctcataacccaatcatgtccagactcaggtgctacccttcttggagccttattagagtaaagttccaagtaatacgtaccaatcatggcggcaagcatacatgctcttctcctgtccatttctcttttcttcaaaatataaatgataagatcaatctcatcatcactgctatcttcatcagagatatcttcatcaccactgccttcaccatcctgcaggtgtgacatatgcatagaaagaaagcacatcataaatataatatgaacaaacttcaagaagaaaagaagggaaggtttaaataggtccacacatcacatgttcattacgtcacatcacatcaaacaagttgatagttcaacacaaaagtagatcataactaatgcagctaagacacaactaatgcagaccagacccatgatatgcagctaaagaaagggatcatctaatacaaattcttctgctggcaccatctcctcagccacataaatcttgcttctttagtgctaatgttcttaaacataactctgttatgtttggaagcaaacaactgtgtggcacaaaagtattccacactgtcttctgctgcaccacactctactgccaacctctgacagtttgtcaatgactcagcaattgattctttcttctgctcctttaacttcttgctgttaacaagttcagtaattagggtatttgacttatcacaatcagagttgaaagaattgagcagccccttcatgagctgcaccactgggctcttgctttttttcccaggactagaagctgtggacacatcacagctgctactccctctcttcctgctgttattgctcatggggctgttctcataaccatcccctacagctctttcccctctagctgcctcccctgcatcccctgcttcttcttctccttcctcttcatcttcatcttcaaaaccagggatgtatgctgtggaaccatcaactgcaactccttgaaatatctctataagaaaatctaagtactcagggttgccatggcgaaatttcttggcgtcccccttctcctgtattgacactaaatcaatatcacagaaaactctaaaatcatgtaaactagctatatttttgacaactgcataccttaattttttttcccaccaagcatttgatgcaattatttctccactagcacttctaccagctccagtttgttggttcagccacacccaagcactgtaataattctttagatgggtgaatctattctttatctgtttggttgaatgccttaggttagccctttggaaatatttggccttcaaattctggtaccctctagttgtccatgctccattaggacaatgcccatccattatttcctcacatgctatttcacacaatgtgtaagttttttcttctgtccaatttgccttgtcatacgtattctaggaaagacaaacatgatttaaccctaaattaaacaatgaacaacatatactgtaatacaaatgcttagatcacggcatccatagcagtatcaatatcatgagcaacaattggcatatttcgcaatagcacaaaagagacataacagaaagtaaccatggggggtttaccatgtgctgaccatcaggaccaaagtcctcttcgtcttcttcgttgccgtcgtcctcggacacatttgtcccttgggacgacgaggcaccggctcgccgtcctcctccgaagactccaaagttgaaggcgggtggcccgctgtgcgacatggatgccccatgacctcggacgcctccttgaccagacgatgagccaggaggaacaaatcctcgcattcccctgccagatccagcgccattggtcaacgacctgccacggcctcgtcctcctcctctccctccacgactgctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccatatccaccatatcctgaagacccctgcgagaagccgtagtcggagccgtccatgtggcccgttggagcttcatttaacgactgggagaagaaatcgtgaggatttccacccgccattgctgatgcgcgattcgtgaggcttgcgcgagcggcgtcggcttgcacgacaccggcgaaccaagcggcgggcagaggactagctagcgcgtagctgcggtgggggctaacgcaggacggcggcgagggcgcggggttgtgagtagcgagagagagacgacgcgaggaaatggatagggatggctggcgtgaaggggcagtggctggaatagagccacattttcccaatagagccactttagtcccggttcttaaccctaaccgggtttaaaaagaatttcgaaatagcgggaaaagatctttactcccggttgttctcaacaaccgggactaaagatatctttagtccaggttgttctcaacaaccgggagtaaagatccgggggtatatatattcccggtgcgccctcgtcttcttcaccaacacttagacggtttaggccgatcgatctctctcggcctctctccttcgccgccactgcctagggcaaatccccgcgccgacgccgccgtcgccgtcgtctcgagctacgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgatgacgcgccacgccgccgccttcgccgccgccgcatgccaacgccacgccgccgccgccgccgatgccttcgccgtcgcgcgcgcaatgccgtcggcgccacgccacgccgccgccgtcacgccacgccgtcgccgccacggccccgcaacgccacgccgccgccgccgccgcgacgccgccgcgccaaccgccgccccgatgccgccacaccgccgttaacgaacgagagcgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacggacgtgaatgagaacaaacgaacgaacgtgaatataatgagaacgagcgaacgaacatgaacgagctagggaacgtgaacgaacgttaacgtgaaatgcaatatatatatatatatatatgttacttcgcatttatcctaatacatctttttgtatcttgcagaaaagacgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggaggctagtgatagtcaaccctccgttggacagaagagggcacgcgggcaacgaggtgcagcgaagaagcttgagggtcggcacatcataacggaagtgcaagaagatggacgtcctagtgccccggccgaagcagccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaggcgcgtacgaggacctcgagctggattaccctggaggagacggtgagacgcatctacgagacacaagccatgccattattctatggcgcaggcggtacatcatcctccctggtcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctccgggccngngcaagcacaaccccaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttgtttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacctcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagttttttttcttgctcactttgttcgtcttctggctttttttttctgtttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgtcagccgctgctggcgcgtcacttgggcccactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgcgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggtgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgagtgacattatttcaagtcaagattcctcaaaaggaaaaaacggctcagacacaacctttagaaaattgaaactgcttctattgaaatgctgaaataaaggaaaaaggaatatatgtgcatgtgtggtagcccccggctaacccggcacacccgaggggggtgcggggttagcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcgtccatctgcgggtcggagcaccggtactccttacagacttggttaacaaccagctgagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtagacaggccgctgcacccttcggtggggccgatcctctttgctaggggccgtacccccggggcgttcttcgtccaagtggccccttggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcggctcagcacagggttagcctcggggtcaaagggcgttaagtgtggccttcccgcagtggcctcggggccttcctgagggtcggggacacccagcaccgtttgacaagcgggcagagggccgtctccggtcgtcaggggccttaggccaccgtttgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagattctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggtattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcggcagcgaggtggtccgcgcgctgctccatgcaagcaagcgcgactttaaggtcgccacggacagagatggggccaccagggcccggcatcttcatctggaggtaggcatagtggaccgccgccatgaacttcaccaacgcgggcctcccgaggaccgcgttgtagggcagactgaggtccgccacatcgaagcttacccgctccgtgcggaagttggcgggtccaccaaaggtgaccggtaggtcgatgtgacctaatggccacgtgtgccccggcgtcacaccgatgatcggttgagacggctggagcaccatccccggggccttgatagcatcaaaggccgcgggggaaagaatgttgagagccgctcctccatctatgaggacacgtcccaacttcacgttgcagatggtgggggaaaccaccatcgcaacctgccctccccgggcaatgcacggtgggtggtcggtctggtcgaaagtgagagcgacctccgaccaccgcgctcgacgcatcgcctcatgagtaggggccatggtcagaagctctcgtttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttatggacggagcaccacctgccggcgggacgctccctgctgggagtaccagcctctttctttttgtcgctcgcaggcctcccctttcgggtggcccgcggagtgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagttccgcggtagtctggggctctttggaggcaatcttttcgagcatgcggttgtgccgcacaccccccctgaacgcgtaaatcaccgcgtgtgcagggatgcatggtatagtattgcggacttggcaaaaccgctgaatgtacgagcgaagcgactcattatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggcgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacagggggtacgccggctattacgccggcgctcgatgttgaggcgggcatccggctccccatgctgatcctcccgagtcgaaggcgtcgacgagggagtagcagccgaatgacgtgcagccgccgccgctcgccgcgccctccgccttgacgacatggagccggtggtagcggcgccggaggtcttggtggtggcggaccgtccaccagcacccaagcgctgctgagccgtcatgaccaagttggccacgtcttccagccatcgttgggctggagactccgggtcatggacgacaggcgggtgtcgtaggagcgcgccagcagcctgaagcgcgccctgaggcgtgctgccgtcgccgtagacgaggaggcgacgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctcggggccgngcaagcgccncccgaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacaaagtcgatctcagccgtccgttcgcgtgaaccgccgccgtgcacccggtctaccgaaaccctagccgctgacgcaataatcctcttttccttttcaaaaataattcattattgcgccataattcaattaaaatcaatataagtattttaatccgatttaatcttgaaaattcataactaattcatcttagctcggatttagttggttcaagtctctaaatttttctaaaattgagatctacatgttaaaaatatccacatgtactgttcatgcttgtttatgtgctgtttggtgattttgcttctttctgtttagattccgtcgtttccggagagtccgttttcgcagcagaagagtttgaagagttccaaggccagcaaggcaagtcacacagatcccaaacaaccctttgagcatgttgatcatattttaagctattgtttctattcaactattgcatttattttcgaatgtcattgggtggaattaacctattctttgttatagcccttttgttctttattactttattccttgataccttgggttattataatttgactagttgagctttatttatattggttcaactagatattagatataattgcttagccctgcttagaaacattagcacattattgggataacttatgactcactattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccagccacaagccagcgtgggcaacggctttatcttttgtatagcatggttcattgcagagcaccagactgagaagtggcggagataagcccacggggggtcgctggggagtccatgccttgtttataagggggtgattatgatccagaaaaggtgcgctgtaatggattgtgttgtgcaaggagtattgtcacaactcctttccgaggtaccgtggtggtattgaggcacatggtgacatgatgtggggttgtgtcttgtgggtacagtggtacacctctgatcagagtaaaactattcgaatagccgtgcccgcagttatgggcgggtctaacaatgtctttcgtgattagtctcacacttctcatcttaataaaaggtgctttaattggtaataatttgatttgctcctggtttggaatggtacattcctggtttggagatagaactgtgcagccgggatggttgttcagaatggttgggcctgtacaacagggtatgttgtgtagcgttggattaatattgtttaatacttaactgttttattaaattctcaaatgtttgttaaatgctgtttatgcaaatgaaaactctactatgccatcctttggtatccttgtgcacttgcatatttgctgcgtgacttgctgagtatgtcatatactcaccttgcaatcattcatcagaggaagagttctacaatgatgctgctggtgtggaggattaggtgtagccttggtcaagctacctatggagtggagtcatccgcaccgtttatcttattttccgctgcttagatttttattgattgagaggaactatctacctctgtaatgaccttttattcgcctattaattagagtaataattgtactctattatcaatttgttattgtgtgcctcggctgattcctggacgagggttcacacacatgtaagcgtttggaattttggatagaaattccgggcgtgacacaccacaatgtaatgggttagccgatcgagttcaaatatcacgtaagttatgcaatttgcaagaagcactcactttattatgccacagaaccaattttgcaatgtacttacacaacagtaccaagacaatgccctctgaatatgcagctttttttaagctaatgaaagttttaattgaactcagttaattcgtcaagttgatacaactgtactgagaatagtcgtgggtatgaataaacatgggcagatgaccgtcagtcctcaacatgacacatgatgggtattaataacccccacaatgcatgatctgcccttcttgtttgcatttatcagtagatgccaaactagcaatcctcttccatcaccacatgaactatgcaattgcagtacaaccgaagaattaatctcacagttactactatgctcaaacaggcttctccactggtcagttgctatcgccgttttggacggaaacgtagttttcccaagattcgcacgctcagtcacaaatcatatctagtcctgatccattgtgagtttgacacatgattgtgaaatcatggacaagagtacggtgttaaagaagtctctcctgctctgagattcttgggcccagcaagagtacagtgctgccttaacaagagcaccagtaaaaattactaaatcacatttgaatgaataatgctaaaatcttgcaaatttctaaacttaaaaatctgcttcatgattcaaaaacatcaaatacgtactgagggagaaaaagaaacatcagtgcaacactaacaagtacggtattctgagtcctaaatgattcctccgtgtaccttaaaatggtaatactaaatataacatgtttacagaacataaatagcaaacacacactggatcgcatgatacagaaatgtgtagttttttccctactaatatatgctctatgtgtttttgagtcacatgattgctacttaaaaaaagggccatgtacaaaatacacaaagtagaacacttgtactacaactacgtacaggagcacataaaaacaatgtggaccagtaccatcaaactatacatatttcaagacaaatttagttctaaaaaaagaggacagatttgtagccatctgcttaattagctcaagtttattaggacagacacaataaatgcaagttaaagaaaattgtatttcattctaggctgaggtgggaagggcaagtttgctttagttcttttcatgcgattaataaattattaaccaagtattaattagtataaatttgaaaagaatgatttatttgatcttctttaaaaaatacatataattttcttttaatgaaacacaccatttagtagtttgggaagcgtggtcacaatgaacgatagatttttcatgccgaactcactaacaaacttagcgtttaaagaagctgcttaacgaacaaaatgagttccaaacatataaaataaatgattgaccccgaataatctgctcgtgtaaacatattttttagacgaaaacttgatatatttgtctttgtagatatatttttacaggcggttctttcatgcgccagcacaaacttgatttctgtataccataggctagaggtgaatcgagaaaaatgcccgtgaaaatgggttattagccacctagacaaacacattatctgtactagtgtcagcgcatttcctaagtttgtgtatcctgtcatgctattatcaccgacaaagaatatatgcacaaatataatactgattatttacattccttagatgtaccaataagagctgatttttattacttcctccgtccaagattgttgcaacctaagattgtaataggatgggtctaatctcattataatctagattgcaacattttaggacgaatgaggagtaattattttgtggcaatgctgtgtgaacaaatctaaggtatacaagaatgaaaattgtgcctctctttagccgtttccatgcagcaatgcatattttaaggaaagtcggcatatatattcgatataatcttgcatactctctccgtactcgtaaagtaagtcggtttggacagcgacacggtctccaaaacacaactttgatttcttgttctataaaatatttattgaaaagtgatatatgtatactttatgaaagtatgtttcaagacacatctattcatataatttttacattttcaaactcacaactttatgagttattcatgatttatattcgcaaggtttgacttaaatattgtcctaaacgatttcctttacgagtacggagggagtatatagctataaaaatcatcggtcaaattcatagtagttgtatagttacataaatgagagctggagagagggcagcatctccatgaaagagcatttatctaggcacatggatggtgtacttagcctatgttcttcccacatgcatctgatcctgtgagaatggatgtgctgcgaaccaaaaaagaagttaataatagattaaattcagactttgcttcaatagaagttacaaccacttattataaaatttaaaatttagttccaaaactaaggataatagtatctttgttaaagagacgacgcataaaaaaggcgccaacaatgaggaagagatacaatttattcaaattgcagtcttataagtaatctatatctaaaattgatgaaaatttgtataacctaccggtatgcaacatgaataatggaacccttgttcagctgccggcatatgcaactggtgcaggaagacagtaagcgcgtatactcattatggagttcatagctcaagcagccatataagttcccacttgatgcagcatgggtgcctgagaaaatgcacagtagctagtacatgaatgtaggacatatatgctgtgttactcaaggaaaaaaagaccaagcacatccagaccatgatgacaataataatgccttgccaaatgaccccatctatgagaggacactattaagttatgtactactaacattagacgcgttatcttaggttgctttttaaacggattttgggctaggctacttgttcatcgtgattcgtgaacatgttttctaaattgttaaacatgtgtttcacgcaaaaacaactttttatataaaaatttcttaaaaaaatcaaataaaaatatagtatttttaagtttataataattaatactcaattaatcatgcgctgttgacttgtctcgccccaccaaaaatctaagccaaggagctgattcgatctaaagccttgcaaaagaggaaatgacctttctcagttggaaaaagaacatttagatcaaaccatgattatgcacacatacttaataccagtcttaagatatatccactggtggagaaaccatctttggtcggtcgaccagattttacattaaaaaccgggattaaaaatatctttagtcccggtttaaaagctacagggtacttttcaatctttagtaccggttggtgttaccaaccgagactaaagatttatttatagtcccggttaataacaccaaccggaaaaaaagatcgccatacactttactcccggttggtaacatttatagtcccgttggtaaaaccgaccggaaaaaaagatcgacgcggagatcggagaggtggcgcgatcggatcgaggtatctcctctcctttaactcctctctcctcctctactcaaccttatctcctctcatttttaactcctctcctcaaccttatctattcttcttgtctctattcctctccttctcctctctactgccaggcagacgcgagggcggcggggcgcggagggccggccagcgtggcggcggctagcggccgcacggcggcagggctcggtgggccggccggccagccggcgcgacggcgacgcgcggcgaggcagcggctttctttttttgtattattttttttgagaatctgggattgttgtgtgatgtatttgattggatctgagattgttgtgtgatgtatttgatttgtgtgtgatgtgaatatgtgatgaattttgtagaagttgtgatgtaatttttttaaagattttgtgatgtatttgagtatttgagatgatcgatttgtggatttggaggcaatttgaggacgattgatttgggattttggggacgggatggggtgaaatcaatatatttaaaaaataatgaagaaaagaaaagaataaagaggaaccggaaagagcaaccgaattagcctctttagcccggttggtaacaccaactgggactaaagatgctttatctgttaccaaccaggactaaaaatgaatttttactcccggttttttcgtagtcccggttatagggggttacgaaccgggagtaataaccatttctccaccagtgatcctccatatctgagaccaaaatttaaaagtgtacaaggggataacagtcaattaaactattttataacaataaacagtttcacttcctaccttatttagcctataaataattaagtactagtacaagataatgctccgaaatcgcactgctggaaactgtctctaccgtaaagttaggttagaaaactaaatgcgccagccacttaacagattcatcagattatccatgaatacattgaaggtcaatctcaagcttacatgttacaatattgaatacctccatgtgctgttccagggacaccgagtatggcgaatctgtcaggtgttgggtagtggaggaagaacttgaatagtgttagttggttggcagcttacaggatgacagtttaagtgcagttaagccccaatggcaagataaaccggccggtatattacataaacttggatcataatatttgggatcacaagcatccattcaatgaaggtaaaaaactatacgcgctctctagactctagtgctcttaaagaagaaaaggcacacagaaggacgaggggagctttggttgggaggtacagagaaggttagaatgacaagtaatttaaaacagatagagtacctattttctgctaattctaaaaattgcatgagcttatatatgaaaaagtttataatttgtatagttacttgcaattctcatcaaatacagttatctaagagtatataaattatttctgttgtaaaggaagtaaaaggtaataatcatatacgtacacgagatcgagcgcatcaacaggctttctagtacaatcaagggacgaatggaccaaaagacttgagatggatttcctatttcttatttttactttttttatctgtcatttaaaacaacaaccggtaattactccctcggtccctcaacatttgacgttgttgactttttaaaatttgtttgaccattcatcttatttaaaaattttgtgaaatatataaaactatatgtatacataaaagtatatttaacaatgaatcaaatgatatgaaaagaattaataattacttaaattttttgaataagacgaacggtcaaacatatttaaaaaagttaacgacgtcaaatggaacggaacggagggagtacatttttccaattatatataagtgaaatattgacaactaatggtaccgaagtgcttgtttttgacaaataaattacaatatcaattcgggatgccaactccaaataccattaattatttcaattacactcctatttttagcaccgttgtctttgatccacgtttgaactatatattcacataatacaaggtcatattacagtttattggatgatatttttgcatcactgcaaaagtactctcagccagaggaccctacagcttttatatgagcatgatatattgtccatccttaactgacaatggcaagatggaaaatcctatgcatgttaaggcacaatttgacaaggcatttcctatataaaggtagccaagtttcactatgaacaacacaaccataataccatacaaagccaagcctccaaaaactgcctcagagctgaaaaaaagaagagatacatagaagatggctcttgttattgctgatgaaatcaaggccaaggcggaggtctactatgatgatgagatctgtcaacaatgcacaaggctcttgctcaaggaagcaggcct

SEQ ID NO: 74746 - DNA, 5446 bp, Oryza sativa
aacattcgatcggcggtccggccccttagagcaagtttaatagtatagtctctaaatagctaatataatagtcaatttatacaatagttgcttactatactattaataactggtctcacctgtcataaacacattacgttttggagtccatgctgcagccggctacagatatgtagtccgctgctcttctctttctttatttatctttttaaaatatgtttatagttagcttatagcttggagttagtaattggctacactattaaacttgctcttatacgccagcttcgcactgcaatgatcgaccggtccacgatttgtcgatctgttgttaccgaacattgaccggacctcgcgcgatgttccggccaccgcgacacgggaaggcacacgtaaccgagcagatcgatcagcaggggaaatcacgcaccaaacccgcgcagccccggcacgttgacgcgctacgcgctcccgcggaaacccagcgctgatccgggcgggtctcgcgtgcacgcgtgcccttggagcaggaggacacctctctgcctccgcggggcgggaggcggccgggtgtgagtgcgacacggcgagacggcgagtctcgcacgtacgcgcagcgcctggccacgagtttccgaggggatagagataccacgcgcgcgcgcggacgggcaactcttggatgagaacgccgtacagcgacgttacgcttacggcgtggcagcgcgcgtatctggatcgcttggcggagtgacgaatctctagggccggtcgcgctcagttttcaccgcgcccgcgaggggatgcactcgcgcgccggttcgagcgtgacagaccgacgttcgtccgacgaaacggagcggagcaggcaagtactccgggactgtgcactggcgtggacgcgtggctactggcatgtgtggtgcagtcgtggagccgttttcttctcgtctcatcgggaggttcggttccgacctgtcctcggagtcgcggaaacaaataattcgatcgaccatagtgacgatgctgaattgatcgctgatcagcagcagctcagcatgcttcccgtcgtcccgtaggtcggaaaagaaaactccagcacttgacaaggagcaaccggataagtgtcttgacttgttttatatcagcatctcaccatcatcctcacccatgttcgggcatgtactccaacatttaagaattggccttctctctatgtattcttcacgtagtagaaattagaatagagtttataattggaaatcttctgaacaagtggagtaaagactaaacagtatgaggtggctcttaattcaccttgggtagtgcagttctattaataaaaataggtaactagaatctatgtggtttaatgttagtcaacaatgaaaaagaattagaggtttaccctatcacctatatctattttttatttgttgaacaaccaaccgttgtgtgctttatggagaagccatggatataaatcatttctattattaaaaagagtgaggtgttaaataattgtctattatattattatactataaaaataatttgaaaataaggcaccatattcactctggagactaaaaattttcaccaagctcgacatttaattcatctcctaggatgaaactctagcgccgtcaccccacgaaagatatccaaaccgctacaccatgctcttcatcctcattggtttctgacaaacacaatggcgatggccgatggcagtaggactctattatatgtttcatcctacttcccctccccctcgactgcctagggagccaaccatggatcggacgtctccagcattgatctggcactttggcacacacatggtagatgatcttctccccgtcttatgttgtgtcgtcatccgaggtgcaacagcgatagggtacagagatatcatcgggcgtcttgtgtgccaagaagttgatataggagcgtccaaatctagctagatacaagcagcatgacatcaccaaccgctgttgtgccactggcagcgtgctagttgacgacatcggcaacggggcctggcttggggcatcacgcctacatccgaccttgactgctgccacctaacgtgtacttctaaataatgttttcatcgatattcaaggtcttccacaccaacctatagattggtgctatcttggttttgattgacaatatcgcttatgtccacatcttactcgttctctagatggacactatggatttgtgagtgtgtgcctatatattggtttgctcgcagcgcgattattgtagggtatcacgtctaaacaaggttataggttatggtgtttatggtcgattggattgtgctaatactgggaggcattatggcactagctcggaacaagagaataacaatactatgagacttcgcttaggtggtgctcgtcgagtaccgtttcctcaactcctaggttatgaatatccagatatcacctagtgtttttccctttgcaggttggctttttggctgaccctgtacatatttctcttgtatttctgctcctctattaatatacgaggcaaagcttttaccctcctttcaaaaaaatgaatatctggatttagccttagctagttataccgggcaaatagcagtttcctcttccttgttgggggtgttgtctagacttttaagaattgctctctacagtgaaaacctatggtttagtctttgttgatcggatcatgacaacatatgaacatacctgtgttcttatcttaggtgctattttaggggaaccttagtcgtagtccagtgttactttggtccacgacgaggaaccttttaaaaatctgttgtatataaattacaaatatatttgcataattatagaagtcaaaagttgtatgaaaaatccaattccaattatatataacccttcctatatagccccgttcacttctcagctgggccttttttacaggtacctttcagttgggccgagcctgatacagctccaggctgaactggccgaaattttccgggacgtcagatgcgaaacgaaaggacaggatcagaactcagaagctgactccaccgaccttccctgccaatgccggtgcgtccccctctcaaaaaggttccggcccaaactcgagcagatttgggtcctccctcctccgcctcctccgccgccgccccctgtatcccaccggctcgccggagagtccgcctcgccgccgcggcctcacgggcgcgtatccagcctcgcggagagcgtgcggaaccgcgacccgtactagggcagcgcgagagagaagctgctgcgccctgcgctgcaaaggtatggctgttactgttcttccgaggggtctctaaatttccggcgattcgaagctttctaaagcatcccggatactgtatcctgtaggctgtaggtagattccgacagtggaagcgttagccgtccccttgcgctccgctgccaattggtagtctcagaatgtgtagatgcagcgtctgcttggggaatagggatgctccctatttgcgctagcctgataggacggcacttcagttgcaatctgatatcctgcttagtgcagaaaagccaaacatggcatgtgaagcgtagaaaatcagaagtaattttgtaacttctcttgctaggtctacagttggagctcttgctgctgcttggaagacttcggacaagaacctaagatcatggtgagttcataaattcacttcaggtcctgttaagtaaccatgtgcaagtttgtttactttgacattcggttctgttcaggtatgtttcttctgttctgtggtcatgtgtgatgtgttccatttttataaacagtgccattttacaggcaagccttgctgattctttcttagcggatcttgatgaactttcagacaatgaagcctatcctgtgagttggtttcagttactatgataatacagattttacaatgatttatttattgagaatttgttaactaatcatcaaatttcaggaggaagaaaatgctgaggcagtgggcacggaagagattggtgatgatgatatgcctgacctcgagtctcttaattatgatgaccttgatagtgtttcaaagcttcagaaaacacaacgttacaatgacattatgcaagtatgtgatcaagctcaaaatctcctttttcttgaagatggttttgtcctcttgttttaattggattgttgtttgacttctttcttctagttttctgattttgaagccctgtactgtcctattgtcacaagaaggctatttgcagtcaaacattaatgggtgtgttttagagtccaagacatgtttaactatatactcaatgttacaaatgctttgcgcaaaaagtacaatccttctaaatttgattctaaaggggactgtcatttgtatttttaggtaacaaagccttttgtttccatacatggcaacttacagaatcactctttgtttgcagaaagttgaaaatgcacttcagaaaggtacagatttttccaatcaaaggtcgatcctggaggaagatccagaataccagctgattgttgattgcaatgctctatcagtagatattgagaatgagatcattataatccataatttcatacgtgacaagtataggctgaagtttcctgaactagaatcccttgttcatcatccgatcgattatgctcgtgttgtccagaagattggaaatgagatggatttaacgcttgtagatctggaagggcttttaccttctgcaattataatggtaatttcagtgacagcatcaacgacaagtgggaagccgctttccgaggagaacttggtaaaaactattgaagcatgtgagagagcccttactcttgatgctgcaaagaagaaggtacttgaatttgtagagagcagaatgggttacattgcaccaaacctgtctgccattgttggcagcgctgttgcctcgaagttgatgggaactgctggtggtttgggagcacttgcaaaaatgcctgcttgtaacgttcagttacttggtgctaagaggaaaaatcttgctgggttttctactgccacatctcagtttcgtgttggctatcttgaacaaaccgatgtattccagagtaccccaccagctctgaggactcgtgcttgcagacttatagctgcaaagtcaactctagcagcaaggattgattcgatcagaggtgatccaacaggaaaagctgggcgtaacttgttagaagaaatccgtaagaagattgagaagtggcaagaaccgcctcctgcaaagcttccaaaaccacttcctgttccagactttgagcctaaaaagaagagagggggtcggcggcttcgaaaaatgaaagaaaggcaggccatctttaacctcctctttttttttctcaagcgaaaaacaaacaataaacattctcttatttaattgtgtgttctactaat

SEQ ID NO: 74747 - DNA, 13505 bp, Oryza sativa
cgctcttcttttcctagagtccaggcttgctgagagtcgtcccttttctcggtgggcaaggtcctccttttatagctcaaggggataccacatgcaccgcctctacctaacttttcatgggagggggacccacttcaccttgtccgggccacgatccgtgccttcgcccggaagctaagcagcagcccgtccttgagcgcgacccagcgccgccccccgcctgacacgggggacaaccctgtcatccccttataaatgggtgaagacttgtggtggtcctcctctcgtggagggagctccgaatgacgctccgatgggacgggtcatacctatctccactccgccggatacagaggcgacgtgggggcacggccgcttgtccaatcggtcttgaccggcgatgggccggtcacagacttggtcagtcctgactaacgtgcgtcagtcgggcggcaccgcacgtctgcccctaccgcattaaatgcggtgaggggcagttggggcgcctcccattgatagcaggttagcctgagtcccctctccgctcgctccccctgccacatgcacttgggctaggcctcagggcaaggcagcacgagggccctaggggcatgacatggcaccccgagccccccccccccccccccgccgtttctgcgatttgcaaggtgcgggggtagggccaggatgtagggccacgtggctggatgggaaggtaaattcccctcactttgcatacccccaggcccatatctccgacagtccctaaatatttgacgccattgactttttttaaacatgtttgactgttcgtcttattaaaaaatttaggtaattattaattcttttcctatcatttgattcattattaaatatatttttatgtatacatatagttttacatatttcacaaaagtttttgaataagacgaacagtcaaacatgtttaaaaaagtcaatgacgtaaaatatttagggacggagggagtatcttttttttcacaaaattttatatatcttgtgaacggtgctatacttttgaaatccataaccaaatatctcttctattttactatgggtagcgtataaatgctgactgaatctatgcggtttaacactaattaataataagacagagttagggtttgtcacatcactttatatttattttttatttgttaaacaaacttatggttgtgtatcttatagcagaagataaagatgtgaattatttttcattatctaaaaaatattatcttggactttcatttcttaagtgatacaataataacacaagctctctcaatggaaaaacaaaaagtacagttaaagggatagagctaaaaaaaaaagggcaagatgcatgtatgtactatatagttgaagtggtatatattatgagtgatttactgtttttaggaggtaatacgaggtatcagaaattttctggtgtaattttataattctcagtactggtgcatccctataacaataaaatttcccgtaatatggtccatatatgcatgcatacgggattatagagatcaggcatgaagctactacacatgtatatgtatctctcttcgagcctaagctacgtatctcctagctaggagaacaggattccgaataagactaaagttacactgaacaatgctgatcgatcgatccactggacacgatcatcatgatgagcagacattcaccggccagtacatcctttttcctgatcaatcggtgagaaaaggaggaaaaggaggaagaaaaagaataaaggaaacgtgatcatgggctacaatattgtactgcaggtctcagatatttgcatatagcagtgttgtagtactgtgtttagtgtgtagtgatgcacacatgaatatgcttttggaggtggcaagcgctagcgtgcggcagtcaacaagccgagctcgagcgagtttggttacgtaggtttgagcttgatatgaacttgagctaagctcgagccgagcctggatactgatcgagcttgggagtgagctcgagttcgagctcgatcgagcttcgaacctactcgagcttgacagcttgatttgttgaaactctaaagaacttacactcttgtataagagatattaatgtaaattatcagtagtcaaaattaatgggtgctacttgtcttgaatgaaacctctgcagcttttctcatgaattcatggctttgaaacgttgcaattaacaaaagctagccactatatctaatagaaatagtagtactattactagcagccgaataattgctttattgagaagcattgatgaggtcttgagacttgaacaagtcaagcacggtgacaagtatacattgacccatcaaaaatatctttctacatgtaatacatcttatgctaatcaagccatgccgagctattcgagctcgagcttgcgacttgcgagcctcagcctaggcttgagcttggcttgtctagtattcgagccgagcttgaatcaaacctgtaacgaatcaagctggagcagcttgcgagctccgagcttttttgacagccctagtatatatacacaactacacacactcccggtcctgaagatattgggcctgggcctgttttctggtccgcgacggtggcacaactggcaccagcagtaccacgcgcacgcagcgcagccgcctccgtcgcatcaggcttgtcgaactagcccattagctaatattattaggccactgtataagtatattttagtaaaagcaattttacagtatttgaagagataaggtaagatgcaatattttttaatgtaaaatttgttaactttcaatatcttaagtaccatggcgtatgagaagcatggcgaaggatcctctcctctcatttactcctcttggtatctcttaatggctgttggaataaaatccaacaagcatggcaataactctccctctatgggagggaactagcttgaacatatggagaaccaaatgagataagttgaggagtggatgagagtgagatagcagtgaagatggagataaatgaatggaattgaacgagatcgccatctttgccctttaagaatccttttaatttatatggaatgggaaattacaatactatctttccttttaacacaggagtagcattccaggtgtggggtctattccccaacaatgaccgtgaaatttcttacaataatgtgtgtgaatttcatcactcatatatgcatgcttgcagcttgaggattgctgcatcaatgacgagtgccacaaataaaacagcagagaaaattagcatgttacgctgaacgtaatctatatgcatcacataggccacaaataaatgggccttagaatatgagggctaaagactagtgcatgtctctgtgggcaacaaagatttgctaaccagcttgcatctccgttctaaaagcgttttggacttgctttcagaggcaagtgctaaaaccccaatgtcatacatgtgtttcgttgtatgtggaagttcacaagcaaaagaggctaagtgatgttgacaaaagaatgggaagaaaaggatcgaaaaataaaagtagaatgaacttggaatggtcgaccttggattagataagcaggggaaaagcctacctggtgccaaaaggaaattaaagaaaggggaaaactttgcatgggttgtaatcacacatagtacttttgagatgcttctctgaaaacgaactacaccctgttctgcgttgttttttccccagcttttcaaacttcagaaaccatacaaggtacttcctccgtcccataatatttgtctttctaggattcaaaagttatcttaaaatagttgtcactttagagtactatttatcacatcaaccactttcaattcaaatttcttcccattctacccctaaccaccatcttatatccaaccatacattatttttaaggggtattatagtatttttctcctgaccttaatatacatgcttaatatacatgctaaataacctggaacgacaagtttgatgagacggaggaagtagaaacaaaacagatcacacaatcagtacatcattgtacgtgatcaacggccgcacataatgtactaagtacaaatccatgaattgaatctaaggaattattttatgattagacagccacgatgcaatcgatcggatgcaagcacaatctatctagctcagctaaaataatttcttcgcgtgattgtgcgcgtacaaccgacgcttcctcttctttttttttcagaaaatctttcacgtagcacaatccaaaaagaatgcactgatgctcatcggaaagatatatataataacgtgcaggagagcgaggagggggggggggggggggcagtgcaacctccctatctgtcactctgcacttgtatgaaacatagcgcgccgggcgcctctctcgatcaactcctgtcacactcgcctcatgtggtcctcttgcaatcagttgtttatttgtagccaagtgcagcagtattgactagaaattagcgcaggtagaaaagctagtaggagaattttgtatcagtgagatgtataaactaaaggatgccccgtacgttgctgcgggacttgattaacattaatttgttagatagtaggtacaatcattaatttgttagataggaggtacaacctcaagaagaaacaaatatgtttcttggagaaattctttttagcagccctatctaaaatttgtagataatttaggtagcaaattctttttagcagccctatccagaatttgtagataatttaggtagcacatatcaactgaaggtcctatccaaaatttgtagataatttatatagcacatatcaactgaatgggcgttcagccataaagcgctggatacatgtagatgtgtgtggagatcacagtagaaaaaatcggaccggaccggcggttcaactcaactgaaggggcgttcagccataaagcgctggatacatgtagatgtgtgtggagatcacagggaccggaccggcggttcaactcaactaaaggggcgttcagccataaagcgttggatacatgtagatgtgtgtggagatcacagtagaaaaaaccagaccggaccggcggttcaaccggaaaaaacctaaactagggacctcgccggttcggtgtgtttcaaggactgttcatgcagtgacccagtgtgaaccgactgaaccggacggttttcaggaaaaaccactgaagcggggactcctaaaaccggctggcccagttttcaggaaaaaccactaaagcggggactcctaaaaccgaccggctcatacgagctgggccaccgtacagcatcttccttaatgggaagcccaagtcctaaggcccagttttattttattgttcaaaaatcgggtgaagcatgggaatcgaacccaggtttgctagatggagcgttaagttccccaccactacaccacactgaccattgtggtgtgcaataaacaataaattttaacaccgcggttgaaccggtgaaccgaggcctcaccaattcgacgtccggtccgagtttttatactatggtgcagatgggtcaatatattcatgtgggctacatttgacactgagaaggcgaagagactgactcggtgactaatgggttgggctctatgctgtattccatccaacgtctgaaaagcgatctaatgcattcatccaacggttaacaatttgatgatgatgtggaagcacgaggtttgagcttttggccttaactttatagaaagaatggataacacatcttagtgtcgatttcaccgcgtacacgcataaagaagatatctgctatatatatacacacacatacacacacagacacaagtaaaatatactgttatagtagagcgaggctccaagaaactaacgtactgaaaataagcgtttagtatatactgcataaataataaacgagtcaaccttggcctaacgtttataatgtaatggcaaattattcaattaagcactatctctacttcacagaagcagctttcatgcatggcgcttttgcttgcgatggctactactgttgttctgcttgtgccacaatcaaccggtccgagtcatgcatgtacatgtcttacctttcttcaggtcaaaacaatgaaacaatgcatgcaatgcacaccgctcagccctcaattcggccagctcaaaatcagtcataaatcgtcgagaaaccatggacatctacagcgactcccacgtgcgtggacttgctgcgtcgtcttcagttaataatctgttgctagggctcattgcccttgtgatccgtgcttagccgctcatccttttcggtgccttgcatccatcgatcgattttgctctcgccatcgatggatcgatcgatctcagcttttgccatgggcggtttggattacgtatgggataagggcgtctgcaagtggcgcggcttgctagctatacctgccgcgtcttgagatctgtggagccacgtaagtcttcagttagccacgacttggagatgagatgaggatcgaggagctgatgatgaaggagcgtgatggcgagagacagggagctcagggccccttaattaatttggatgtatagcactatacgatgtagtactagattaatctttaagagtggcttgatttcttcccatgtttagtcatcgtctcatcgatcatccagtgcaaacgaagacgatgtagagtactaagttacaaatatacatatgtgcatgcaggggccactgaggctgtagacggtagttatctgttactacaatcctactatactaccttagtacgggcgttcatgttcttatacgggagtagcaatcagcaataatctgcgtggcaacaaaacgaaggtttgctggatagaagttgaacctgcttcttatcaacaatgcagatgcatgttggcagttttgtttgcatccgtggtggcagtgaagacataagactgctaaatttgcagtccctattcaaactgcataggatcccaattcatttctaggactagcagggcgaattgagatccagtgcaatttctaacaatctcagccctctatttattgatccaatggttcaaattgtgagctacaataaaactagagctgtactttttccaagtaaaaaacgctaccgtactttgctacagtactgaggcatctgggccatccgttttaaatccaatgatagctcttgtgactgcttaacttacagtcacagtggccactgcactggaaccgaatcctagcagggcacgcgctcccaatgcttttgctctgcaaggctgcaactgcgaaagctataatccgagttgtttggacaagtagcagcggcaggtcggtaggcacgcccctgcagcgacgactagctgatgtgtgtccctgtgtggcagcctggcaatggcagggcgaggccgacggccgacctgcatctgcatggccggcaccgttttcggcccatctcagtctttccctctgccggccggcgagccctgatctgtttaaagggagaaaaatactgaagtttttgtttggaaaaacaaaattcaggacctcgtgcattgcaatagtgaattgcattcagaatgattagccatagacaaaatagtttcagggtagcttcagaaacgtcgtcagagattaggcaaaccgacaggcgacagagaaactacacactggtcatcatgtacagaaaacgggaggccgtttcgagcactggcaccggaaaacgcagcctatttctgaacactgaacaattaacgtagtattaccaacacgcgcgacagctaatctcgatcggtagctttcgctggcattaagataagattcacgcgaaccgcaaccggtggtcaagggaagaggagatcaaatagcacgccaacacgcagaaaagatgatacgctaatgcgtatccagctagattataacgtgctttgccgatggcaaatcaggaggggaagggatcggattcttgcatccttcattaacaaggctgctggtttgtcttggcttccaaaaaaaaaaaaatctccgagtccaacaagacgccaaggtcgattccttgtttgggctagataaacaatatgggcttacttgtgaccaaagtattaggcccactatatgcttgaatgcggcagaacggcccacttaaaactccaaagcccagagcacctatgggcctcagccgacgtgatcacggtgcatctctcagaaggttcccatttccacgttggtttatcaggtgattttagatctatcctacggaaatttgatgttttcccatcgaaacctgattctagtggaccgtctagtaccacgtgtgcttcaaattgcaggtcaaaaggagattgtcccctcttcgaattacacctccagtctcctctccagctgtttcaccggtgaatcagcaagattacattagcatctgataggaaccaacacttctgctgcattctcgcacaagctttaagagcccgattataactcgctatacagaaatccggaaaacctcccgcattccacacgcgcgcctttgtcaacagctagagttgacaatcatcacttcatacggtaggagttccatatacacatcacaagcaacagaaatcgctcatagccaagatgcaatcctggggctggagagagcaccttgctcctcaggtgtaaaaaaaaaagggaatttgtgaggggtttgctcttcctgccacacctctcaagtctccattttcaggctttttcgcttgtaaaatttctcagcatttcaccagggacacaatttccaaagtgtctaatggagcctaagattgttccatggaggacactggcagatcactagcagcagcgtcaggcctccgggactccatcttcgcggagatctccgccatgaccagcctcgacaggagcagccccgcgacgaaagcggacgccatgagcatcgtgaacacgccgctccagctcttggcagagatgtaccccgtcagcagcgggccgaccgcggcgccgatcgaccccgtcccgtcgatgatcgccgtgacggtggcgagcgccctggagttgccgttcagggagctgtgcgtgccgaggtcggcggagacggcggtggtgatgagggcgtacggcccgttgacgagcatcccggtgacgaacatgagggcgatgttcgagtacagcgagaagctgccgtatatgcggtagaagaagagcgccgggatcgccgagaacgtgaagctcgccgccgtcagcgcccgtgcgtcgaggcggtcggagatgtggccggcaaggatgccgccgacaacgccacccacgtcgaacagagttgacagtacaccggctgcggtgtctgacaagtacactccaccgattgctgaaaaatggaaacatattggcattgtcaggtacattatcattcttagtgctaatacacatcagattacaccaaaaacaaagtgcagttcatactagtacatgacagaatggtttggttcaaaatcatgaggtaaaagattaatttggtatgaggaaaaaaaatcagtatgatattgaaattgcacacaagactaggggaaccttttctcggaaaaaggagggacgaacctgtgtggctgatataaaacggaagccaatacaggaatgtgtaagccacaagcttgcagaagaaaaggcagagagcaaatggcgctacaccaggaattctccaagcctgaatgaacccgactgccttttcttttgatgccgatcgttcttccaacagaggtgcactcatgtcatccttctcagcatccttctcatggatatcctcctcgattccaatcatctccggaccgacaggcaagaacagaaacactgcaagcccaacgactgcgatcatcactccagggactgcaaacgaccatgaccatccaaacttcaacattgcagctgcaattaaggaaccagatatgtttcccacagatgtatgagcattccagattcccattatcagccctcttttgctctttccaaaccaattaccaacaactgcaaccacagatggccagccggatgactgaaacaggccagccatcatctgaacacccagaaagtagtagaagttgtgtatgttgagccagttgccggcaccaaaggcagcagtgaaaaatccagtgcctatcattccgatggtcagaagtatcctgagatccacccgatcacccaaatggccagcgaagaacatgccgattgcatatactccgagaaatgccaagtcgatctccccgagcaatgcagtaccatcgtcggcattaaacggagcccagccgctatagagagccgtcatgttgccctgtgcatctcttaaatcctgaagatacagatggctcggccaatgcaacatacctaggttttctgtcttaggatcaagaacactcttgacaatgcttgtagtcttcctagtggcatgatagctagcataggataagaacgtcagtatcaatacaagagcctggcatgatctgaaggagataggactcccccgggcacactcatatagctgaatccccaatggcttcatccgacgtgttttgcttggggaacccatgaatgaagctgaatttggtttttccgctgaggcggctgcaaccaggaagaagtattatactgtctgcaaaaggccaaaagagaaatcatcaggagttgtccacaggaccacaaaatttaacagcttgacacaaatggaatagggaacttctggttcacaattgttcggcagcaaatggacacggtgaaagctatagagcttattctgcaaggaacacgcaagcatctgacgaaatgaacaatattttgccaaattattggggcgacgactgcacgtagtttaatgtggacgataagttaagttggtcataatttaaaaattgtataaagacgaattgcataaactaccttgcacttcgctattcgtgcgattaggtaggatgttacgatattcagaaccgacactttcttttcttgcccaagtgggatttcccgtttcatcacgagcaaaaggaaaatacaggagttgacgaccagttccgattagttgatatgcgttgaacgagcaaaaggccctatgaattgacaatacacagcgacctgaagtttaactgtgaaggccctatgttttaatgctacaaaatcaagaaccgccgtttggtcaggttcctatcttggcaagaagttctgaaggcatcattccattgtctaaatcttttttactacccattgtctaaaattacaaataatcaagttcaaggaccaagaggaaaacggaagaagagaactataattcaatcaactcaacaattggagggacaagaaacaaaaatctccttcaaccatagcatcatcttacttccgattcagaaaccgaaagaagaatcgattcagaaacgggaagaacagaaggcaactggagagaaaacaaatactccacactaatacctgtgccctatggatcccttgttaactcaacagcaagaatgcaaggagaaagcaagacgggtcctgctcttgcaagcaagcgaataaaacagacgcaaccagaggatcgcactctctggaagcaagcagaagaacaggggtccatagaaagagagttaaatcaggcccctcaaatttgcaaggcaaataaataaggcagacgaggcgatcccgtttggccgaccagaatctagtttttttctagacggatggaagatcaataaaaagagaggagatttatcctagaaaatgggaaatttaagccaggagaggaggcgaagagatttgatcagatggagcatgcaaattacctgcagtcttgcagatagaggttcagaagttggctgttccaggaatcgtcctagaaacagcgtggttcttcttcttcctggctgctttggcgccgtgaggaggcgagcggaccgcggaggggaagctttctggagtcgcctcgaccgtggcttccgaggaattactggtcttatagatgtttacgcgagtctttttggcttttgtcgtggtgaccgttccacgggccacgggcgctgttgggtcaggtctttctccggtgaggttacactaccccgtggttttcctgtggcgttcaagtcgcaacgattacagccttacagaatattacagggtcatagtagctgctgtttaacaacttcgatattcgctgcttctattccttttctcatctctgaactttcctctcgttttgaacctgaaatttacaagttagcctataaacagatttctatatgatatgatggcatacttggactaaagagttcaaaacttcaaatcatgtaataccgatctattaattagaagtacacacgcatatacatacggtaaatgtgcatgtttctgcacttctagaccgtttatttctccaatattatcaagtgtttggaaacctatacacgtgtagtgtataagtatgataaatgctcattcaaacgtactcagttaaaagtaacagaagaatttcgctggttgatgatcaaattagaatgctgcttgttcataccgggaggtgaaggcatacacctacctttgccggttaggtggattttgctaatggccagttcaaatgccagggacagagaatggggagatatagatataggatattcttctgaacaaggatattccctgtgctctaatattatgctctctaccggatcttcttttgagccccacaactgtagggccatggcaaagactacaatcttgtggctcatgttctgcccattattttcttaatatgcaaattcgctgttgagtgcgacaagtgataaagctaaacatatgacccaattagcctaagttgtatactgttttttatggtgtaggtaagccaattaacgtcaggcgatcactaacaagcaaggacctagaagcagtcaagcagacacacctaggaatcactggatcaatgagcaaagaagagagagaacggaccttcaacctccgatcgattctccccggtctgcgatggtggttgaataagtgatgcgtgaaagtcaggtgatccggcgaggcgtggctgcacgtacggcacatgagacgaacataatctatcttggtgaaagacacagagcattatgattgcaagcttccaaaagggtgtcggtgtatatgatgcacctcgatccgtcgagggagtccaggacgtgcaggttcgccatagccatagccctagcaattccgcttagttgaattaggatgtctaaatatttacgttgtgtgttactattatccaaaactaactctatttctatccccgaaaatcgagaaatacgaggaactgccacgtcagggcttcatattttatggacttgttcactttgatgtcattttcaatcttaccaaattttagtaaagttgccaaaaatttctatatttagtttgctgtcaaattttagtaactatataaattaccaaaattttgttaactatgccaaaattttggccgatcgaatg

SEQ ID NO: 74748 - DNA, 1646 bp, Oryza sativa
gcgaattcgagctcggtacccacatttttggaattagtttttttgtgacttattatccaaagtactttaagcacaacttttcgttttttatatttgcacaaatttttttgaataagatgagtggtcaaacagtgcaagcaaaatgtcaaaatcccttatattatgggacggagggagtatttaagtagcaaatgattatcactatggaaaaaccttttgatctggtcatctttgtggtccattgctcttgtggcaattgtttaagataatgctgcttggttgcaaaaactgcacttttcagattatgtaataagttataagttatttatgttaatgagcttgatatgcattttaacgatggccgctcctattcttttccatagttgcctatcaggttaactataaaccttctcttttcagatggtacttgtgcacccatagagagggacactcttagaagtcttgtggaatctggtgcaactgaaagttcaggttgtttgcctggttgccacttgggaagtgatgcccctccattacatctatccacagctaatgctcttggggatatcttttttccatcaagtgatcttttgcaagcaaatgaggagtgtgctttggctgctctcactaaattaccagaaaatggttcgtcttctagttcatatattctgttaactagtactcccttcgacccataaaaaaccaacctagttttggatgtgacatatcctagtacaacgaatttggacatatctctgtctagatttgttgtactagaatgtgtcacatccagtctagattcgttttttgttggacggagagagtatagctttcagttgtactaatacaaaagaagtactaatttcatccatgttctgtagaccgcagtaagcaactacagagtactagtagcaacctgttgtccagcctcaataatgtcgtacaagcattaagtaatcttcagttgaagcacaagcagttagcagaggattatcaaaatcaaagagattccagtgcccgaaaaagagctgaacatagacgtctaaaaggtatcttgtttagagattgtgctgatgtttctttacagttgttttaactttcaaataagcatccatgccatttaaaggaacatgtttcgcaacatttgagacctgctatacatcttgaattatcaaacatgttgccatcaactcctatctatcctccctacgcattaaccagcaatcttctggagagcattcttgcgataataggctgtactgttgcagtactcttatatttactgcgccagcgcttcagacttgtaccatattttccctatacatttttttacctagatacgttgtcctaatacattgggtaaaactaaccagatgttttggtttactttgtcaagaggagttggccagtgctgcttctgagttggaagaaactaactacaaactggcagcacttaaagctcaaagagataatacacaaggagctcgaatcccatatcctacattaggaaacaaaaatatgcctgaagataaggtcagagataaacaaagagagatgcaggatcttgaagctactcacaaggaattatcggtaactgccatcgttcatttttaaagttccaaattactacttcctccgtttcacaa

SEQ ID NO: 74749 - DNA, 1355 bp, Oryza sativa
cgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaataaaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctacgcagcaccccattaataataattaacatgtgcacactgaaatataacgcaagttgtagtggctaaaatccaattccaccatagtaactgagaagtgttataactaatacaccacacatcggtccacaattgcaactt

SEQ ID NO: 74750 - DNA, 3592 bp, Oryza sativa
tctgatgtttcaacaaaactacaggaactcacgcatgatgtacctaaaggaaactggttctagacacactataaatctgcggtagtccttttccatctcgaagacgaatcaacgatgtgtttagaatcagctgttcccaacatgcgaattgcgcacagaaaacggagcgctccattagagcgtgattaattaagtattagcttttttttttcaaaaatgggtccatatgaatttttgaagcaacttttgtacagaaaccttttgcaaaaaacacaccgtttagcagtttgagaagcttgcgcgcgtaatacgatggagaagggttgggaaccctggattccaaacacagcccaagtctatccaaaatgtttagacaagaaaacacgtaacaagttggtttacagaaatacgaattagatcaatcctgcactacaagtagagtaaagtggtgatttctcttaaatctctcgaatggtgatttaagaattcagtgcaaacctaatccttgctataatcaaatgttcggtaccgcatcaacggaacaataaaaagcacctggcataccataattttttcattcttgttgaaatttgtaatttaagatgcatgagaccacacgaccttaatgttcaacgtgtcatgcattagtgaaataatagctcacaaaacgcaacaaatatagcaagataacggttgcaatccataccaaactaacgtataaagtgagcgatgagtcatatcattatctcctgcctgctaaccatcatgtacaccatccgatcccaaaaatgacaacttctagggatgaacctggacaaggcttagggtttagggatgaatctggacaaatgattgttcacgttcatccttagatgttggtttctccttacgggacggagggagtatatgtgatggacacaaaagttactttcatgatgaaaccaaaggggatttgttagggcacctaatagaacatctgtccaaatggcatgacttacttatatcctaataggatatccaagaaaaactaacactctaaagcaaccgatgaggaattgaaagaaaatacgtgccaacgcatctataaatggacaagcgcaatggaaaccctccttatcgttcacacagttcaagcattatacagcaaaatagaaagatctagtgttccgcagcaatgaagatcattttcgtctttgctctccttgctattgctgcatgcagcgcctctgcgcagtttgatgttttgggtcaaagttataggcaatatcagctgcagtcgcctgtcctactacagcaacatgtgcttagcccatataatgagttcgtaaggcagcagtatggcatagcggcaagccccttcttgcaatcagctgcgtttcaactgaaaaacaaccaagtctggcaacagctcgggctggtggcgcaacagtctcactatcaagatattaacattgttcaggccatagcgcagcagctacaactccagcagtttgatgatctctactttgatcggaatctgggtcaagctcaagctcaagctctgttggctttgaacttgccatctagatatggtatctaccctaggtactatagtgcacctagtagcattaccacccttggcggtgtattgtactgagttttaacattacagtggttcggaagttaaaaataaactcagatatcatcatatttgacatgtgaaactcagggtgatatatcctagtacatcatcgtaactaattaccatcattggtactctacaattttactgtgtgcttacattcgatccgaagctactttgtctttaagatataaatggagtgtataaaagatgtccatcctttaattccaataagaacaaacacgaagcacatatggcaaatactaaatccactacaacaaaatcatagaccataaaacgcacgtaaagatgtagcaatgcacattgattcttcatccactactaaaataagcgcatatgaaaggccgcatatgcatgatcattgtgaatatgacatgcgcttatcgaccaaacgtgtcacttcatgcaaatatgttgtttcaagcgacatcaagatatgatttcaaagttttaaacaatggtatattaatgactttcatatatgcatattagtttcaattgaaagccatcttgttgtccatccttcctgacaagatgtagtgtacaaggcattctttagttgagcctcgctcactttgtatcatagaagcataacctagacgtaactaatttagtatagaagcaaaaagtgtagcagaaacaacgagggtggaaactagaaagaaggatttatgatgtttcttagtttattcagtcatgaaagagtgactttaaaaaaactagtaatcatgcacgtgcaaggcacgtttttcatattacatatggcatcaacgtaatattttgctgtcgcaatatgtatataagacgatttatttcaatgtggtgataaaataaataaaccaagcttcatgttaatccccattcaagctaaaaaatgcaaaaaaaaaaagagagctcattgttgcatacgatcggaatacaatagcgcatgaaatctatgttggtaaaaaaataaatcactgaaacagagaaggaattaaagtttttatatagtcaagtcaaatttgaaagagagtaatgggttttgaaactaataagaatgtattattataaagatgttgttattccatatatttccaaattgaagttggatcatccattaagatttctttgagttgattatatactacgggccttcagatcgaaaaaaaaactcttctcgaagttgaactccatttaacatacatggaacttccttagtattttgcgaacatcaatttcaaatattcattaataagaaacatacgtagtatttttctgatttttcaagtttacgacttattgtttaactgtcattcatttgttttgaaaaaaaaagcaattttcaattgatatagcacagccgcacaccccttctgagatgagttctgattagcatctcctgataacatggcatctcttctttacaagcatacaaaaggacatacatcagaactatttatgttaacaccaaataaatggcagagaaataactaattttgatttaattagattaagacagtcacaatatccagcttgcgcttgttgccggcgttgttgattgactgcttgctcatgctgaagtagcctaggaagatctgcacccaatgtccctacatcaggagcagactttcttgtgttaagttcatgagagcttgccaggcttgtgttaagttcatggcatctcctgaagtttatgcattcatcatctagctttatctcacattagatggagcaagctggggtcttccgatagcatcataggttgttgaccctccgcaccgccgctgctatggaaccatgaagaagtgtctgtgtcacctattcatattggaactaaatttggtaaaggttagtcagatatctgaacctaaaaccagcattgcacatattgaaatttgatgctgaaacttattacctgagcagcagcacattgtagtcatatgcttctttgcaaagttctcctataca

SEQ ID NO: 74751 - DNA, 1022 bp, Oryza sativa
acaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgcctttgctcttcttgctattgctgcatgcagcgcctctgcgcagtttgatgttttaggtcaaagttataggcaatatcagctgcagtcgcctctcctgctacagcaacaggtgcttagcccatataatgagttcgtaaggcagcagtatggcataacggcaagccccttattgcaatcagttgcgtttcaactgagaaacaaccaagtctggcaacagctttggctggtggcgcaacagtctcactatgaggatattaacatttttcaggtcatagcgcagcagctacaactccagcagtttgatgatctctactttgatcggaatctggctcaagctccagcccaagctctgttggctttgaacttgccatctagatatggtatctaccctaggtactatagtgcacctagtagcattaccacccttggcggtttattgtactgagttttaacaatatagtggtttggaagttaaaaataggctcagatatcatcatatttgacatgtgaaactcggggtgatatatcctagtacatcgtcgtaactaattaccatcgttggtactctacaattttactgtgtgcttatattcgatccgaagctactttgtctttaagatataaatggagcgtataaaggatgtc

SEQ ID NO: 74752 - DNA, 2945 bp, Oryza sativa
cttttccgttggtcgtgtagacgctgcagcttcggaagatccgctcttcgtggaagttgaagccgacgcttgggaaagcgagcaaggcaagacacatcatcttgatcatattgaatcctagtttataaaattatgttgatttaaattattgcattatcgctttatttaaattcccgcgttatcactgttttatttagccatgcctatttatctttgttatgaccatatcattattgttattgttatgattattaccttgttcaccctagacaaacaaaacctcaactagtggacactctactcatgacaccactagtttaattttaggtagatgcttcgcaatttaattaagtaacattaggtggttttacaactttagactttggggatactcatatcacctggacactttggaattgttggtttattgtggaattggcttcacaccgctccttctattcaaaattccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttcgatgctgtttactgcaaaacttaacccctatattattatccccttgtactcccttgcattaattatgcatctccggtgtggcttgctgagtactgtggttgtactcattcttgctcaatctttccccccttcagtaagagaagctttggagatgatgtcttgggtggagtcctggcttataccccagttgagcgcctgtgaagatggagccgtaggcccgctagtccgctgctgtttatttttgattgtcaggccttaagcgcctttgtaataatgtaaatattatcgatataataaagatgtgtcttttatatcatgtttgtttggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctttttgcaaaaggtttactcccttcttccttcttcggatttcaactagtactagatggtcaggtcagtgaagaagaagacatcgtcagttgtttgccgaagctccggaagactgcaggatctgcgagcgaagtggaggaagcagtgaagccagctgtgaagcaggagtgaagatcttgagaacccgtcgcagaacctaagccaccctctagggtagagtcattagtcgtgtgtttccttgcttgtgtgtgtagcgcgtggtttgcatcagtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggcctccaccaggaatgacaagacgtcagagaagaaacaccttccgaggtgcaccacagttgacagagcatcttttagctaatggaggtagagtgtctgatagtgaagattcagatcaagtctcctcagaagatgaagatgagaaatctccccaaggtttcaaccaggataaaatggaacgtaaggcatgctctcgttgtggagaaatcggacatgttgccagctcgtgtgcctctacatgcgttcattgtgaggaagaccatccacccgacaggtgtccaacgagcaggatcacttgtttattttgtgaaggaactgatcatgtaccaaaagatgtcaattc

SEQ ID NO: 74753 - DNA, 2613 bp, Oryza sativa
tggttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaattggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagtcaacaatagtggcctcactcatctgtgccctctcctctccttccgatggcagcggcaggcgtaggtgacggcggcggcacggcggcggtggaggcgtgggatccggcgggcggcggccaacccccgcatggatccggcggcaggccgccctcgccccccccctgcgggatccgcctcccctcccctccccttccttccctccccagattcggcgaaggggaggggcgttagtggtggtgcaaccagaagggagcacagatccggcggagcgcagcgcggaggccgctgccaacgagggcatgagcggtgtcctcgagcgacgacggcaatgacaaggaggaggaggaggccgcaccgctgccggaggattatggggttttcatttttttttgaaattttgtttttttcagatttttgtttttccgtgtaggcgacataagcacccgcacgcgaaaatctgattttcgcgtgctggtgcgccacccgcacgccaaaatcgcgattttttgcagaccctgggtgctggtgggctgctcacccgcacgcgaaaaccggttttgaccgcacacgaaaatctttctcgtagtagtgcgttttcgaacagtttttacatagatctagtgcaacaaggaacaatttcacccattaatatccaaaaggaaatgcctttgcagtaacaaatgggaatatttacgttgcctggggtctctataatatatgtgtcgatcaggatattgcctttacaaaggtttcattctgccgcgaaaacacttttattgcaacataaactccattgtgtgaagtcaaacaagaaattaaactataatcccagaaattctctatgaagtaggcaagagaataattgaattgatcttgggtgccttaaagtggacacaagatttgctgtaaatcttttaagtggcttcaataagttaaattactcaatcgtggttacaccactatgtagtggtggcacaaactatatgtacagtgcaagcggtactatctcaaaagtttcagtacaaagtatttggagcttatttaaaggggttaaaaggtaaagtgagaacattttcttgttactaattcctttggattaacctttaactactgtaccgacaaatccaacttttgaactacacgaacctataaaagaggacatggatttttaccgtcgtctgccatttgactattcaaaatattgagacttagagtattgagatcaagacaataaaggagtatccaaatttgattgtgtgcctcttatttctattgaaggataaatgaattgtccgtcttttctcattacctcaaaagcttatatggtcagcctatattgtcaaatatgaaacagtaggttggacttgcaatactccgtattaaggaggcataagcaaggtgatggaaaaggcagcctacctacgaaagaaatgtctcgatcgaaagcaagtcagaagccaaaaactgaagccaatctcttttatcggttcaataattgcttggaccacatgaaattccccggatacttacacaagtcgaactattttccacgaaattcttgcaagcacttacttgagcaagcaaaaaagactagctattagcccatatcggcgatagtgaactccactgctcaaaacaaatgatccaaacaagccctgaaagctccttttccccaaggcaacagctaactgaaccagcaaaatctgtctgcctctgaaagaaacaaaacaaagagaaaaaaaaaaaccctttccctcccttctcacggcactggccaacttgcaagttgcaactgatgtgaagcactcactgagactccaagcacctatatgcaggtagctctcagcacgcttgagttggtgatgccttgattcccactgttttgtccgtcaaatactactgcgacgacgacgacgatgacgatgacgatgacgatgacgatg

SEQ ID NO: 74754 - DNA, 7849 bp, Oryza sativa
aggaaaggggggggaaagaagactttttaggatttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaaacctaccccccttaaacggaatctcgaccccgagattcggaggaactggcgaagagatcgggatgggctgccttcagctcgtcttcacgctcccaagtagcttcttcttcggcgtggttgctccactggaccttgcaaaaacggatcactcggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttacccaaggaggcgggcaactccagctggtaggcgacttctccgcgtcgagcaatgatacggaagggacccacataccgaggtgcgagcttcccttttgtctgaaacctgtgtacacctcgcaatggcgtgacccgaagatatacaaaatcacccactgcgaattccaggtcacggcgacggttatctgcataacttttctgccgggactgtgccacctttaaattatcccgaatgattctgactttagcttcagcttctctcaggatgtcagtcccgaacacttggctttctccaacttggtcccacaatagcggtgtccggcatttgcgcccgtacaacgcttcataaggtgccatttgtatgctggcttgatagctgttgttgtaggaaaactcggcataggggaggctcttatcccaggtcttcccgaaatctagtacacatgcgcggagcatatcttctaggatctggtttagacgctcggtctgtccatctgtctgcgggtgatacgcggtgctgaaattcaatcgagtgcccagctcttcttggagcttcttccagaagtgagaggtgaattggcttcccctatcagatacgattttcttgggaatgccatggagactcacgatcctagcgaaatagagttccgctagtttgttccctccataggtggtcttcacaggaataaatcgagctacctttgttagtcgatccacaattacccatatagaatcatatccaccttgggtttttggaagtccagtgatgaaatccatcccaatttcatcccatttccattctggcacttggagaggttggagaagtccggccggtcgctggtgttctgccttgacacgctggcacacatcacatagggccacaaactctgcaatttcccgcttcatgctgacccaccagtatttctccttcaaatctaagtacagctttgtactgcccgggtggattgaataaggactttcgtgagcttcctgaagtatcagctgtttaagttctctgttatcgggaacgcacacccgctttccgttccatagagttccgtgttcatcctctgtgaaaccagcggctttaccctgtttcatattcttgaggagtccatgcatgtccggatcattcttctgagcctcgcggatttggtcgagcaaggtaggcttggcttctaacgcagccaagaatccacgaccaactatgcttaggttcagggcttccatctgttgattaagttcgggtggaatgcctcggacgttaagagtattgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaaatcatgtgtagggtagttgccttcatgaggccgtagctgacgtgaggcataggctaccacatgaccatcctgcatgagcacgcaccccaatccttggcgcgaagcatcacaatacaccatgaaatccttgcgagtatccggcaagattaacactggcgaggaaaccagctttttcttgagagtttggaacgccttctcgcattgcgggctccacacaaatttctcttctttcttcaacaactgtgtcatgggtcgagcgattttggagaagttctcgatgaatctccggtagtatcccgccaaacctaagaaactgcggacttgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggttagaccgaacgacatcaccgtgaattcatacagcccgtatcgcgtggtgaatgcggtcttcggaatatcttcttcacggatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttgaattccgccaggttctgatttgctgccatacggtagggtcgcttgtgcagaggagtggttcctggagcaagatctatccggaactcaatctctcgcttgggcggcataccaggtagttcttccggaaacacgtctccgaactctctgacaatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaagaatcacatccaagttcttggtatctagcagaatcagatccgaggaaaaaggaatcccctgaatttctatagggacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcggggcgcggagcgagattgctgctgctgttgttgctgctgtgaggaggatccccctggatagggattggtgtagcggaccctttggttagcaccctgttgattgcggaagttcgccaagcggcgcttgtgcgactccagttccttgtgcttggcttccaagcggatgctcttgtccaccagacgttggaaatctggatagtccccggagactagacggacggacagctcagggtccatacctgccaagaacttctcttgcttcttctcatcttcccgcacatcctccggggcgtaccgggccaggttgttgaactcatgcaaatactccatcacggagcggttgccttgcttcaactctcggaattcccttttctttagagccatgactccggcgggcacatgggttctccggaaggcggcggtgaagtgggcccaagtaataggctgtccctctggctgcgtagcctggaagtggtcccaccatagagatgcgggcccctgcagctggtgggcggcgaagatgactttctcctcatcgctgcactgcacagtgtctagctttttccccacggcatgcaaccaatccaacgcatccacagggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtggaggtggattgccttgggggttggggttgctgccttcgggttggttgccttcaccggtgctaacatttctcctggtcgtcaccatctgaaaaccccacacagaaccagcagacagggagagctaacgattaaaactaaccacccacgactactataaatcttgaatttattactgacattaaattggttcattaagttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctaccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgttgttctccaccatgccacgacgcaccatctgatggaagtcgatacgagccgcgtcgtatgcctccaccatgcgtgccagatgcacgacggtagcgtcatcctccgagctagcatctcagaaggtggcgtagtcacgggctcctccgcgacgagggtggtagcgatagggcgagtgctgcaactcgtccgggtagcgctggtgaagggtgccgatggcgaggaaagcggcgttctggcaagcggcgggaaaggaatctccacccgcggtgactgccagcgaagtccgctcgggagagccggagaggatcactgcggtgacctcccaaccagcgtggggctctgcatcctcaccctcctgctccgggagcggcctggcctggtagtccactccatgtggatatcccaagaccacgcacatgccccgcagctccaaaacgaagccagtcatgtccaaaccacgacgggtgacgctgccggccatctacaaacaaaaacaaagagaaaagcaacattttgaaggtcaggttttgatgataaatgaagcagcaagacagagagagactagacaattttcacaaataatcaaagatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataatcattacacgggcagcgaaggcccagcacacaaagacaacgaaaaacagcggaagactagggcgacgaccacaggcgcttgacggcaggcacgagctagacaccaaagccttcatcttcaaggagctcctcatctgtgcttgggaaaaattgagcaagactgagtacaaccaccgtactcaacaagacacacccacaaatgcagagtaaatgcaagggagtacaaagggaattataatataaggggttaaggttgcggtaaacagcatttaagggcatttagttactcaaagctattttgccaacgcgatcctagaactaaacagtgttattaatcaaggccgtgaacccacacgaacctgccttaacccaaggcctacgatgatccggaccgaactggcaacccgaccctgggtcccagctcgtcccaagccaacccaggccaaccattccacattttagttgtttaagcaggttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggtagtacggtagtgctttgcaacagaggcccgaagaccggtccttatacggccgaggagctactgtcaaaaccatgctccccgagcccagcctaaaaccattttggggaattttgaatagggggagcggggtgaatccaattccacaattaaccaacaattccagagtgtccaggtgatatgagagtttcccaagtctaaagttataaaaccacctaatgttgcctaattaaattgcgaagcatctacctaaagttaaactagtggtgtcatgagtagagtccactagttgaggttttgtttgtctagggtgaacaaggtagtagtaataacaataacaataataaaatggtcataacaaaggtaaataggcatggctaaataaaacagtggtaacgcgggaatttaaacaaagcgataatgcaataatttaaatcaacatagttttataaactgggattcaatatgatcaagatgatgtgtcttgccttgctcgtcttcccaaacgtcggcttcaacttccacgaagagcggatcttccgaagctgcagcgtctacacgaccaacggaaaagaaaaggcttaaccactaaataactccacataacagcagaaacaaagcacaaaaatgggttctttacatcttaaggaaaaattagggacttgaacggtccaattccgagttcaaatggccaaggtatggccatttgaagcttatctgctctttaaatggatatttagaatttcttcatttaatttttaattaaaaacc

SEQ ID NO: 74755 - DNA, 516 bp, Oryza sativa
atagccaggcaaatatattatccaaaccagagtaatccaagaggtcgaatgtactgatgcagccttgaacgatgccgacgtagacgatacaattgcctgggccgacggaacattggactgatcccttcgccggagatcgaagacgatgcagccccatgtcgggtgccaagttccgccggaacgtaaaaacaaaagtagaagtaaaagggtggcgatgcgccgaattgtattgatcgtgaagatagtttacaatgaccccgggtgtacatatttatacctatgggtagatactagtccttgtaggacaagaaagaaactttcctaaagataaaaggaaacttacaaactattcctaattaatagataacttgccatgccgcattcttttgaactcggtctcttctggataaacttcatttagtagatcaatttccttaaccgaatatagcaagaatccgacaactgacgacttgacaactctcatcggctaatctcagacttcaaagccgatgctga

SEQ ID NO: 74756 - DNA, 1687 bp, Oryza sativa
gaacagtccttgaaacacaccgaaccggcgaggtccctagtttaggttttttccggttgaaccgccggtccggtctggttttttctactgtgatctccacacacatctacatgtatccaacgctttatggctgaacgcccctttagttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagtgctttatggctgaacgccccttcagttgatatgtgctatataaattatctacaaattttggataggaccttcagttgatatgtgctacctaaattatctacaaattctggatagggctgctaaaaagaatttgctacctaaattatctacaaattttggatagggcagctaaaaagaatttctccaagaaacatatttgtttcttcttgaggttgtagctcctatctaacaaattgatgattgtacctactatctaacaaattgatgttaatcaagtcccgtcatcatcaaattgttaaccattggatgaatgcattagatcgcttttcagacgttggatggaatacaacatagagcccaacccattagtcaccgagtgagtctcttcgccttctcagtgtcaaatgtagcccacatgaatatattgacccatctgcaccatagtataaaaactcggaccggacgtcgaactggtgaggcctcggttcaccggtccaaccgcggtgttaaaatttattgtttattgcacaccacaatggtcagtgtggtgtagtggtggggaacttaacgctccatccaacaatcctgggttcgatccccatgcttcacccgatttttgaacaataaaataaaactgggccttaggacttgggcttcccattagggaagatgctgtccggtggcccagctcgtttgagccggccggttttaggagtccccgcttcagaggtttttcctgaaaaccgtcggttcacaccgggtcaactgcacgaacagtccttgaaacacaccgaaccggcgaggtccctagtttaggttttttccggttgaaccgccggtccggtccggttttttctactgtaatctccacacacatctacatgtatccagcgctttatggatgaacgccccttcggttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagcgctttatggctgaacgcccattcagttgatatgtgctatataaattatctacaaattttggataggaccttcagttgatatgtgctacctaaattatctaccaattctggatagggctgctaaaaagaatttgctacctaaattatctacaaattttagataaggctgctaaaaagaatttctccaagaaacatatttgtttcttcttgagggtgtacctcctatctaacacaataatgattgtacctactatctaaccaattaatgtaaatcaagtcccgcagcaacgtacggggcatcctttagttatacatct

SEQ ID NO: 74757 - DNA, 5372 bp, Oryza sativa
tcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggacccccataggctaaggcccataaagactccgcaggccgcacacgagatgaaacatgaaccaacccaagaacttctgcaggccttcggtgagtgcctacagttcaaaagaagatactatcaataaaatcatgtacatgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcagagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcaccggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaaccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactattt

SEQ ID NO: 74758 - DNA, 2503 bp, Oryza sativa
aagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacagtaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcggacactcgactgggcagagaaaatctagcgttcatgcttatttttacttgaaataccataaagcacaatccaagagattttgttgatagaaacttagatatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagtcataagcctccttggggctgcttgaaatgctttctgcagagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctgtaaaagaacgagaagtgcatccacaccaccacaagatatgaatgactgagcaaacatgttggctctagaaatgttaggctgcacaatcaacctatagatgaggtgcaacacccttgcaacctgttaacaaggacattgttaagatcacaagaaacagcttagactatattgtcagatgagctatatagataagatggccctagactgctacacatttgtattgtctttcaaatgatcaaggcaagtataaatatatcccaacagaaaaatagcacgtactccctccagttccataattcttgtcgttttggacaacaacatgatctccaaaatctttggctatgattttctattataatatatacaaaaaataagtaaatatttagcttttaaaaaatatttttaaactaatatatgcatcatgttctagtgtcttcaaattaaatattttaaaagttagtgatagtcaaggttctaattgtttgacctcaacctcatccaaaacgtcaagaattatggaactggaaggagtaaccacagacaagctttaagagcaaagagctgatgcaccatcaaatttgttgtgactcacggttaaaataatacccacttatccttatgatatgatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggagg

SEQ ID NO: 74759 - DNA, 24741 bp, Oryza sativa
tactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgccacaaacaccatctgtgtcgagcttcaggaaatacttccataatagcattttgcattgctctgcactgatcggtaattatggcgtttggtgctttatttgacatacatgataaccatgatctgaataaccaaacaaaagtctcagtttcttcatttgatagcagagcacatcctaatagaactgattccccgtgatgatttacaccgacaaaaggagcaaatggcatatggtacttgttagtcaagtacgtagtgtcaaatgtcacaacatctgaaaaagattcataggtagccctacttcttgcatccacccataaaacattttttagtcgagagtcctcatccacgtccatgacatagaaaaagtttggatctttggacgtcatacgcaggaaatactgataaactgcatgtgcatctccagcaccaagcttaagctttcgtacatcttgcaaataatttctgcactccttttcaccaaattgaagattctcatagcctccagcttgcataactagagaactaaaattcttgtttatacgaattcttgcttggtcattcaactctagccttctcttagcttgcaaatcaagtttcttgtgacatctgagatgtcttgctttgctaggacttacaacatgattatggtcaagagtaagcgtactaatgcagaatttctcatcatgaagataaaagttaactttagctgggcactgctgccttgtggaggggttaggcttgaatttatttgttgatgtgtactgtgccttaccttgtctgctacaagcaagtgtgaaatatctcaccttgccatcctcagttttcttagatcctctttttatcacaccgaatcctaactttcgagcataacttaatgtaaaagcaagtggcactatcctcactatcaaatagcatacctttggttggctccaacagtttggttttatctgctaccagagcatttgaatcactctcaacctcctcaattgcaaagccatcttcatctgatatgatatgatcttcttgctcatcatcagaacatagattggtgtccattaccttaatttggcaaggaaaattaaatcgattttaaaagcaaatcaaatatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgtggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatgggaattacaagaacgacctcgcgatacttcggaaacgtatagtccggctgtgagaaaagcttcagtcgtcgcagattttgttttgaagtgaactttaaccacaattattagaacccgctaattaacctgttgggcctggccaaaatcaccacctcctaatgggcccatatatatctggcccattcacatgcataggccttcggtgtgatcagtttgtgcccggcccactaaattcacgtgaatgtatttcttcactccgcctcgttttaatgagtcgagataatggcccattcatattttaagggcctatattttagtggaccggggactaattagagtgaggcattgaggacagaaggcgagagaggacatagactcaaaagtcaaaaccgtctcgagggtaagtggatcctcttaccttgtgtagtcactgaacatatgcacctcacttcattatggcttacatatcagtggtgcaactataaactgcacaaattcagaggagcatcgtccatctcgaggaggagaagcgagcgagcagccaaacttgtctatttcgtgagctgggcacatctagagagatgcgtcgagaaccatcggatcgtaaaagataaaaattacaccttctaggtgcgacaaaaataaagacatatggctatatagagaggatgatgagctcatgcaggcgcttcacctcacaaacatccacgtactagattcttctttgttttttccaaaaggatcgatcgttaaattctccttctgttcaaaggctctctaatttctttctttaattttcatattttccaaatgactagggatctgatcaacagcgctaactgccgatcagcggctgaaactaaggcagttcaaaacagttgcagccggtagctctttacaaccaccatagctacaacagttgtggcagtaagaccaatcgaacatacacatagaaggacaatggcatgtacaggcgaatccagcgtggatgctagggagacttaccgattgaatcccccctaccccgctagatctctattgatagaaggagagggaaagggggagaagaggtagaggaggaagataatgaatggttgaaggagaaaggagatgagtgtccctctaatcttattcaggattcgtccctaagtgcatgtgcgaagtcctttctccttggttacgcattgacaagtagagagcatctcccaccactcatatagacaatcaagctcttcattggatggggcaagttgctaataggtggtccagtttgtcactagcccctggattgttagagtatctgtgagtgaaatgaatgttctattaccacatagtggctagtgaataatgtaaattcttttagaatttttttaggagaacgacggtaggagatctgccggaatttaaattagggaaaaggccgaaacccagcaaagagtttacagagtttacatggactataacaaagaggaaatacagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtccaattactttgttacagtttcatggcggtggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatgataatgatatatatatacacaaacactccaacatatggacaatcttgcaatacagacttgagtacaccaccgagtcatttggcgcacgatcgatgataataattaatttaataggaggacttgaagacttgctctcatccctgcagctagcgagcgtgattacatatatagagacgaaaagagttgtgttctatggtaatttgccaatgaattcataatttttagcggtagacatttgccggtaattttgtgtcatggtgaagtgtactggtgccaatttttctataaactggcacacatgatgatcctaggtgttggttcttagtttgctagtgatgttggtgcattattcgtgcagttgtgtttgcctacacacgacacacgcctaacattgccattgtattgttcttatatactacccctgccctataataagttaatctagtacggcatgtatcacatatcccgtactaaattaacttattctgggatgatgggagtatattgatttataattttagaaatgaaaagaaagctcttgaatggaaaaatgtacaaatacaaaacattctcacatgacctcgagcaagagaattgaacactatctgccatctatagcagataatgtgataccgttaacactagatgccgcaataacagttgacgcctcttcgttcgtcagcctcatgttgaaaaatgcagggtgcttaggctcaggtagggtcatagtctcgttgcttagcattgcaacaacctctgacgtggtgggccgatcggccgcattctcttgcacacaaagcaaagcaatgttaatacatctcattatctctattgtatgagaatcggtgggtaacaatgggtctacgagttgaagccatgtttcatctttccacatctgccatgcctgcaaggtgtatgatcgcaaaaaacatgaaaacaatctacatgacattagtatttcttctatcgaagaagtacgaaaaaagactttaattttatatactactgaaatcttttcgctttgcattttaggaagattagaaactcaagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattttagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatccaagcttttatttggcaaatattcatatattagtattttctcctgtccctggtaacagcatcccaagagcctaacaagatttgtgtgctggagcttagctatgagttggatttcatttttgaactctgtcaagccttgccctgaatgagaagcaagtctcttaactgctatctccaccccatcaggaaatcggccctagagacaagtgcaaaagagatggatgagtgacacgagttaatttgcagtttcaattgacttttgacacttgacaaatattatgatcaagatataatcggccaaagcagagagtgaattgcataatactccatgtaaattaacgaataatatatgtgtataacttttgtcagatttttcgtcttatgtaccttgtatacaggaccaaagcctccttgcccaagtttattttcttctgagaaattatctgtggcctctaatacttgcgaaaagtcataaatagtgaattctgaacttcttccttgtagcccccaaattagtgcttcatcttcatccgcgttcgtcttacctgataaatgtagaattggtttgataatatcagttgatttagctctttatgcattcatgcatgtatgtaactttttttatgtagatatatatctgaccttttatgtgccttctcaatatgatggaagcgatgatacagagaaacaatgcaagtagtggagctaccaaagcagggaccaaaacttttgctacgggctctatagattcagagcaaatggttagtttgttttgttggaagcttggtaaggagataatgaaagtaatttttatctttaattactactactctcaaatatagcaaaattagaactgaatgtgacacaacctagtactacaacgattatgaatctggataaagggattgtccagattcaatgtaagtaataggatatatgtgtgtgtctcctatctaatactaaattgttatattttgtgatggaggtgcttaagtaaagatagtctctacgcaaagatgtcaaagaagggcgtgttttgcttactcttttgttttggccatgttggcagtaatggggcgggctgtggcgctggacttggaactagtgcattcgacgacgacccggagctccacgtcggctcaccggcgaagaacttatccgtgtcatacctcagattacaccggagagcaagaatacgtcccccttgccgaccggcgaagttggccgtcgccagatcgctgaaattctgaagacagttgtagcagatatcttcaaccaaatctggagcacactgtgccaagcagaagagcctccttggaagggtaacggtgttgcttgcatcggcatcatccatgtccacgcggattgcagcgtagtgcttcgtcgtggagagagcttgtgctactatgtaattcatcgtcttgatgaagaattgggtgaagttttttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtacaaggccagactgaacgtaaatgcatgggcccacacgttgaaattaatttagaaggtggttgacatgttaaatcatgctttctaatgtcccattctgaacatgatatattttaataccataaatctaaatataattatttgaattcgtaatattagaatgtttcgtattcaatactatatatactacttttacgagatgacgaaggaagcaagtatataactccgtctccaccatcatggctgtgaccatagatagtttcaccataaccgtggaaccccgtgtgttttggtttcattttgcttttcttactccgaaagcctatacaatatgtgtccttttctggataaggtgttggattttttttccgctgttgttagtactcttttcaaaatattaaaacggtgtgtttcgtgtaaaaaaactttaaatatataagttgctttaaattatcaagtaaatccaaaattttaaatttagagcaattaaaacttgattagttatgtgctaataacgagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtttagggtggaaaataacgtctaagatctcgtttgtttagagatacatatatgtgcgggcgtgccagtgtacctaaatacacaatgtaaacaaaacatagagaacatgctctttattaatcttaaaagatcataaatacaaattcccaatgtaatatatatgtatgcgcgctccataatctgtcattggacagatctgacttgtgcgatgtggtctcctggttcctggggcctcgaaaagctcccagttaattacctccgcaagtctaggcctgcaagagaacctccgattaagctgcttgtggtcgtctcgtcgtcttcgcttcgcgttctccatgcatggttgggatgatgatgtagatgtgtgtgtgcgagcgccggcagcgatccacagcctcgtcggtccgtgcgccggtgttggtagcgtggccttcgtatcgacttcgcccgccctccgtcgtctagcctcgtcggtcttgaacaacatgcatggagttgcgtagctcgaacgacttgacgtcacagcagttgcgtcgagattagattaggaaagggagaaattattaaagatggttgatgtagacggtaaccggatttaatcaaagctcggcatctcatttgggacgaataagaaaaaccaataggacttcttcagcccacgcattggtttgtgcatggcactgtagcagtgatgacatgtcgtcctccgattggttggccacgttgccacaataattaacttaatcaacatgcattagctagcttgttgccatccaacagcactggctcgccgtcctcccgtcgtccttccttcgtactgcagccatacttgtctccatcgtcatccgctggtttcgacgccatgcgtgatacttgacctccggcatgggaatggatagaaatcttggcagtcggtggcagctccggcgatcctcggcgcgctccggcagggcggcttcccgatgacctcctccatggttagcccgctccagtgcggtgaagcttgcaaatcaaggacgtccggcatctcggcgaggtcgcagcttcgggtagatgcatcaccagcagcttgaattagcagcgtcgagtccagggacaagtagcacagcgtcagctcgaacagacgccggcatcgatgaggcttctgtgacgcgtagatgaatcggccaccgcgacttccccggcgacgacgatacgtgcagatggatccctatgcatggatgtgtgcgtgctgtagatgaaagaaaacgaaacaatcttgctagcttttaccttgactagccatcaagctcctctcctgcgcttgctaatgatcggatcaccgcgcgcgccctctcctgccagacgtcgggactccggccgaagtcgctcgccgccgccggtgcgtgtcttcgatggatggatcgccgatgagagttgatggatggatgtgttgatgctggatgggcagatgcgttgatgatgggtggcttgtggatactggatgcgttggtggatcaatttgtggataagttcgtcaatgccccaggctgccgaggggtcgacgccttatataggggcctaaggtcggtgctcgccgcgtccgcgcgccgtttcgtccgcgtcaagttcgttgcagataaggctcgatcgatcagtttgttatttgttcatatccttcttttattttatctcttagcctctcccggtgtcaaatatctgagctctgttaacttctggagcatcggggagatggaggcccagccgcccgcgcgtgcgcagctgggtggcgattccttcatcattatttctgtagataagaaacaatcaatagagataaacttgatttgtaatttgctttgtttctctgctgctgggccacagtccggtgataagcgcctcgccagcgctcgcgcgaagtaactaactcgatcaagtttgttacaaagatagaatcaattggtttgttggttatctcttaattcatctggttttatctcttccgcacgcgtgagcagaagttgttcagataaattgaaaccccagcttatctctctaatttgatcgataagtaaactcatctagccgataaatcaaaactgtggatatgtataatacgccgtgattgtgtcattcattgatatgggctaagcccaggggcaggcgcattaaatttcttaattaagcccattaatcacctcacccttaatcaagcaccatatatttgtgtactgccatgcatgcatgcatgcatgcatgtacgtagttgcttcaccggccgactgacatagctagcttgctcttgattcagtatacacacgcatatatatactaattaacaagtatagattgggcacagtgtgtatttctatatttgcatggcgcatgcacacatgaaatggagagctagctggcctcacatatacctaatgatcatggctatcaggttcatcgttctagccgctgcaaaaatgccatcaaacactcagtccggtctaagaggattaacaaagacaattaattagagtattggaactactgtttgatacacgtgccttctaagcacaaacttttatatataaaagatgaatgattttagaacaaaattttccagataaaagttttgtaatgaaaatttcagaaaaaaaatgcactggggacacactaaatatagcgatctctagaggctactactgacgtgcagtgtcactagtattttttgttcttcctaaacccaaacataatatgtgggttcctggtgatgacatcactgcaatgcagactctgttcacgcccatcaacagtactatgggccttaatgggccagctgttgggcctagcctccctaagcccataatagcttttggtcacctattgttcgaatagttctcgagatattgttgtattttttgtttcctgtgttctttcatctcatacataacaatatagcagatattttgtaaactatatatgcgtacttcctagttaaatgaatgagcagtgtcctgcttaatgtctaaagtctaaactcgaatacatggtgccacacggccgaaagtgatcccacgacctactcttcatcgttttctaaaaaatgattcaatatttcaaactgatcctcaaaagacaaatgaaagtatgataaattggtcttataaaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaggagggcggcgaggtgccggtgcaggtccggcggtggcaccgccaccgccgtggtggccgcctcacagcggataatatccatggtgatattacatctgatatagaaactttgaccgtctagatgtagacacgaccacaatcgactgtccatcttcttcctcttgatgaatcttgtatgcccccaacttggccagtagccattggcgaaggagaatttcttggccgtgcagatcttctcttcgaccaccgcaccgtacgtcccgctgagtagactgagcgtgaatttcgcttcgacgacgtcgtcggccgcggcgccggcagctggccgggcgaggcagaggtagacggagacccagtcggagtactcctcgcggtcgccgtcggggtagtaggctatgtaccaggtgtggcctccggcgtggaacttgctggagttgatgctgttgccgacgccgatccccttggtttgagagtagccggcgatcctcatggtcatcgacccggttgctgtctcgctcacgacggccgccgccgctgccgccgccgaggtggttttgggtttgggcttaccgtcgccggcagacttggaagtggtttgacccatgggtacaacaagctgtacctgccacggaacctagacaaacagatcggaggaggacgacgacgatgagttatcgatatgatgcgtctcatccacggatagattaattttgtagattgatgggaattagaacgagttcgatacggaaggaatcactgaaatatagaacgtctcgatcggaaacgtatgcaggtaggaaactttggattttttttttcaatatagatccgcctctgtttcatctctcactggattttatgcacattcgctcttggtccgtttcaatatcgaagcgaatccgtattcaattccgcaaaacttgagataaaaacggacggggtagctcatcgccgggccatcattggcgacagttaaacagaaattaatttggtgaatttaagccaaattaaaaagaaaaatcatggggaaatgataagtgaggggtgaggaatcgatttttacaattgaaagaggaaacatatgaggagacagattgatgtggcggcggctctagaattatgtcaagagagaagaacaagcggcgaatcgagacgcgcgcggtgaaaaaggctaggatgagcgatggctgggccgagcccaaacacagccaggccgagggatggaggggggagcaagccaaggcggggaggaaaaggagatgactttcggccggaggaggaaagtccaagagaaagagagatgaaggcccaagagggagagaaaaagggagtgtgagaaaaaggccgaatgggctggctcagagacgatgacggacgaaaaaataagttgtggaagccttacgtattttttaactagacatataggtatagatgtatagaaaaatgacgtgtgttgcaacagataaagatgtttttcagtgatataatagctactatgagctaagtaataaattgaaacattgggatatcattatcattatacattataattgaaaaagtttatgaaaatgcttccttggattcgggccaaaagcccattaattgctttcttttcagccctagctcagaccgtaggttttgaccataattagatcaacgcatctcatccacaaatcgattaatttgtagatgtgaattagatcgagttcgagacgaaaggaatcattgaaaaacagaaagactcggaaatttttttttaataatggattaaatcggtctctacacccaaagaatatacacagcataagactcggaaacttatgcaggtaggagtcttacttttattgaatgcttaggatttttccaaatagtcacaccaggatttcgtccgtagctaaccttcgtgcttcttgcgtttcaatgtaaatttctttccttttgactagtgctatattgccatgcccgtgtgtttcaacgggatctgaagattcaatgacgaaatacaaaatttctttccttttgactagagtgccatactgccatgcgttaaaactgaatttgaagatttaacttcaggagttgagtctagagtagagttgtggagctgtctaaagccagcgtcacaactctagtttattttgtgagagagctccacccaactacacttccagtttgggtgaaactgaaactgtttggctgagctccagctccaggagaggtggagctggagctagagttgtaccaaacaggcccttaatgacaaaatatggacaaacggttttatgacagtttttcctacgtggtttttcagctggtgggtcgtgaatgaaaacattagtaattttttaaggggtaatttggaaccatgccattataattttgcaaagtttgagatatgccatcggtatctcaatgacatgtaggacccacatgagtcaatgacatgtgggttaggatggcatggttccaattttgcaaaattataatggcatggttccaattttctctttttttaagtgggtcttgcaaacacgtactatttcttgcatgaggtgttttttttttggtagtgattatttcacttttcacttttcttttcgtgaaaacacttgcttttttcatgggccgtgaaagcactagttttcatttggcttgtgaaaacatgtacatatgcttggatagacagtttttagacggttttttcttagaaaggtacgatgctcatggaggaggacaactctattttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgattggcattgatagatgacaagggtctatagaaggagaaacaagagagcgggagtgtaaaatgataaaggatcggaagcattctcccctctactttcttttactctagtattttttttatatcagaatttaaactatcatagatctgatttaaaattcatctatagtgttatattcattttgattaaattaataattcaacacccatattgatccctacatttttagtaggcaaaactttactttatatcgtcttctatccttttcatgcatcttgtaccatataagccaataacaatttggtcagaatctctaaacattgtgtacgttattaaccattagagatacctatgatatcaattactaacagtaaattcctaccagaaaagatattggcccccgtgtctttctgcttggggcaacaatggtggtgattcaggctgccacaacaccacccgcctccttgcctcctcctccctctctaccgcctgagcgggccattggaaatcgtgtggttgcaaggatggtagcggcagggtcttctccctctcttgttgggcaaccgacaagcagcgagctgcgggagccgacccggttgcgttggcttccccagtggtggcgaaggcagaggcagctgcgcaggagcccaggatggtggcggtgacagaggcgatgaggtgtggtggtggtgggacgccggttgcgctggcttccccagtggtggcgaaggcagaggcggctgcgcgggagcccaggatggtggcggtgacagaggcgatgaggtgtagtggtggtgggacgccaggcatagtggaaaaaaccggaccggtggtgggacccctgtcgccaggtcgcagccggatctaggcctccgcacctagccatgagatggtgtctgcaagaggccagacggtttggtgaccgcgagggcgtccacgacggtggtggaggcggctgcatcaaagtgtgacggtggtggaacaacatcggttgtgttacggacggatatgggcttccatgcatagatttgtccatgcatcggcggttgtttcgatgggagagcgagcatcgacgggacgcgatagttggggcgtgaccatctaggggccctgcaccttgatccccgttggggactacacaggccccatcctcggcaaggtaaatggtgcgatgtgagggagacgaggccaacgcacggtggacgcatgctgacaacaaccgtggccaagggcgagttcgcgtgcatggaatttggggatgtctgagagcagttgctggcgactactctccactctactcatgctcatccatcgatgatgggatgtggagggcagcttggcaatgggatggggcagtgtaatgatggccagctgcagcggtgtggacagtttttcccctacttgtgccttctggtgatgggatgggagcgggcatggcaactgttttgtcaaaggggcacatcaagaacataacaccgcccgttttcttgtcctatccatgtcaattgaccaccacctccttgacctcctctcccaccccacaacgccacctcggacccgccaacatgtgccacattgtctctgcagctcttagctagtacttcttgtttcataataatagtttacaaacataggaaaataatacttttatcaaactgtatttcaagatcattttcaaacatagaaaaataatactcatatcattttcaaatatcgatacccaatacataaacataacatgtaaccaaagtttgaaatgaattatcgacttaaggcaactccataaattccatttatttgtgacttggtagtacaaggattcttcattattgacatacatacccatgaaatataccatttacagtatggggagatctatagacgactcgatatgtgactttggctccatataataacatctagaaagtcttttattcagttttctcttatagaccaacaaagaatacatatgggagcaaacaactcgacatctcaacacacaccttggactccaacttcagaaagcttaaatcaagcaaaagcagctattgtatatattcttgaaaatatggacctgtgtaattaatccgccgctatataagaacgtcatatgagacattcgacactagatcagttttaagcatgttcagggccagacttgatagtaggattctatttggagccatcatgtttttcttcacctcctttcttccagaagaaaagaataacaacaaagcccaacacaggtaagagaagcaggatggcatccttgaatgtgcaccaattccgagtactgcctgccgcgtaggctcccaggagggcaagcatgtccagcaacatggctgtgtgcattggccaaagaggcaatttatgttcatcgcccttggtcatccttcgaagcagcaaaacaatgacagtgatggatgccatgaaggaagtggagttgctatagaaaaaagcattgtaccgacgcttgtcgatgtcgtagaggaccgggttgccagcagagtgcccattaccttcatccctccacaggccaccaggtggttttaggcccgtgaggtaggccacactcgcagccaatattcctgctagcattaagtacttggccatcatgtcggctttctttttcatgtcagcttcctgttgatcttgtgtttgtcttggtgtgtccatcatgccatcttccttgttggtttgttgattttgtgtttgttttgactgatgttgatttatgtttgcacgttgtccacgaccgatgattgccacatagactacagctgcaaaaactaccgtaaccaatattaagacaacgatggaggttcgcagatgcatcgaacttccagcagcataggcatcgatgaggccgaacatgcccgctaccatgcagacaaagagcgcatagcactttatgcccggcccgtacagatttcggttgagaaggagaatgatgagagccacggatgccatgaagcttgctgcattgcaataaaaaaatgccttgtaacggatagggaacttgtctagtaggacagggaagcctgcacggtgcccaaactcatcattttcccagaagccacccggtggggtcaagccggcttggtaagtgagtgttgcagccaagatttcaacaagcagcaacaactcacgcttcttctccaactgatgctcctttatcttgtcttcctcaccctgcttgtccgacttcttttctagtgtggagaagagaatgtgaatcaccacatagataaggacaccaccagccaaggcaactgtgtaaatggaagtgcttgtgtccctgcaacttccgacagcgtacgcgcctatgaggcaaaacaaatcaagtatcatggctgcctccagtacatggcttctaactagaaattcattctgcaacatcaccatgatgactagggatgccacaaaagccaccgagttaaaatagaagaagaccttgtaccgcctagggtgtgttgtcaggagtattgggtctccactgtggctagccccattgtctgcccagacgcctccaggtggatctattcctgcttggtaagcaacgatcgccgcaagaatggcaaggagctgaattaattcacaaggcttgtctagatcattgttgtattgtttacttcccctgtacaattaaatagatagttcaattgcagtctagaataattcttttggtactcgaaattgatgatgtggaattaagaatttctagcactcaaaaaatgtgtacaaaaatgcaagaaattctcaccgaatcaatcccccccccggtcccccatgtcatcatgattgaaatgatagttaacaatgtgaaacaaattaatttttgttcggttagcccaatatgtggccttaaatggctccaatcagtaatcactacatctccctaggtcttgattgaggggcacgaaggtcttttccttcctcttaattgatatgtactcaaactattagaaatgctacagcccccctagtactggtcctttctatgcccatgccagcggcatggatgatcgtagagctatcttcatggaagtagaaagcatgaatagaaatattttttttcaatgatgataagcagcgatggagcaagctagaatttcctcatgcccgggtcgaggctaaaaacaagggaataaaattggcaggcgactgatagcattttaatgatgtggagcacaagtagttgggcattatgaacacatcaaggtgtgaagagcttgagctgatgagcagtccggattggaagcaaggtcattgggtgcagtggcatggactagcaggaaaaaaattataagattatagccctaagagactatgatcaggaaaaagaaaaaaaagcactccgctgcaagttggcgactccaacccatagactcgaggacaagactaacgctatgcgtgctcggttgctatcagcctttcgaagggagaacaaacatgtcgcctagatcaatggttctcgatgagcatgtgctttgtggatctatgatcatgttcaagcaaaactggtacaataaagtatagatgttaatagtgaaatagttctagtgataggctcattttgtaaggctcatgtctacatacttttgggagcaagacaccattgagtccatggaccttttttttcttttaccgtaccagtttctttacctatcaatggttctcagtgagcatgtgctcgtttattatagttttacagttttcaaatatttctaagtaaaatcatttcctacaatacacaatataaatctatgatcgttttccatatatctttacataaggaaaaagttcaaatacccccctaaactttggatggaaatccgtcaagcaccttgaactttaaaatcaaacacccattctcctaaactttgtaataccatgtatattactctctaaggtggttttggatggtgtttttgcatatttgaaggcttaaacgagtggttttgaataactaatatacatatttaaatatgattagttagtaggacatcaatttatattatatagtggtgccatattattattatgttgatactcattttgtaagtgagattgaataaagggtacaaattaaagaagggatatttaagtgaagatcttagcatgtatatctaatgtatatgtcacgtgatcaaactcattcaacttatatacaaattagattaaaaacatcttatcgggttatataaatagtactataaagttcagagagttgtatgtccgttttcgaagtttagggtgctagatagacttttactactagagaactcatcttttatccaatgccccaaacatacaaatacctcggatggattaagaagcgttactaaatctctttagtaccggttctaaaagcccaagtccctagaaacatttttagtaccggttggtgttatcaaccggtattaaaaatacatctgtagtaccggtgttagcaccaatcgagattaatgctgatggatctttagtcccgttgatattatcaaccggtactaaagatgtatttttagtactagtaggtaacaccaacccatattcaagatatttttactaaagatgcctcctgagttagttcaaaaggaaatcatctctattcaagtcaaatgtgtaaggtaggtgggatcgtaacacgcgtgagggctgaagtgagatatcttgagtttgattcccacatcccacatattttttttttgacttggtttgcatcgttagtaccggttctttagtcttgatttttttttgtcacggttgctaactggaattaatgggtatacatctttagtaccggttcagatcgagatctttagtctcgattttttgtcacggttgctataatcgggattaatggcggttttcaactgatattaaaggtgatttctctcctggtgtttcaatcaaagtttagggtgatatttggactctctcctgcatataaatgtactacatgaagcaaggaaaaatgtagggtatgtatgtttttgacctaatgtggttttatatatcctacactttgaccattgtattttatattatattgctcatgatcttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatcaggatcccgacggcggcggcggtgtcgttttcgccgtgagggttgggacgatgaagacgatgacataggcggcggtggcggagacgagcgcggcggcgccgatggtggtgaacttgtcatggctggtcccggcggcgtaggcgcccatgagggcgagcaggtcgaccaccatcaccgcccgggtgagcgtgagcagcttggtcccctggtgctggtggtggccggcccttgtgcaggaggaggaagaggaggctgaccaccaccagcgacgccgcgaaggagatggcgttgaaccagtagaagacgatgtagcgccagtagttggtgtcctgtaggatggcgtcgccggccagctgccaccggccgccgccgccgccgtcctccagccacgagccacccggcgggttcagccccgccgcgtaggtcaccgtcgccaccagggtggccagcagcaccaggtacttcttcagctggcactccattggcgacgacgacgacggctgcttgtcgtcgctgctgccgctggaagaagtgaggttttgctggctacttccaccggccaccgccggagccgccattgatctgctactgttgatcgggtgatcgatcgaggtgaatctttgagcaataatacacacgatggcatggctctatgcatgcatttatatagagggctgatcgatcgatcgagcgtgtgtcacaatcatggcatatatgtattacttgatcgtctagtcatattttaggctttattcccttgtcatttttatgccctttgcatttcattcggtagtgtcatgcaagtgacattcattcgtgcacagtgacccttgcacgcacgccaggtttctattccttatgtgtgtcgcgcacatgctttgttttgagctgctgattaaggccgtgatctctcggcacacaaaacgaagcacgtattattgcatgattaattaagtattaactattttttaaaaaaatgattaatatttttttaaaacaactttcgtatagaattttttttaaaaaatatacaccgtttaccagtttgaaaagcgtgtgtgtggaaaacgaaagaggtgagttgggaaaactaggggaagaacacggtctaattatggacgtttttacacgaattatgcaccagttcattgcacaaatcgtgtgtttttccctttcttatgagtacaacgtaaataaagagcgtgtaattttgtatacactagttatagggctagcctaatgggcgggtgatcgccttgggcgatcagcacccccatccctcccctaacacgcacacgtctccccttttatcctcttcctaccacactatgaaatttcaaaccatttaaaaaatataaaagaaatctaatacacttgaaaacatattcatgtgaataaactttacacttataaattataaatatatagactttatgtatagaaatattctatataaaaatatatttgaatccaaattcaaattcgaatttgaagcgagtatataaacttttaccctataaactttgggtatatatgtgtaaactgggctgatagccgcgcgtgatcgatcacgcgttagctttctagctagttatgtcccctgcgttgcaacggttttttatccagtttagtagaaaaaattggaccgagtagaccatcggtttttataaagtgaccgggctttttttaattagaaattggttttttaggatggatgtttttttatgagaggtaagatatgtttaagtagaaatggaggatggattgatagaagaagacaactccctctttaagtagttgtgagatataggtttttattcggttaagagggcaactccctctttaagtagttggagtattttttttttataaaactagagtacttgaaattaaactatcaatgtagatatgttatgacgttttagtcaaattatataaatttatctaaagtaacaactttcataatttattgttatgtaataatgatacaatttaaaatgaactttcagtttcattggtatgtaattcatcaagggaacatttttttatggaacactaatactgtatgatttaaacataacacaatgtatgccaaactaagggccttcaaagttcaaaccaacctttccaccggaaatgcatttaatgtagtggacgaattccggcccatacgtatagatgggctgaggggtagtaggaccacgtgaagaaggaaaaagtccacttagactcccttaattgttcacc

SEQ ID NO: 74760 - DNA, 30978 bp, Oryza sativa
ctcccggagtccacggagctcggcgacgacgcgttgagcgagctgcaggcggccgagctcgcgtcgttgctgctgctgctgcaggtgcagctattgctctcctgggacatcacttgctcttgctccattcgtgtgtgacgagctagcacgcgacgaaaaccaagattgcttgctagtgatcagtgatcactcgagctactggcgtttcttgctgcaacttgtcactgtaagttggagtgatcaacaagttggctgactagctagctgtcgtctgtggagatgaaggcaatgtgatgcaccatccatgtatatatattgtggctctaagtcaatgtgtggaagacacaacaattaaagtggcactatttcttttcttctcccaaagaaatgtgaatgacatgcaaacggagagagagaaaaaaggtgtaaaatcacgccatgatatgtagcttaaggacgcgtttcttctctgatctgaagatctcaatatactgaagttctgcacaaactatagatttcattattcattgttcccgagctcggcgcatcgattggcttcgtgcaaaatgtgtttctttggacgatcgagcaatgattaaagtagccagaaaatgccaagccacatggcaactccgtacttaggtgttagcctcgtgcaaaatattaaaatgcaaacatatgggaatcgtctatatttcacagatccaaatctttggatctgcgtgcttatattgtgtttcaataattaagtacaaatcaataatgcaaacgggcgaaactaatggaaagggtgtcaaccagcagatgggacagaaaaagcagtgtttgttgggataagaagatgagaagactaaagaacataatgcaaagcaaagctggcaataacccattatttttgtgaagaaaatgcagccatgcagcccatagtaccctttctttccccataattttcaacttaactattgatgaccccgtgtataatgttatctgacagaataatcaaatatatacgaccagagattccagcgcgggaacataaaaaaaacctacggggaggaactcgtggcgttgctttggagaattggggatacaggtgtttcctaagatcacacttaaaactttattaaggattgctaagttgcgaccaaacaccaaaattcgtctggagaaaaagctgggataaaactaatcttcgctatttgagctcacctttcatttggccccatgctagaatatagtgacaagcaatgagtgctttaatttctagtggttcgtaactactggaatggaccagaatgagagtattttatagacttgaggataacttttttttttttggctgagaaggcatgcatcaattcgagaaaacagaaaaattaaggtcaaagcagaacagataactaaacagagatgatgagtgaaaacagcgtgaggatcttcagacttcagtgaaacctgatgatatgaagaattcttctctctctttacctttacgttcaaagcaaatctctattcgttcaaaaaaaaaagcaaatctctgaatcttagttaaatataagtagctagcatcaaccgtagtaggaattcatcgtgttaatttggtcaattaaaagcagatgccacagacggcaactttgcacgaaagcccagatgatcggtttagatgttacctaatgcacaacgcgagtacgactgttgaacaaagaacgaaataagacgagaaagtgcattcaagacgattcatttctttggacggcaatttgaaaccgaaaacacgctatgtttttatacatctaaaaacgagtaaaagccttttcttatactccatatatctatcatcaaacactttagtgaacaagggcgatacgtagctaaatacgggccttgcttcagttctgacttgaccttcctgccctgtcccaaacatttttttcttaagctatgacgacgactagccgtacgtagccatggatgcagagacaataggagacatgacagaaattacataacaaatcaaggaattctagaacacgtatcacaaagtgccagagcaaatgagtatgatgtgcccatatgtagccaagtaaagagtggttagtacgtccatgagctccacggccgaaataaaagagtggttaaaacgtccatttgcttcataacttccatataagtggtctttttcctgaaagaacagcatgatgcttatgtagacggctggaagaaataatactagatggtgctcagttcacgaaagctacacttctactgatcgaagcgtcatattgttagacgaaataatgcgaataattaattagctgagaccacatgcgttagtttcagtgaaactaacacgctgatggggatctgcagggcattattgtcacatgaagaacggtacgtacgctggtcaatcgtattccctactgtataattagttacaaactacaaactttttgtgtgtttgattctaatagaaaaggacttttgaccaattatggtggtctcaatcgatcgttctcctcacatacggttcaattacatctctcttttaagtgtgatctggctagcttttgttttaagttttactaattcaaagccagagcttttctctttaaagtgttcaaagcaacagtcgattgattgctactattgtctggcaacaatattcagaatgaattcttcagataaagagaacgattgttatattgcccatcttttcttattccaaaagaaaatattgtccatcttttcaatatatttgtatgcaaggattatatactataactaaacattcacaaatacatatgaatgtgagctgttttgcttcagatatttctgcacagcctcttataactactggttaaaattaaacttgaccaaaacctccatttcatcgtactattgtgccctattgattttgaggtgttattcgatggtctctagactagtagaatagttatttctaagtagtaatggaactcataaatcaataatttagatcacttttactgatgataattatagtagaatatatattaccgtaaagtcctaattgattttagagttcttttatggtcttttatgacccttgtgggcacttaaaacacaaaagcccacaaattttttaactatagtccttgcgaaccaacctccagggtttaacttcactgtatcccccaaccacaaggacatcccgatcgtgtctgattccgttggcacttccacgacaaaatcaggtgacatctatcggaaaagtggtatatatatactcagcaaatctcaatcaagggcatgcttgattaaggcacgtacgcgtcataaaatcaatcattaaacagatcgatcgatcggctggtcgcaccaacattctgttgagtgcttgctaaccgattagctgcttagctcacactgtcacacgcattggcacgtccaaatccccgcaaaaaattgcgaaatccccagcgaatcgcccgctcccctctccgcgcccgcctgcaatctcaaccagcagcaaatagaggtacattgtgaatatgttcacgggttagccacttacacccttaaaataagaaaagcgaacgactgaagtcgtgcggcaccacagcctcacataccgtaacgttcccttctccgatcggcacgccggccggcccggccggcacggctcgcttccggtcgggccggcggcgacgacgacaagacccctttctgtcataggatcctctcctagaggcatcatttcacgcattatgtaaccgtacatgcgtgtggtttagccggttttgattattatcagcgctgcgtcgctaattcgacagctcgctcgcgtttgctgctgctgctgctgcagcttgcaaacgcatttgctcctctggccatgtgttgtgcatgtgacacggtcgcctctgctcgtcccgcgctcgacgcgagctcgcacttgggctagctagctaacgtgtactagtacctaagatcctcaatttgcgactaattggatgattaattagggaaaggtatagatggcgagccaggagaggttaactggttcgctgcgccactggcgttggacttggactcttgtgggaaccggtaactggcgtgcgagtgctctgtacctaaccttctagtcattggcttgtggttttatttatttttcataacttacattggcaagtcccttgttattttctaattaagatatagattttttatcttaatttttaaattgctaaacggcgtattttgtgtggaaacttcttatgtagaagttgctttgaaatatcatataaatctatttcttaaatttaaaataaataaaacttagttaattatatgttaatagttttcttattttgtatatctgtatttaaattttcattagtgaactcaaacggaccaacagagacaagtgaacattgtgtgcacactgtatggaaccttctttgctacttcctctccttttcttttcactcttctagtactgttgagatattgagttcagtaccactagtaccagcacagtacgtgtagtaaagaaaggctggaagtagaagagcttgaaggcacagttggcatttttatagtttattatttaactcccggtacttgttcgaaggagctgtactccctccgtcaaaaaaaaaagacaaatcctggtttccgtgtctaacgtttgaccgtccgtcttatttgaaaaaattataaaaaaaattaaaaagacaagtcacacataaaatattaattatattttatcatctaacaacaatgaaaatatgaattataaaaaaatttcatataaaatggacagtcaaagttggatacgaaaattcagggtttgacttttttttttttttgggacggagggattacgtaataatgacgtggcagcagcaagatccggacttgttatgagcaagggctaatctggtgagaatttgtgtgagaacgcactctggtggtgagtgatgtacacaagaatccatgcacttactgccaaactcattgtgaaatcattgaggcaagcaggcaacacatacatctcaattctgatttttgctgattgtccgctgtttcaccgcaccattaaaacgacctccaaacggccggccagcagcccaccacacccacatgtccataaaaaaaaataaattatgcacatcaataattcaatcagctgaaaaaaaatctgcttcgaattaattaacttctattagtagagagatctttttgattgttggtacacaaagcacacaggcttcatggcctaatcaagcacaacatagactaaactttgtcaatagcagtaactactaaatatagcggtaataacatttttcccttttttttctttctttcttgagagttgtcgttgtagcctattcatgagcccagaaaggtaaaatggctactcggcccacaagagtggctcattgagcacgacggcgtcgccgccgtcgtactcctcggccgccagtgccgccggccacaccggcgaccaccagagcccgtcccgtaggtcgagaagaaggtcgggtaggtcgaagagagcattgtcctggccgccgtcggcgtgcaccgtgtcagggcaggcggcttcctcctcgggttgctcggcggtgggcgacgacgacggcgacgactcctcctcgcaccgcacctcggcggcagccttggcggcggcggcctggatgtctgccggggaggtggactccgggcggggcagctcgtgggcgctgtccgggaagttgaggtgcgcgttccggcccttgatggcgagcgcggccacgtcgtgggcgcgcgccgccatctccgcggtggggaaggtacccagccagatgcgcgacttcttgcggggctcccggatctccgacacccacttcccccagctccggcggcgcacgccgcggtacgacgggtgcttgaagccgctcctcggcgccgaggcggcggtgcaggtgctgctgctgtcgacgccgccgccgccgccgcccgcctgcgccttgccgctcgccgccgcgttgtcgtcggtgctgcagctgctggtatcctcccctgcgccgtgggcggcattggcaggttcctccgcggccgctctcttgcgcttcttggcggcgtgtttgggcttggagctcttgggccggtcttgcgcgccattgtcgacgagggaggaggtggaggaggaagtggacagcgacgaggaggagaaggagacggagacggaggaggaggtggtgggtgtatggctcgcgtctgcttccatggctcccgttaggagaaggccgtggcccgtggcgaggagagagatcgatggaagtgcggtctgcggcgagtgagcgagtgagtgcctctggctataaatagtcgcgcggccttgctttcttgaggtggggcagggtatgttaaaaagccttttgtttccctttctacgcaaggtttttcattgattaatgtagatgattaattaatttcatagtttcattatagaactcaggaccattggatgataaaaaccaggaccatcggatgataaaaccatcattttccaaccatttgtacgtatagcacttcttggaaacataggattaaaaaaataataataaagaatatatgatttcagcgtaaaaaaatataggattttaacaataatacttgtgtaaaatagataattgaaaaacattaagaaaaaacatgtttgtttagttagatggtgggaaaataccgaaatttaagaagaaataaagactcaaataaaacttttcatgagattggatatcatgttaaatttcttatataatatgcacggaatgaggaatttgtaggattcaatattatccaatattttatttcaaatggctatttaaggaagaacattttttagaataaaattctataaattccttactatgttttttcttcaaatcgaaacggcctaaaatgctatttcctccgtttcatattataagtcgctaggattttttttctagtcaaaactttttaagtttaaacaagtttagagaaaaatttagcaatatctaaaacaccgaatcagtctcattgaatctaatattgaatatattttgataatatgtttcttttatgttgaaaattctactatatttttctataaattaatttaatcaaacccaatcaaaatttaactaaaaagtcaaaaggacataaatttaactagataaaagtcaaaaaattgttttgcctcttctgatctaaagctttagaacatagggaaccccaaacctaaactaagatttgttcaagaggtgggttcttttgcattttaaacaggtggagctagtgaaatcgatccctgaaacaacaacaaaaatatcatcccaataagtcaaattttgaccaaagatagtttgactctcatagtttgattcaaaaataatgtatggtcaaggtttgttacgagaataatcattatattacaattatatatgagttttcttaaatttgtatagaagagttgacattttattcacttgagcaaccggccggcatgaggcagttgaaactaaagcaacaaaagtttgtttgtttttaatctggacatttcagaaaagtttagaatgcaagaaaaaaaatacaaaatatattatgataaagcaaatacagcgactctcactgcttttactgtttcatcacatgagtcaaaatcaaacattcagattttttttaacgaaccaatataaggtgtaccaatttcattaactatagcaggggaaaaaattaactaaacaaggtaaaaggagaactatgttacgactacggaacagtcttcgaaaaacgttttgctcttgctaaggcttaagtcttgaactcttccttttttttttcaatcaacgaagacgccgatggctcaaatattttgattttggtactatattgaactactaatttgcttgagaaggttctgggctttggcatttacttttagcgttgaaacttaaaagggattaagcagagtatatatataactacaacctactaacagtactctagacctggtcccccaaaaaaaacccgtttctctgccgaactagtttaaagctaaatatacagtgaccgtacatactgaccacgttgatcgcaattctagctaattctggtcacgtttaacacttttaactattactacttgatgcaagtcaatcgatctgtacgtagcacagggcatatagattaactcatcccaaataaactatctcagagccggttacttaacaagatcttcagtagcattatttaggcctaatggtggagccgcggagagcaagtggtgtttgcttgggtacaaaatggttcggcgcaacgataagatatggcgcgtcgtgtcgctggagttcgacacgagcaaatcccaacgaacgtttggtcgtctcgatcgggtccgattcgatccagagccaaactttggcttcgttttctcatcagttttcctttttttttcccctccttttttgccgtttctgcgcttgacttccccgtgagtttttgctactactctcctcggtcggccgaaagaaagggatgcatgttaggccgtggcacaccaccctcgcgagatttcagctgtgattgatggggagcgtgtcgatcatggcgcgtatgcttgcacgtagcatccggattgaattgcgatccgttgtctgcatgcctcgctctctttctctcttccgaggatttgtcatttatcaacgtactgctccaagccagaaagttggattgtaagggtcaataactccgtggaacccctagtgtgcggatcgcaagagataccccaggaagtatgagaaacttattagtttacggactagctagctagaggccggccgtcttccgagtagaacggaggggaattgaatgccgttgtgaactgagaggatcagtggattgaagaacctgggcaccggagagggagcagattaatattccttccacgcatatctagccgtacgtgctggcatccaagtactagtacccaggtaacccaacacgatgatgcccctctgtactcgctcgtgcgcacgaacgacagcacgattaatatggggttcagaaagcttcagaaaacgagtatactttactctcagtaaaaacgcaatcacgattcgatcaggacgtacaccggagctgatcgagacaggcagaggtaaaactaagggagaaggcctggctgtcagctgattaatactagtagtaattcagaggatcaaggcacggaaatactaagctccccgagacgtgtagtgtggttaacgcgacgcgattaaatgcttgctgcagggcttgctctttcgggcaagctacagctacagctacagcacagccgcgcccttcgccgatcgtgcaacacgttctctctctctctctctcgcgcgcgcgcgcgcgggagatgcgagatttgaccctttgaccctgtgggggcacaagacagaagagaaaagaaaaggaaagaaaaaacaaacgatcgcgcggttcccgcgggtcgcgagccgcgcgaggagccacgtgatctgagctaccgctgcctgcggcgcccgcgccgaaaaatccaccgagtctctcatcaagcaaaatcgcggtggtttggcacgcaaaacctctcacgtcgtcgtcctcgacaccaaacgcgatcccatcttaccagtagtcccagtacacgagtactaagggggtgtttagatggggctaaaactttttagcccatgtcacattggatgtttggacgctaatttggagtattaaacatagactagtaaaaaaattaatttttataaatgagagctaatccgcgagacgaattttttaagcctaattaatccataattatcaaaagtttactgtagcatcacattgtcaaaatcatgacgtaattagactcaaaagattcgtctcgcgaattagtccaaggttatggaatgggttttgtaattagtgtatgtttaatactctaaattagtgtctaaacatccgatgtgacagggacttgaagtaagtccctagaaaccaaacaggccctaatcctgtactatgagctaaccttagccagtgaactaacgagacctccattgatcatcctagtagtactagacggtagccctggtacaaaagtcccggcaccaagggcattacttctaagttacagagcgtgtctacctgtccaacgcatttatatatactctctctacgacgaacccgggcggtgtacgtgcacgtacatatacgttgcatactgctgcccactaaggccagtagacggtcgactctctccaagcgtcgtcttatatatacaggcagcagtacacccctagctagctactgcttgcaagtaacaattcaccgtcaagcgtcaaagttgtatccaacctcttccgtatagcagcgaccggaggagtcctcctcgcagagagtcgcagtcttcaattcgtacgtgctttagcattgtaagatttgggtagtattagtagtaccagttcttaatgcacggcgacgaaactacactcgcattggttatcctagcgccgagacacagtacagcttaaatgcgatagcccaagaacagatgaatggtagtagtaccaagagcttgagttattgctcctcgttaaggcaagcttaacaattgcagcgtttagtctgaactttttctttcttttttgcagtactgcagatatatgcagtgtgctgctacagtgtagagtagcaggtacgagctgccctagatgccaacggcaggtaattaatgctaagtaccaagctggcaagctgccctaacggaaaattactgtattggttaattctccatcacgtcaatgagtacagtaaccgcatgctaccggccatgcatagatatgctcctgcagagtcctaatctactcctcccgatgatatctccccgcatattaatcatctccaatgtccagctgagcgtgcaacgcaacaggctgtagttaacgaccgtaatttaagacgccgggcggtgtcaatgccgtacaaccagcagtaattttgtcataaccaatgaagcatttaaccagtgatgatgcagtgtgcgtagtttgacataaccaattaatgatgaggcgtttcaaccttgaccactcagcttactatattgtaccatcgccaactcctagttacgttgatcaatgaaataagcaatgaaccaatgagtaactgcaagcccccaagttaccatgtccacacgcaaagaatggtgtttacattgtgatccatgctaccatgtgtctagtagaagcctcaactctaaacactcaagttggactggacacctgaactctcggtggaacttggaagtagtagtacatgtacggggcaatggcagattacggcttttacttggcggctttcctttgtattcatatgatgcggtcaacagcaagttggccgcaacggtttggcgaaaaccggacacaatccatccgtatcaaagagttcggcacacaggcacagaccatggcgagctaaatcctgaaccgcgccgccaccatgagccggaaattatggcagattggctgtgaaacttggagaattttcagtttcaggcatatctacctgaaaaaaaagggggctaatggcggcgacaggaagatgcgttagcattagcagctaccacaaagagcagggattgtgaattactagagcctctgctcttggtaacggagaagataattaagacaggtgggtcacagctggaatttcagctagtaagagaaagtttaaagaaaagacaattatcgtcactaatttggagtagccggggataatacatcacaactgcactaactctagcacactaatcttaatatttttattttatttgtttgtccaatacattctttattttttttccttttttagagtttgtgtggaggggtcccttgcacatggatgactccatctatgtttttcttcgagtaaagtgcataggcagtctttaaacttgtaaggttatgtcatataggtccccaaactcttaaaatgcacatctaggtcccaaaacttgtcaaagtgtatcatttaggtcccaaatcgacataacccctatagaatcctatatggcgctgatttggcatgccatatggtcgtgatatgcccttttcttctttttcccttcttttttcttcgttttcttctcattcttctttttttttcctttcttctactcgggaaaagaaaaaaaaaaggagaagaaagaacaaaaagaggaggaggaaaatataagaaaagaagaaaaagataaatgggtttcatttgttagtcaaaatgatgccacgtcttgtccgtgtggcatgccacattagtgccacgtaggatcctataggggctggggcgatgtgggacctaaatgacacactatgacaagttcttgtacttggatatgtattttgagagtttaggacctagatgacacacccctacaagtttaaggaccgcccgtgcactttactctttttcttctctcttttatctcacatactagcttatgtgatgtcctgagacaatgctctaattcaggctgtgtttagttcacaccaaaattgaaagtttggttgaaattggaacgatgtgacgaaaaagttggaagtttatgtgtaggaaagttttgatctgatgaaaaagttgaagtttgaagaaaaagtttggatccaaacaaggacttgatgtgatgaaaaagttcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagaaaatttgaagaacaaaacacggcctcaagattcaggataatggagtattttcgtcaatgtttttctggccctttgcatgattcacattacttattacattggcagacaatgatcacagttgccgaaatacggtttactttatgatccgctgacctgcagacttagaactctgtactgttagcttttagtagtaagaaattactgtgaatcctgcaacgtggttttactttagagagaccaactagtttctggaattctggccagtccttgcctctttggacttctcagctctaaatcacaaattagcttttaggagtatcgcataaaggcttgtcgcttcctagctacttttgctgactgcttcatactgtactcagcatcccaaacagagacgcatcgaagacccttcagcataccattttcagtcaatacaacatgtaaatatgttcattaccaataaaaacagaaacgaatgctcatccaccactttctcctaggtaggagtatatcttatgaaggccaagaaagccttatgttgttagcacaagcttatatatcaaacgacacaacttagacattcactatttaatttaactagtacaaaatacactaaaatgaacagtctcaccaaaaactacttagtttacatggagtatcatcacttgcgccagaaagtgacacttcttactgttgagcacactgtactcttggagcatcctcctcctcatcttcgtcgtacgcttcctgcttcctttgatactgcttgcgcctcatctcctcttctatgttcacatcatgcatggtagtttcctcacattgatccaggtccatatctgataattggtgcccaggtttaggtggtaggatcatctcaagtgcccggcattggtcacgggagagtacaccagattcagggaactcaacattgaattccacaaagagacggcccttcatgaaaggccggccatggtgtggcattccctcatcatttatggccttgtgttgacctgtttggaaaatatttgagttaattctttaaaaaagtctgcaactgattagaatctgaatagaaaaaacagaattacgaagtggcaaacaaaaaggctagcattttaaggggatgagataccaggtttaataatttcgccaggatttgccttgattaggagctgcctactgtccagatgagtgaggatgaattggaacccacacaatgcctcagttaaagagattgtgcgctcaatgaacaggtcatcatatttcctcttaaatcttggatgtaccttaacttgcaagataaatactatatctcctgtcactgtatcaggctgcaacagcatgaaacacacagtgcaaaatattagataaagaaagtagtgcatgcacagatattcattagcacaaggatggatgaatatgtggctgcaagtatgtatactagtataaatggacaaaataaacttacagcttcatcagcttcaccttggaatacaattttttggccatgttgcattcccttctcaatatgaacctcaagcacctttttctcctgaataactttgctagctctgcagtttgtgcatttatccctgtcacttatgatctcacctgatcaagtatagaacattacaaacataaagcaggctcctaagaaatcacaattttgcagcaagatatagcataaaaattggagcaactgttgcatacctgatcctctgcattcaggacagacagtctgcatatgttgaatcatgcctagtcctatctgtcgcattatattcctcattcctacaccatgacaaccatagcatgttgctggagcctcagatttggtcccttttctgaaagcagagagtaagatggaaaaggtgaaacactacagtcaacactcaaaacagataaaaaaaacatgataaactaattatttttttgaatgaagggcaaaacctttgcctcttctatatttatagaaggaattttacagggcccctcagaatggtgaataaacctggattgaaatgggccacaaaaaaaacatgaattttgcctcgtatatattttgaatgataaactaaactaattatggtgatagagctagctacgcctcagaatggtgaataaacctgggttgaaatcggccatatagatgtatttgatctgtgtaatgtgttttaactgggctggacttatttttaaagctttactgggatgaagcatttcaataggcactgtctatttgattgggtgcactgtctatttctttataaaatgggaggttagctttcattgcacattagatgtcgtatttacagaggcagtcaaaattagactaggtattcggtagtcggtattgcaagcttggcattatataggccaattcacagccatcttaatcaggatttacatactacatatgttattctataattatactatctgaatgcccctgcattgcaacatgaagagaactcctccatacactttacagcctcaaaaattaataaaattattctcattgtaaaatcttctagtcatattatttgtcatcatttttacctcacttcaaaagaaaaattttctgtttgatggcttgaggttggggaaggggcaaaagtccacctacctcactatttgggggacccacatgcagtggtggtgggtggtggcaaattcaatactcaccaccaccattggggtcttttagaggagtatagatatgtaggactataataaacattggctttagcatggagtccaacatattccccaaatgtgcaagatacccttattaaactagttttggacttttggggatggttcaggttctataaaattacgtttgcacctttttttaattcaataaaagattcaagaatagaagcagtgtggataaatgtaaggatatcttctaacattgttggctgacacaagcatgtatccgttagcattaggtctctcattaatgattttttttatggataggttgaaacagaacataaatggaatgggataatgttaagggattatccagtaaccgaaacatttaactgggtttccctgcatctcaagtacatgcaaaaataatagaaataagtgcgcacgaaaatacaaaacaaatacaatcaccagttgatggatttaaactagcaatatagagaaattacagtgaacacttcgggataactatttacaccttattttcaactagatggaatcatatgtatcgataatgctaaagtgaaagagcatgataagtaataattttgccaaataatgagtacatcatttcctccagttagcaaattgaagtgcagcaataacatacaaaggcttaccctttgcactttgggcacagaatatttcgtgataatgatagtttcttcatagatccattatacacatcttctaaagacaccttcaaagtatgcgccacatcttcaccacgtctctgtctgcgtactcttgagctactccctgttaaccataaaagttagcatgaataattctgtttttttttaaaaaaaaagttcaaacaaaaaaatgttgagggtgctggaaaatttcagggtacatatgttgcttacccccaaaggcaccacccccgaaaaactgctcaaatatgtcaaatggattatggaagtcactgcctcctcccattccatccttaagagcatcctccccatattggtcatatatgtctctcttctcaggatcagtgagaacctcatacgcttgtgataattctttaaactgtaaaacacataaaaatgtaaaaacaaaatagagattctgaattcaaacaattgcatgtcacactggcacatcctcaccttttctggatcccctcccttgtcaggatggttttttatggcagccttccggtatgccttctttagctcatccttgcttgcagttttaggaactccaagaacctcatagtacttggtgttgttactcctcggtacacgcccaaacatgtttacagatcacaagataatctccctgtaaatctgtagaactaagggtcagtctgcagtggttgagtcggtgacatattgtgcattggagtctactcaaaataggggaattttactaatcctagtatgactttgtttccctgttacaactataattaaaatgcttatagtaacaatttttaatcaaacatcgaaataaactatggcttttgaacagccaccgaaatgccaaacagagagtaaaaaggccaaggatcactgtaattttaatatatatactccgtactcaacgatcagtaatatgctagtaatataaaatgtaatcagttctgttaaacaaactaaaatgggagctaattttacgcatttacaacaaatataaaaccaacaaaaaatcgtagaaggacgactccaccacatgcgcaagtgcctgaccacattgaacttttaacatatttggcacccaactcaaaaacatccggaaaatcgaaggaaaatctagtctcatccccaccgaactctgtgtttcgagcggagcagacaactaaggtaaaaaaaaaaatcccctaaggagagctgatcacgaatatttctccagccaccgcgaacccccacgaggtgtcctacacaaccctggaaaacttcgcctcccctccaaatcaggacaaggctccacctctcctccgaagaatccaaccaacaagatcggtagaacagccaagaaaacggcgcagaacaagcaaaaaatacactcggtttcccccctccagaaaaatcacggggggctcatacgcgatccaaccggtccttaggagagtctcggccatgaaagattggggcgtagtgaagcgatcgtacctgaatcggcggcagagagaacctctcggtggaggcgaggcggacggaggcgagcggtgtcaccaccgctcaagccacgcgaccgagagagggcttgctaagcttgtggtcgtgggcctttatccttgccggcttgccggttggtgtgctccccctgtgaggatgaggtaatctgggccgttggtggaagtgattgtgtggcttagattggttttctggtctttaggataaaccggtgcagatgaaaggcaaggatgtctgctgcctgcctgccttggtttcatgatcttccatttggtttgttaattaaaacatggtagtagaaaaaactggtaacgtctacatttgtcaatagtttttgcattctttatatcttttaggccaaaactgctcttcgccaatacaatttatagcaattttttaacaaaatatttttataaaaaataaaataagttcgacaatattccacgtgtaacttgttacatgtgaaatagcagtgatgatcgctaagtagttcactgaattagtgtcctataatctatagtagtacgtactgcataacaattagcaagcggtcacgcgccatcgttgttaacttggtagtacgacttatatatacaccttacattctgcatccacacttagaaacattgtcacattaatccgacacgttagaaggttcagtataagtaggctatgctgtaagctgtcacaggcacaaagatatccaaattggcaaccagaaaagaatcacgcaaactgcgtcactctccatcgagcaaaccaacccgcaaagttcacaacacgtcgtcgcgcgacggcgatggcgatggcgatggcggcggcggcggcggcggcggcggtgggggctgatcaacagcgtcgtcgaacatgttcggcgggaggtcgtcaaaggccccgtgcttgacggcgtcatgcgcgcactccatgccaaagaacggcatgatcatcggaaccgactgcaccatcggaagcagctcctggtaggcgaggccatccatggcgccggcgtccacgaacccgtggccgacgtcgacgtatctctccggccatccagggaagttgatcagagggtacggaggctggtcgaacagcagcggtggtggcgccgactgagctgcattggacgagctcgcctcgccgtcggcgggtggtagtagctgcagcggcagtggcccctcgaaagcgaagaacccggagcatgcctgatcatatcccatgaacggtgcagcctcgcggcattgccagccgagggagttgccctccaatgaagcttgatccagggaggccgagctctggtggaactgcaagaaattaagtacagtgtcatcagtgcaagtttccatcaagaaactcaaattcacagtggagcgagcgcagtaaattcgtaacgttgatgatgattcatcagcggttcagtgaaaggcatgcattaccgtggctgtttgggagtcgagagaagatgacgagggcgctttgcccttgccgctgttgtgcttgttgggccgtgcagcagggagaggcccgcggaggagcctggcgagccgcttctgccgagtgctccagaaattcttcacgtcgttgtccgtcctgccctgcaagtaggtcgcgatcctcgcccacttgttcccgaactgcgcctgcaactcgatcaccaccctctcttcctcggcagtaaacttgcaaccgctttttaaaggagggaaaaagaactcgaaaaggtgggttatacatgaacatttccatcgactagtttgatcaaagataagcagataggaacattacagagacacaattcagtgcaagtgcgatcaaagattgcacagaccgcagatatagagtttactaacacattatcatggagtagtgggtttacaagcaaaaattcatctggccagttcaatttaagcatgtaaggacgaaacatttacttcctatacttaatttgtttcgaaacccacacaaatatccagagtagtgaagcagtaacaaagaaaattaaacacgagtcgcatggctggacgctaggttagaggaagcaaacacttctaaagttttaacagaactaatgttactctctatccgtaaaaccagtggtgccattgccggtgagaagtgagaacaaccaggaacactgcaattgccgtgccgctctaacttgcaaatgcacgaagaacttgaccagaaaaaaaaatcaaggaggcgagagaactgatcgaaccggggaagggagaagatcgaaaaaagagagggggggattcgcgcttacctcttgaggtttggcctgagcttgttcacccagcggaggcggcaggacttgccggtgcgcggcaagaggcctttggatcgaatggagctccagtccatggggccgtgggtgcggacgtgctccagcagaacctcgtcctcctccgccatccacgggcccttccgcagcgcctcgcctccgcctccggcgccgccgccgcccgcgcccctcctcccgctccttcggcgaacgccaccaggtgctctcgccattgccctcacaaccgccgccccacgcgcgctcgcgaacgcaaaagcccagccacaggggagggagggagggagggagtggtgggagggagtggtgttcttatgcgagagcggggacgacgacgacaatgcttcgtgcttcaactctcagtgtggggttcctgcaaccggcgtagtggcgcgactgagagccgtcgtggagggatcggacggtcgggtttgattcgcggcggcacgactaaccgcctcgccaccaccagcccccacgaacgccgggtccggttccaccgagaattctagcgcgtacgctccgggagtccaggcagcgcgcgtttctgggctataccctcgcgcgcggctcgaacgtgctttcttttttttttctttttttttaggtgaaactgccgcacgcgcgcggggaaaaaattgtgattaagtaatttgtttccaaagaacatgacctactaagataaccttcctttttttttcacaaaacacaatttcctgtttttctaaaagtttgaagatatattttataaattggatcttttgcctccaatttcaattgaaagttttttaaattgaagctgaatgttttcaaattttgagacaaaagtattcaaatttgaataatttgaattttgaggtgacagtttttaatttgagttgaaagttttcaaacccgagttaagttttcaaatctcggcttgaaattttttaattttgagttgaaagtttcaaatcttcaattgaatttttttaatccgagctgaaagtttttaaatctaagttgaaaagtttttaaatctgagttaaaatttttcaatctttacttgaaaattttcaaatctaagttaaaagttttcaaatataaatttatactttcaaatctgtacttgaaagttttcgaatctaagtttaaaaaaattcaaaccttagtttaaaacagaaaaaaagaaaaaaaaacgtgcatagagaacttttttgccggaaaaaaggaaatatgcacgggagttttttttgtcatgtggaacgagaaacgcgtaacagaagattgaacccatagctgccttgcacctcgtgcgcgagacttggtgaaatggcttatacgcgccaattagtcatccccaagatccacggccctgtccgctggacgcggttttttttttgcacctagctaggccgcgtgccatctatcgttttcacgctttgtgttgtatttctatcgttttcgcacctccgtaagtatggttgttatagacgctggacataatcccttctcggctgctcgatacccctcctccaccgtcccgaccacacaatctgcaccttgtccacacaagcattcaccgctgcgcgcccggcggtgatggcgtcaacgtcgcacgcggagtggaccgcggcaggtcatccccgtgcagtcggccaagagtgtacggtagcacccgcggatggaatggggatgtccaatgatatagccgcgccgccccgtccgacaggctctttgtcctacacagatctcattcttagttgatgctcgggggtgggacctcctgacgaggccggcatgtgagtaccctcgacgccccacaacccctcgctgcggatcttgacctcactcttatttaaaatggcaagtattatcagcccaaagggagtacttgtgcacgcatcacaaagcaatcctaagtctagtagcttgggtgatgcggcactgaggtgtagaaaagactttcccctatggactcaaatagagggcccacatataagtggcgttccactatccgcttggaaaaagggcccacatatcagtgacttccctctgtccgctcgccaattcggatccgtgccttcgtgcggtgggtctaccccacgaatgttcaccaggagggaatctcacgaaccgatatagcattccatcattcttcagacctaattatacgtctataattatgcctttagtaattgttagcactgattttcagttaaagaaaatccacgtatactttatgctttttatgttacgaggtttgtttggatattggattctattcatttccaaaaatatgcgtagttgataaacaattttttatttatatagaaatttataaactaaacgtttagttgcatatatataaattctaatctataaagtttatatgtagaaaattttttatattaaatattttcgtggaaactttttagatatagactttatgtatataaattatttacatttagactttttatatagaaagtttatatatataaagtctatatgtagaaagtttatatacacaaaatctatgtgtagaaagtttccacataaataatttatataaaaagtttcctttaataaaactatagaaaagactaacgaagaaaaggaaattaataaaaattggaaaagaaagaaaaaagcttcatgcgtaccatgagaatcacgttaaaaaagggaaaaaaagttagtgaagaacggacacgtttgttacgtatccatatctaataaaaaaatacataaggtttcctcatattttttcgtccatcatcctgatcccgttactaaaatatattttaatccgcttaatagtccgatcagacattttccaatctagtaaaaaatcgcagctgatatagaatatgtgttctttcatgtaacctccaagcaaaagtaacagcttgcccacatggttaggaaaggaaatctgccaccagggttcaattcccaccgtcccctcctttacgcctattattatttgcacgctgtatggttaaaaaatcaaaaaagttttgccacgctgtatggttaaaaaataaactattattatttgcacgctctatgagcctctcctaggccagattaccatatcaaaaatttttgtacttattattactcagaataagtctactttacgtcccacatctcaaatcctattttcgcgtaattttttttctctccgccactagcacggaccatgcacatccgatggttaaaaaatcaaaaaagttttgcctctcctaagccagattacccactcggaataagtctactttgcgtcccacatctcaaatcctatttccgcgcaatctttttctctccgccactagcacagaccatgcacatcccatggttaaaaaatcaaaaaagttttgcctctcctaggccagattaccctatcaaaaaacttttgtacttattattactcggaataagtctactttgtgtcccatgtctcaaatcctatttgcgcgtatttttttctctccgccactcgcacggaccatatatatccgatggttaaaaaaacaaaaaagttttgcacctctttcttcaacatatatttattttttctctccgccactagcacagaccatacacatccgatggttaaaaatcaaaaaagttttacacctctttcttcaacagatattaagtgccactagcacggaccatgcacatccgatggttaaaaaatcaaaagttttacacctctttcttcaactgatttttagtgattctgaaatcttgtaatgaaccagtttttaattcgaaaattaaacataattaatgaaccagtttttaattcaaaaattaaacataattattattttcttttcgtcatctgcaaaagacgatatattagagttcgcaccatctatcgttcacgcatgagccgtgaaacgatctgtctccacgcgagtccgtgttcgattttagaaattatatcagacgcttgccatgcaaaagttgagagcgtgtgttatgacaatataaatatatcaatatgcaatagttgtttcttatcagtcctgattatcattaacaatgcattaaacaatttatctatgttggaatattataacatatatgttaactgtgtatttatagcatttaactttcattatacccgtagcgaagcacgaagcacgggcattttgctagtacaagaagaatcacgtaaaaataaaaaacagataattagaaaggaaataacggataccgaatcgcgtaaaagaaaagaaaaagggataataagaaagaaaataacggatatctccggttctccgtcgcgcgcgccctctaatccgagccattcgcgggatcactagtggagtagtgggcgaatttcctgtcgtgcacaagggaggggaggcgctctctccttgaaaccgtcgtttcgctcgctgccgctgccaccgtcagatcagtaatgctccaaaagtccaaagacaaggagtattcaaatttttgacaggcaagttcacaagagcaaacaaagctttcgctgtgagcatttgcaacgaagtatcgaggcgattattgcttttttcttttccaattccagttcaaacagacgaacatttcacatttgggccttagacgatgtgaagcaaaaaactgaggatttctagagcacatacaatgcctgggatctatcgatacaattgaacacgcactagcgttgtgctggtcatgggtctcctcctccctccactcggcgtcgtggaggagctcccatccacctccggatgctcgcgcccacgcccttcatctcgtccacctgcgtttacgcggagtcacggaacacattagtgcaaaaccagtagtcacatggtgcgatctgtgagattttttttttttttggaggattcgtcttaccgatccgacgcccgccgcgagaactccggcggtgacggcggtggcgccggcgccgacgaagagggtggcgatggcgaacgccttgaacggcatcgcgaacgccgcgccgcccctgccccgccggaaccacgccacgcccgccgccacctgcgccgcgctcgcccccgcccaccacggccacctctccgcctcctccccgccgccgccttcctccatctccgccgccgctagggtatttggggggggagcgcctcggagccagagcgagtgaaacaacaacctaaacaaccacgaaacctcaccgacatgtgggacccatgtggaagaggaggaccaagccaggccactgacatgtgggtgagctcgaagggactcacgccaccgtagaacaaccaaaccccgccgcgaaatcgcagctttccatgggaaggtcacggaggagctacgcgcggcttcttctcctagggttcctactgctacggttcagctggtgcttggtgagtgttgattcgatttaggttggttccgtgatgtttggattggggatgtgatggatttaatggggggtttggggggagggggggatttgactaggcggtggctgatgacggcggaggcgcggaggaagggggagggatttttccggtggtggtgagcacctggcctttccgggaggcggtcagggcggcctgggaggtggtgtcagccagtggcggcgcaggttgttcggccgtggatgccgtcgtcgccggctgctccgcctgcgaggtgctccgctgtgatggcacaggtcagttgtattcaacctggggtgtgggattgattgtagtagttcactgagtttaattgggaacagtggtgatgcaatgtgctcagtgctgatacactaatctggttggttgggtcaaaaactgcgataacaaacttcaagaagagtttcgtttccacttggaggaatttcacccctggcttccattagataagtgatgtttgacgagagtaataaaaaaaaacaattctgatgaacaactattttcaggcagcaggcagaatatgtgtagttttgattgaaacacgatataacatatttgcatcgcgcttaccgaactacaaaagcaccttttacaatctttttcctgtctttcatcatgaactcgtgaagatgacattatcagcagttcctattatgttgcacataattatttgcactgaaatataatacacagaaaatacattgtatttcttgtttcacttttgaataagaatatcgaattggggtttgcctcctctgtttctaataataatttctagtttgtcttactgtgcagtgctttaaacccaataatatagatcttgcaaaacctattttggttgaatcccttggaccttattcagttcaaaaacttgactactttcagttagcttcatgaagcaactatagtactggttttaaatggtttacatttcatgcagttggcccaggtggaagcccagatgagaatggtgaaactacattagatgctctcatcatggatggggtaacagcttttttacatactcatgccacagcccactgagcattctgcagtttctgttgcagcattcttggtgtataatgtgttgcatttgttttgcttaagaaaattggcagaccacaatggaaatcggagctgtcgctgccatgagatatgtaaaggatggaatcagagcggcaaagttggttatggaccatactgaacatactcttcttgttggagagaaggcaacatcctttgcgatttcaatgggacttgtggggccagctgatctgagctcaccggagtctatcggaaaatggacaatttggagacagaaccattgtcaacctaacttctggaaaaatgttgttcctgctggtagctgtggcccgtacaatgctattgatgtaccatcaggggagtctaaggcctctgccaaacgtgtgctagagcggactcagggggacatttgtcaaggattatttgaacctaataatttactggagccaatgaactcccgtctaaaaatcgttaatcgccacaaccatgatacaatctctatggctgtgattgacaaggtatataggcatatagcccatccaaaataaattgactttcttttcatcggaaactaacaacagtgactttgtcaagatgggtcgcatagcggctggcacatcgaccaatggtgctacattcaaaattccaggaaggtgagcatttttgcgcttttggtgttttcatgttaccatctatcatggagccttttatttttatttaaggttatatttttctcacgtttgagtggtttcatgtcactttaatttgtgtactctggcataatctattttcatcatctaattcaattttccatggttaatgacaagactcacaattccgaccgtgaaatatatttttcttagtatttttatgctgtatttgtatatgtaaagtcactggtgaatgttgttgttaatcttctgcatgtctgcataaaaaactaataaaatgctaatgtatggtcagaaatttcattgccttgttaatgatggggtttatatatgtgattaacaggtctactttttttttcgtgacatcttgactctcaaaatggatttgatagctagacatggtttttaatcattatggaattgctgtttcatctcttggtaggtatcactgagcattgtctgatcatttggttccagggtaggtgatggaccaataccaggatcttctgcatatgctgatgatgaagttggtgcatgtggagcaactggtgatggtgatattatgatgcgcttccttccgtggtaatggaaaaataaattagtatttttgacttttttcttagaaggataaaagtccattttactcctccagtatttcccgggagcacttaactccccaagggtatttctcttttttgtttctccctgtaaaagttgtatttcgcactggaatttagtactgtaggatgatgggagatgcatcacaacttacatctcaatattttttttttagatttttttatcattgcttacctaggttggaatgatccaatgaaatagtttgagggagtaaaatagactttttttccttacaagtttataagcacctctataagtttcttcctagcaagttttttttctttttaaatgtaagagagatacccaaccatcttttgttctctatattattatattgatatttgcatcctaggggatgatgatatcattgacattcaactataacaatattccccatccattctaaagattagcccttgcatcatgtagtctggcgttagtatttttattgataggctgagtttactgatggcctcatgctccatgtaatcttcttatatttgctatagttatcaggtagtagagagcatgcgacgagggatggagcctcgggatgctgccatggatgctatattaagaattgcccgcaagtacccggactttgttggtgctgtatttgcaattaacaagaaaggagtgcatgctggggcatgccacggatggacattccagtattctgtcaggaattctagcatgcaggatgtggaggtcatcactgtatcaccttaacatgggcagatcgtaacagcatatggtgcgtcaccaatatggcatttttcgaactggggataccccatttccattcaccagcaggtcatgtttctcatgatctagaattttcatcattcagtcccctgtcaatgcagcaatgttatttggggattgtactggcttattattggattgcactcctcctggaagttcagacggccttgtaagcagattggatgcactcaattcattcttaataacctcgtctgagtgttgtctaaaagatagtaatagaactacatgtgatcaactttttttgcaattatctgttcagtaatacctagctaggttcactcctctaaaaaagctaggttcactcgagcatcttcaaagttgggaagcccatctatccgttttgcaggcatgtggctttcaagattctcaatagcttgccacctccttttttgcttttgctttggtctgtttctctcgttttttagaactcatgacttttatttagttcaaacagttagaaacaaagtacattagttatgattgcctcttccagagagagagaggttttgcaaagcaaatatgttagggcatctcggtggtaacaaacatgagtgttgttatgacaagtatatttttatttttttagccctcagatcatatcttgttgcactagcttatcagctactatttcatttgccttcatcggaatccacctgacctgtaaatgttaaccatgtaaaagatgaagaaatttggacagcatgtattctcttttcatcatataagttgtcttcgtactcagaatatcaaatattagtgactgaagaagggagagaattgtgaaatcacacgcttacaatattctatggctagttggatagattacgtaatctgtgtatcttattagcaataatcatcatatatttcttgcatttttaaagcctattataaggggataattgcaaagcttccgtattgtcgccgattaagaaagccagttgggtatcttggtgaaggtcgtgctctcatgtcctcgttgggatgttttgcccttgttttccgcttgagaaaaactagcggcctgctggtggaatgacacttatccagttatcagctatatcgaccgctgtccagtactgacctactaaattttctccttttccttttggaaaattgacttaaatctatttagcggtacctgcctgtacaatggcccctgaattctcgaaggggtacttgtgcgctgcagtgctggagattcgaaagcaagccaaaactgtcaattttcttcctaatacaaaaattatgatcacctatttattatggttagaagaagcttaaggaaaaagaagtcgttatctttatctagaaattgctcccaccgtgctgaatacaagagatactagatttacactctctttgtcaaaaaatataagagattctagatttatcctaagtcaactattgtaagtttgaaaacaataacaacatatttcaaagtgaatctaatctaatgaggctcatttaatacttaaaacaatcatatgatctcttatattttgggatatttttggatggaaggagtaccatattcaattgtagaatgtccagatcaagatgttcatgattgatcaacacaattgtataattgtatacaagctgcaattgtatttataggaatatacgtaatgctgttcactaaaatcaacttttgttcttttttatattttaaaaaaaacctactcctgataaggattgtccaaattgtcgacaaggagagctcccatccaagttaacgttggacaggaattgccatggaaaattagtaaatgcaaaaaaaaaatcataaactcaactagtatccaataataacgagaaaaatacgcaagcaactctacaactcgtttttcttcaggaaaaactgggatgtaaataataacgagtaaattaataccgagtatccaataaactcaactagtatccaataataacgagtaaattaataactgggatgtttttctacaggaaaagttgatatatacgcaagcaactctacaactcgttgcaacgcaagcagcaacacttgaactaattacaagaaagggcgccgtgtggaggaggggcagaggacggaggagcttgagatggaaccttaatccgtcggaagaaaaggggattcgtgaagcagataggcaccaccatgctggtactcgagctgggg

SEQ ID NO: 74761 - DNA, 97591 bp, Oryza sativa
tgcgagatgaatttattaagactaattaatccatcattagcaaatgtttactgtagcaccacattgttaaattatggcgtaattaggcttaaaagattcgtcttgtattttacacctttttttatatttaatactccatgtgtccaaacattcaatgtggcaggatgaaaagtttttatgtgggaactaaacaggcctatactagtcagtactcagcaagctagctatgagtagtagtcgctactacagattcagacatccacaatccttcacgagtaactcatctttaaaggattgagaaatagccgattaaaatatggctacggagaatgctaagtttccttcaacaaatagtttccttttataaattgctatgagtcgatgtcgccattatctttctctcttttccatgtaagcaaacttaccctcttaacaactctaagaaatctctatttttttagtagtagctatatttatggcgctatattttttaccaaaaaatagtcaccatatatttacattgtaaattcatataaattacatatgtaattttagcttattaacaatgtaggtcctaaaattacatatgtattttagtgtattaaaaatgtaagtcctaaaattacatatgtaaatcatatggaagtgatgggtaagttagacaaaatgagttagttgctcgcatggtaagcgtcttggtttgtaatgctcagggcatgagtataattctgctcgtctcttggatctctgattctttttgttttatgtattgcacgaatcttaacatataccgtatggattatgaatcgacatattctttccacaaaatatggagccatttttttagcagctccgttttttttatcattgtgcatatcctctaatacggtttttttttaagaactagggcacaaagcccccctttccattaatggaacggcataattgtcttacagattctaaactagaaacagaaagcccagaaagagggttcccacaaaaagaccagcaaaacaactggttgagggagaatatcctctaatacggttagaataatatatatgatcaagctaatattcggaattgtcttttttcctcttcttaatcccatcggccataagtggttagatctatattcttcttccctcatcttgctctccaactctattcttaacccatacccagtaatataggccggtatagtccttccctcatctttattttcaatcctattcttatcaacccatacccaattatataggcaagtatagtccatcctaatcatatagacccgttgcaattaatgtgtgggcatgttactggtgtatagaaagataaagatatactgtagaaatgaaaattgttttaattaaggtcttctgacctatagggtggtaagagcaaacaattgaattttcatttgtttcaccaataaaaaatcggaattgctaaatatttgttgacagatttttgatggctaaatctttcactttctaaaccgttggatgtgtcctagattcatgttaacagtttaatacgcatcaagatatgtgcttttaggaagaaaaacaaaatcatatttagggatcgatcctgtaacctcataggatgaagacgtgactgccccattgggctactatatttttatgatccagtttgaacttatatcttacttatactataattacatgcgagttacatgcaagttatatatgtaattatagtgcaaatatagtgtaattatgaaaattacatacgtaattatagtataaatatagtttaattatgaaaattacattgtaattatgttacagttacatttgacagatttttagactaatttttagtcgaatgttgtatagatagtcccataaaaaatattattttttaatttcggatcaataaatcgatcacagcaaaaaggaaatcaccaaggtccataattaccctatctaaatttaagcatatgcatccatacaagaaattaatgctccggtacggttaaagatgcaaactttataccggccatttgaactgctcgtgaattcgaatatttttgtttggttatatcataaatactacaagacgggcaaccatctggacgggataactaaagaggaattttataggacttgaaaaaaaattttggtaccttgaggtaccaaattttatattagaaaatgtggtacctctaaatataattctcaagaatagtaaaattaccctaattaaaaatatctagcgctctacagatttactctattctctctacctctctctctctgactaccatccccatgagcacggaggtaacaatgatggctggccgtgtgggtggttcatccggcgcagccattgccggtggtgtgttgggcgtggaaggagccaccgtcacaggcgccgctggtggtgatggtggaggtgtgggtggagtagaggaggagagtgtggagttgtttgtgtggcaggtgcccaagcacatgatggaacacagagctgcttgccattttctataggaggtggccatcgtcgataaggtcaccgtcatcaaggacaaggcttctcaaggtgcggatcctacatccagatctgggcttgtgaccctgtgctcttgcattgtttgttttggagtttgattatggggtgttctacatgttctatgggtgtttctacatccatagcaactttttcctggaattgattttttttagctctctcttgatgatcatatgatttgttgttcttattgcaatgatattttagttgtatcatgatactttggtacatataggtcttgaatctagtacctataggtatcaatctagtagcgaaatattatggctggtacatagaggtatatatcgtacttggtacctataaaataccagacctagtatacaggtatcatgttcgataccaataggtattacacatggtaccacagacgtatatagtgatggcatcattgacgtgttatctagaatatcagacatagtacttaggtatcatgttctgtactaataggtattacacatggtaccacggacgtatatagtgatggcatcattgacgtgttatctaggatatcagacatggtacttaggtatcatgttcggtactaataggtaccacatatgcatggtaccgaactgtacgtatatagtgacattaacattggtgttgatacgacattatcaagtatctagtccggacgggataccgttctgtagcagtccgttatttgaattcgctaccaataaaagttctacaaaaactagtagtacggaaagaaactgaaatgcatcaaaacgaatttgtactttaaaatatcaaattctgggtgttaaaataaaattaagtactgtccggtttcaaaatacctgaaagttgttataagcacttgaattctttatattctgaatgttcatgtcctaatatcaaattttctatgggattttatcataaaattaatttaaatttcttatatgtacaaatatgcgaagttcagaaattcttttgtatattgttaatcgaatttaaaaaatatagcaagtgatgttgttggattaattgcttgaatttttttacgatgagcatatgctaagcttgtttacaccgtctagttagtactacaggttaatccaatggatcgagtagtcttacctcatcggaggatatactccctccgtcccatgatacaagagattttaacgttttgcttatactgtttgttcacttgtcttattcaaaaattttgtgcaaatattaaaaacgaaaagttgtgtttaaaatactttagataataaagtaagtcataaaaataaataataattccaaattttctttgaataagacaactggtcaaacagtgtaagaaaaatgtcaaaatcctttatattagagtacggagggagtagtaagcaattaaaagagttaaattttgcgtacgcacgcacctccactgccttcttcaaggcaggtctgaaatcggtattgccgctggccttgagcttgtctaccaaattttccagcttcttccggctgtccgctgaatttcttgtcagcccgtactcgctgacgaccgcgtggttgaaggacacgatggccagccggtcggcgtcgcgaaccaacttgatgatgtacttcatggcgatcttgagaagatccagcctcgacgacatgtgctttccccggacaaactcctccttgttcatgctcccgctgacgtccagcaccgcgaccaggtctatgggggcgcgcttctccggcgccaccaccttgggcgcctccaccgtcaccagcacctcgaagtcgtccttccgttggtcccgtgcgatcgccgcccggatcggggtggtgctcactcgcacctcttgccggtcaatagccgccttcgacgttgcctgcactagctagctagctcatcattaatctgatcagcgttgggaagacgaaaagtagtgtactacagtattagatagctatatatgttatctagctgtgtactgtatttgccatcaattcgatgaacattcaaccagaatccactcttgatcgatttgaaagaattattacaattttttcccgaaattaagtttttttaataagtccccaatttaatttcgttgcaacctacagatactgcagatcagccaaccaatgtacatgtatagatatatagctccttacttgcagcaagcacaacacagagaataatggccaacaacaaattaaaaacaactaacaacaactaatttaatcaaagatatagaacagccatatagatcgatcagatcataacctccatcttcgtcttcccagcgctggacgatgccatggctcaggtcgatccagaataccgtacaatcttaatcactctccctagctagctctcaattggattagcgcgttgagtgcagatcgagagctggtatgatcagcttaagctaaatgagaatacggagttgtagacaggaacaaatagatatgtatatatgttgtgtgtttggagccgagcgaacgcccgtgaggccgtgatcatacgacaattactaaaaggcacatccttgataaacaatgacgcgaccctcatcagtcttaatcttatcaatggaaattaattaatattgtagactagctcgtgaccggcaatgcaaattaccaagcgcttaatgtggaaatgggataagggcagggttttcaatttcgaaattaaatattatacttgggggttaccgaaattttggaaattttgagccaaaattatttgaaaatttgactgtatttgaataaaatttgaccaaattcaaaaacattgcaaaaaaccaaaaattttgggcgagatttgagcatgctggtggggggctgaaatttcagaaatttcgaaccgaaatttcaaaccctatataatggcgaggcgcccatgttttcttccgcatcgggcacccgttgggaagtgttttgacattcgatcaggacaccagacatgagaagtgacacaaatgtgagaagaaatttagagggaaacatatactatgtacataagtttttcatgcacaccaactaacaaataacaaatgccactaaaaattttagaaaaaattggacatatactttaaatagtattgcatctatatgtgaaatctgatatttaaattcatttttagtcataacaaaagagacaaaattttgacatatttttactcttaaaactgccagattgttcacttttttattacattgttttgcgatagtgctgtaatatttcttggtccatcgtttctttagctgcaattctgcaaatgcaacgcaattgaagcatcatgaaccactcaaattaaacaacacgcacagagaaaacgcacatgcagtgttagggtaaacaatcagtttaaatgtttgaaaaattctgggtaggatagctttcgttgggttcaatgcttacctgcgtagcaggagaaggtggaggacatgatcagaagaagcatcaaaaccgccgcgatggagtaggacatcctcttggtagctgccattaggagattaatgaagaaacaggctccgatcgagctgttattgtacagtatacagtaagtatgtatatatatatatatatatatatgtatgtatatatatatatatatatatatatatgtatgtatatatatatgtatgtatatatatgtatgtatatatatgtgtatgtatatacatatatgtatacatatatatatatatatatatgtatatatatatatatatgtatatatatatatgtgcgcctgctctgtttcgcaatgcgctcattgttgtgcacctttgctcatgtttttagatgagttcttgcatttatgccttcagaaatctctagtgtacaattaattgcttttccatgtgtaaggctgtgtttagattcaaagtttggatccaaacttcagtcatttttcatcacatcaacctgtcatacacacacaatttttcaatcacattatctttaatttcaaccaaaatccaaactttgtgttaaactaaacacagcctaaggtttctttgctgtcatttcaaatgttccagcattaaatgccccttatatctttgtacagttaattgttgtcatttttgttttggatatacacgtatttatatatgacaatagatctcttcagatgtgcaaaattttgaacagaaaaaagtttaattgggccgacaagcgttggcttgtcctgttaggcctgcaagcattatgtatgcatgatcggttcatgactactcgcccatgaaaggagtatgcatgcttccccaatgtttcggtataaatagatcagtgaatataaggtaactatgctatgttaattaagaaatgtacgctctgactttaataattttatgcgagatatgtgacgtcttatatgtatatggcgagagattggagtgaaacaaattataggaactatacaatgctagcaaggtatcatgtataaacagttaatttgctaataggtaacttaggatagaaaatagtaacataagtatagaatctggcactcgtaattatattccaagttacaacaacctctaattcttcatgttgttttcagccagcacagtttcccaccaagcgactcgcatgagcttgttcaacttttgctaaatattataaaaatttattattcggggttatatgtgttctaataaattatatagcactttgcaaatttattcatagtaagtcatgtagtatatatactaacctaattttatgattcttaattataagatgtaagagggaatctttagtccaggcttaggctcttacaaacaaaaaaaatcatagagattaatccttcaaaatccaaatcctttgtttttactccaaaccgaataactccaaaagtttatcattgtttacatgtcctgcagctatagattaattacccaattttagagatgaatcatcaattgaagcttaaataatataacactatatatattctaaaacaaagcagtttcattaagaacaatccaacttaattcctttattaatttccctttaatatagcatttatatctgttcatgcatcactgcaaaatctaagaacaacctcagacattattttccattcaaaataaccgtatgaagtttcttgattatgttaactcttaattaaacctcagacattattttccattcaaaataaccgtatgaagtttcttatttacgttaactcttaattattccacccagctgtaccaatttaattgggccagagcagtatcacaaatatgtgggcggccaaatttagttgagctgagaaacgctggctgatcttgtcatgtctctatttctaatctatggattatttgggccgcaagggaatacggttgtcaaagcatgtttgcacgtgtaacgtcgcgcttttagccagacgttagaaactaattcggcaaaatcataatttcaaaaatttggttctttgtgtgcgagtctaagtcgtgccgtggatctcaattcaaatcccgttgttccctctcatcgccatcaaaatccccctcctcaaaatgtcaattctgattcaactcccaatgtcaaacaccgaaattcaatcccgtccttgaactccttgccaatatttctcttggttctgagaataccaaatccccgtttggaattccttcgtcaactcctccctctcatccaaatcccaaatcccgaagtccaaatatcaaatttgaaattcaaacctaaactccaatactctccaaattcaatctttgtcaaagtctatttcgcctcccttgtcaatgggctgttcctctctcccggcccatcccctcctctcggcccagctctctcctgcgcgtgcaccggacgtgctcggagcgagcgagagagcgccgtcttctctttcccctctgtctcgctcgttctctctcctctctcaccggcgccgatttcccgccaccgccatccgaacctccaccgccttcgtcactccggcaccaaatcccccgcccgtcgccattcaatttttggccgcgccagccgctccttgcacgcgcgccatgccgcctggtcgccgccgcgtcagccctgacgccgcccatgccctgttgccgcgtcgtcggttgtattcttgggctgttctgagctgcaacctaagttaaggtaaataagtcctctatttattttaaggattgcgatgaatcataattgtcaccgtgggtaccagcgctatgtcctgggactggtactgagatcatggtttcgtaggaagcggttcgcactgtttttcctacgacacgctcctgtcaggtaccgttgtacagcggtatcagattgggtgtgacagcacgatcacacaattttgtagcagaatgcatgatatgatgatctatacatgcttgattaaataaccggttcactcctaacacacaaatgggatgaagggaagaatgcatgcttctcccaaaatctcagtataaatacgttaaggaatgtagagtagctattgtatgtcacaattaccttatatgtaagattattaaataaggactaacccaagcagtcacgtgtgcggtcgggagtgagatattggggtagaacaaaattaaatggccatgtctatccttaattattgatttgatcatacttataacttagaacaaacataattgttgtgaaataatcaatatcttttagaaataattatccatacactcgcatgtattctattcctgatggatctatcacatttaacactagaaaatttatttaattctatagaagatatgatcaatgatgccatgtcagttaccatcttcatctggtcttatgtttgtgtaccacaattattaattatacttatttgtgttacaaagcacttaatttgaatatgaaatcaactacatgcacacattttacttgggctagaatggtgtcatgacacatatgtgggcgccaaaatttagttgggctgagaagcgctgacaggtcttgttacacttctagtagttctctaagtattgggctgcaagggatcggaacatcactgtaaatgcatgtatgcatgatcacacaattttgtagccgaatgcatgatcccatgatctaatcatgcatgcatgatcaccagcatcagtgacggcaacgcccatggatgtgcttgctgcctctgcaaattaagctctgctgcctcctaacatccaaatttagttgggccggaaaagtgataacacaagtgttgaaggctccctcttaacatcgaagcgttggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttacagttaccaataaatccaagtgtatgaataccgctgcaacactccacctaacagtatttcaaggatatcgaataatagatgtgtatatctacaaacatgattctaccatacaaatggtaggcttaaactagaggggattcctatgaattaattaactaagcttaaactaaataaaaatctatcaattggtgtccagttcatccctggtctaccaagagatctatgtaagtaaacgtggggatagaagggatgatggacatggttgtcacacctgctgtctatcatactttccgtggagagtcacgtagatattaatttaagtgcctacctcactataaatttggcgtctatgtggcaccttctgtctgccgtacttactttccgttgagagccacgtagctattaatttaactgcctacctcactataaatttggcgtctatgtgacattgttcatcgtgctatatgtctatgagagaatatgattagaaaaataaataaaagaactcaacagaacccacatgttatgattagcttaaataaaaataatattgtagaacctagtaggccagcggcagagggtaatcgatcacttgagcaccgccgtgggatgttgcttccccattatcgcaccactagcctactgaccgcatcgctgaaactgtcctctgtgccgagctcgagacggtaagagctcgagccttagccaacgcaggggaggacgcggcgacaatgatggggacgatggtggatgaccaccgttgtcatcgcacgagccgatgatggagcaggactagccacctctagggctaggctggccagcactaagctaaggtgccctccttgctctctcccgttgtgtcattgccagctggtcatgcatgtgccagaaggcatagcagctccgatccctcatcatcgccgatcactctggccaggtcaggcggtgatctcggtggagggtgcatcactcttgttctcgtattacctcttagcaaaagtgtactgaagcatctaggtgcataaggacgactgcccaaccatgcaattgatctagtagctcttgaattaaccggaacttacgtcgatgacacgttagcacaggttttctggtcacaaaggacaaaattaccattcaatctatcgggggagtttcgatagcggaaggagtctccctatctgattttagggttgagaaatgtgatttaaactggggctataggtgagaaaggtaaaatggacggtttcctttgcagaggcagcgatcaaatacaagcggcaaactcaatctctctcattttctttttcccaagagaacacggtccgcctcggtttccaaatttagttgggccggaatggtgcaatagtgaacgcttgcgggcgctgggccctaaaatcttacttgggccgacgttcagtgggacacagaggccgcatgaaagtccggctgatctggttgggccttgtagtcgtacggctcattatgagttgcattgggtcgaaacgagatttgcaaaccaattctccatttaattaacccttttttttgtgttctctccgaaggaagtaataaaagaggaagagaagaaaattttgatattcgttgcagttctgttcagagtaaatggaagagacaaaatcgatgcagatcctgaatgtgatttcagctatatcatccctgttttgcactgttttcttttcttattttgaatcttttctgaatacgcatgcaaatcaacctttgcgaccagctcgcgtgatacacaaacacacgattacaatgttaggaaacttgttctcaaggcgcaaaacttaccgtgacagaattgcatgatggagagatgctacttaatttgatgtctaaatcgaaacctcttacacaacaatcttgctctactagcttctcttacacaacaatcttgctctactagctagtgtattatatatagaacatgttggtgagagaattttatgtttgctatcagtatgtaatactcttgggagattcgaggaaaacaaaatatgcatctcgtactctaaacctcactattgcattgttctccacttatattattcatgtagtaacatctgatatgttatttaccacagcgaaattctcttttcaagtcagtgatgtaaaaacatctaatctgttagttgccacggcggaattctcttataaagttgactaggaaaaatacccgtgcgttgcaatgggtgttgactagaaaaaatggccgtgcgttgcaacgggtaaagacgtttcttcaatgatacaacatatatgagtagttgagcaataaattaaaacattagggccactatacattataattaaaactaaggataaacggccagtcggccatcatcaacgatgaagattaaatctaataaattaaagctgaattgaaaagagaaatcgtgaaaaaaataatgaggaaaaactaatccacttttgcaattaattggaggagaaaacacacggaaagacatattgatgtggcagcgggacatattgacgtggcagcggtgctaagatttggcccggtgacggcgggaggctcgcacacggatgggaaaataaacgaagcgtgattggaacaaatatcccaccaaaacaaggacaaaaaaaaatccaacccattctaaggaaacaaaaacaccatataccatgtctgcacaattaaattctcttggaacatctccccttgcctaagcaaagagggaaacatgagtttgactgatcttacattttcaaacaaacaacggtgataacctctttaatttcatcataaaccccgagataaggactgcatatgaatcacattttgtatgcatatgcaacatgtttttctccgaaaatgtcaatctataacaggagcatggcatcgtcccttcagttcagatcttcaaatattatctgaattcaatcctcgatctgataagtagtgtttgtatcccataagcaaagcctgcataataccgacaaatcaaaagatcaacacaagctagctatcttcttgcagcaatttcagacctgctgtagcaaccagcagcctgaccattgaccaacctgacaaacgaagggtatatgaactgaaatgcctgaatttcaagcaaaattcgtctttaatcccctcaaggaacctgatatatatgttctggtctttgcaatttttttttgtccttcacttcacatcatccatcaagtagcttgatgaatcatgagtcaaacacacttttagctagctagctagttgcttccagattacctatcatatccgttgattttttttgagcaggctggagaaatcctgattcaactctgccacagcacatagcacttaattactgcctgattgtccaatcaacctcatgtaaaaaacctagctttccacttgcaagaatatcagcagatactcatgtcatcgaggcgctaatcgtgcactgactgatgcgtcgcttcagaggaagaaaactgcaaagctcgtgcttgcctgcctgcatgtcaaggcgacacatcttaatatggaccttatcgttttatcacaattcacaatcctatcattttgacaatgggaaagttttctttttctgagggaatgtaccctcgcttttttattttatatactacgatttttttagaaaaaataacaacatttaaattaatatgtgacataccactcgataaacaagtacaaatttaactttacagattataacaaataataataaatataaatttgaatgcccatactaactctgggcctgttcggtggctgcagtcgctgcaacagtacacacgttgttcagatcgctatgatgcagcggcagtgctgcgttgcagccgcagccacgggctgccgaacacagcctctatttgttccttttattacaacccatcgaagttaaatttaatcttaatatgtttgtgcaattatatatctcatattaatttatcttaacatttgaaaaagttagtaacaactcttttgagtcgtcgtgaaaggcagcaacaacctaacagtgacgtacgtgcaaaaccacggtacagttatcagctatagcaacgaaagaaaccaaaacccctgcagctgaaaaggaccataatattttgcagaagattcgcaggtttctgtcaaactatttggtgttgaattgacacacagtacacgaagtcattatccaagcataccaccattgacttgaccacagattgagatgcatagcttagattttaatattatataacacaattattttttgaaactttgatcagaaatattttgttaaattatttagtaacgtgaagtaaaaaaatattatcacattgtcatgctaatttaaaacgtgtatgcttgtttgttttcttcaatatttttaagaaaaacgaatggtcaaacaaactataaaagttaactgtattatatatattaaaaaagtgtgtattggaaaatatggtagtaatatactccttttgtttgatgttgtgatgttggttagctcaaaattgaactaacagtgcgtattaaatgtttggaaatggaaggagtattaggttcggacaaaattaggttgtgctcagggacaagacggtcccaatcactgggaggaaatttaacagtgctccggctttgaaatgtgtgcatatatatgttggtcgatgacgtggcgtacgtgcaaagttgcttctctgccgaattaaccggcatgttaggcagccgttgtggcgccaccttggccggccatgttggtgccgtgctgctccgacaatatagttgcttatgtaaatttggttgcagatgtgtcaaattgcttgtgggatatgaaaacttataacccctaattaaactaccactagtaagtaagtgtgcacgtacaaagcacgtcatacttctcatcgtctgctttgttaacttattgtcatagcttatactcgtttcggtttcaaattaattattatcatattttagatttgtctgatcagatcattaattcttaggaatgtatgtataatttaacaacatatgatttatgtattattatgaaggtatttctttacgatgaagctaaaagtataaaattttgtaatattagaccatatgagtgcatagaaattaatggtcaaagattgaaatatttgattcagaacaaattaacctagaatgcaagtaatctgaattagatggagtactcaaattttgaaatttaattaatataaatttgattttagtttcctttttttcatcatattctattttttcgtaactgtagcttataagtcgagtacatataataaactgatgaaaaagaattcctcacgatagcttataagtcaacaacatattataattgaattgataaaaataattttagggtaccacaaaattatcaccgttgaggattttatatttacatattcttagctgttctaaagccaaacctgcgagtgaaaagaaaactttgaattaaattctaaaatgatggggacgtattgagggtggtcgactgaacttggatctcattaatttgcatgcattcctaattattggacagttatatgtccgaccaacattttactgatgtactaggcgtgctacaaagagttgtggctgatcatgtagttaattgatggcttaatatttggctttaatatgaaggagaaatggaacaataattcttcgtccgaaacatatatcaaatgaaatttgctgagcagagattaaatcaatacttacatggcatgttttactgcattattatcatacttcttccttttctaatttttatattagaagtcgtttgattttttttcttagtcaagctataagtttatagaaaaatatactaataattttaataaaaagtatattattaaaatattcaacattaacttaataaaactaatttggtgctgtaaatattattaaattttttaataaatttaatcaaatctaaaaatttgaataagaaaaaaaatcaaatgatttataatataaaacagagagtacttaattattcttttttacaggaaacacagcaggagatactcctaccgtgatgcattgcaaaagacagagagtgtttacgagagactgtagggtacttaattatgtccaacagccacctaccaacacgaggggggttaaatcactgacgcatacgcaacgtactgtttgcatttcttagagtataaacagtactgtttcaattagcaccgctgtttcttgaatcttacaggcactgtcactgtgtagtactccattatgaaaattaagaagtttggtgtcagttaacaaagcaagttcaacatttaattaatttcctgcgacgagccaaagcaaagtaagtacaaaagcaaactgagtacatttaattttttttcaccacacatatcggatgagccacaaattaaagcggataaactgcacctagggcaagcgtggagactgaaaacataattcttttctatctatacgaatagatcgaaaacatattcgctttgtaggtctaaaattactcagcatcagtcattcaattttttttctctgtggaccgtggagaaagctggagaaaaatatattgtaaaccgttagacagattttgatgaaaccaaattataacagtgtaaatcgataataatagttgtatacaaaatataattatgtatatatagaattagaattgtatattaaatttaaagttagttttaatatatgttgtaaatagacacatctaaatagacgtataacaagtccaatcttacaatctcacgcaaaattacgcagaaaaatcccctagttgtttttcattacaaacaattaagcaaatgaacttctttactgcttgatcttcttagatctgcaaggaaattaaaaattctactatcattagtcagctcgacttatcgtgagtgtttgtgattatatctgaaatgatatggttgcacctcgtcagcgatagattcatgcttgttgcatgtatgcagtctccatctctttcttgtggtactcatacatttttcttccaagcacgctaacaaactcctttggctgcatgctgcatctatctcaagttctcaacccaaaaatgccaactttggcacgcaaatcacgcacaaatcattggccaccaccgtgtataatgattatttagttatatggagtgtagaaacacccacataattccagatgacacgtggtatacaagttcaggttaagttattcagaggaaaaagttcaagcagtacctgctctgttgtttcacatgtaccaatcagagaccaaacctgctgcgatttctcacaattcggcagctgttgattgtgcctactgcctagatagaacttaacatcttaacggtattttgacctgtatgtgctggcctaatcaatagcattcatccatcaactgaagaacaaagaggccattcatggttcagagttcagactgaacctgcaggccaggtagctagtactaatgtacaagtgcttgtacatgtgagaagctggtataccgactgcttgcacatgtggcgacaatgtaaccgtcagattgaacaaaaattgaagccgatcacacctactgtagttctacagtccctttcttccctgccatgaatatacatgtactatggctactagctcatgctggacggttctcaatgagatcaagacatctagtgtgcgatctatgaccaaatatctaacatgctatcctgaataagaaagtaaactgtgcattatttatttcagagtttgttactaaaggagaaggacagccatgtaggcatgcatgccatgcatatggtccctgaaaattaagtactagtaataagtatggaactttcacctatctatctatctagctctttcatgcatgatcaggcaggaaatccaagtgttgtcttgtcctataaaagaagggaccattgatctacctctccacaattcaatccatttcttcctctaccatactatacctagcttgccaccaacaacagtacaccatgcccaagaagaagctgtcacataggctgttctctgccttggtatccctactccttcatgggaagcctatctctagatcatcatccaacaccaacaccacattgccacacccttccttgctgcacaagtcctcctcaagcttccctcccatggagaagctcgccgcgaaaaccctagtactcgacgtcgaaggcggtttgcttagatcatcctccttgttcccctacttcatgcttgtggcactagaggcaggagggttcttgaggggccttgtgctcctcctcctctacccattgctatgtgtcatgggaagtgacatggccttgaaggtcatggcaatggtgtccttctgcggtttacgggcaagccggtttcgggccgggcgagccgtgcttcccaagtggttccttgaggatgttggggaggaagggtttgatgtgatgaggagtgccatgaggagggtgtgtgtgacaaagatgcctaggatcatggttgaagggttcttgaaggagtacttggaggttgaggttgtttcaggtagggagatgaaggtgatttgggggttcttcactggcatcatggaggaggaagaaggtggtgatcaagaggaggtgttgcttgaggagaagaaaatgttggttgatgttgtgggcttctctacctccttggagttcctccaacatcatctctcacattgttgcaaggtataatatgtcataagtaattaattcaacatgtaaaatttgcatgtttgtgttaattcttatactttgttatatatatatatatatatatatatatatatatatatatatatatatatatatatatatatatatatatatatatatatatatatttgacttaacttgcatgtgagtttagatcacctagctaaggtagctagttttacatgtataaactcccctttttggtttgtgtgatttagctagttcaggtattagacatgcatgtaatacgcgtgattggattgaaacaacgtatataatatctgcatatttacacctgaaagtaaaattagatgtaatagttaattacgtgcacgacgtcttttcaacggccggtctcatgctgatcgtgcaatcattgatcatatatacatactttttttcctctttttatgtattctttttgtatctcatcatgtgagaccaacaaaagcataatatctgttactgttagacggccactcattaattttcccagaaagaatgtgacctttaccatcaagtcacaggttttaccccttttcccaaactccccagcactttcccgtgtcaattaaatttaagaatattttgatagtcctccaaaaaaatagagaatattttgatagaaatagagaattttcctcatgtgaagtagtactgtatagtgcatacacaacatttcgtcaaatctctaattaatctgaccatttaatcacacatgcaacagtttcgttcccacgttataaaatttgagatctgaattactgtgtatgcatttcatcttgtcaaatctgtaattaattcgaccatttaattatacaacagtttcgtgttcccacgttaattaaatttgatcagaacaatttgatacaactaatactactattttcaaaattaattcccctcatgtgcattgctgtatgcattccatcttgtcaaatctgtaattaaattgaccatttaatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaattactcactcacacaacacaggaggtgtacctggtgacacgtgaggagaaggcgaggtggtcggcgctgccgcgcgacaagtacccgaagccgatggtgttccacgacggccgcctcgcgttccggccagccgccggcgacacgctcgccatgttcacctggctccccttcggcgccgccctcgccgtcgcccgcctcgccgtcgcgctcgccgtgccgtacaggtactcgacgccgatcctggccgccacgggcttgtcgtggcgcctcaagggcgaggcccccacgccgctcgccggcgccggcgacggcgcgcgccggcgcgggcagctgttcgtgtgcaaccaccggacgctgatcgacccggtgtacgtgtcggtggcgctggaccgccccgtgcgcgccgtgtcgtacagcctgagccggctgtcggagctgatctcgccgatcgggcggacggtgcggctgacgcgggaccgcgacagcgacgggcgcgccatggcgcggctcctcgacggcggcgacctcgtcgtcgtctgccccgaggggacgacgtgccgggagccgtgcctgctccggttcagcccgctgttcgcggagctgagcgacgacgtggtccccgtcgggatcgccgtcgacacggcgatgttctacgcgacgacggccggcgggctcaagtgcctggacccgctctactacatcgccaacccgaggacgtgctacgccgtgcagttcctggagagggtggacacgtcgccggcgagggagcggagggcgccgtccaccgacgtggccaacctcgtgcagaggaggatgggcgacgcgctcggctaccgctgcaccatgctcaccaggaaggacaagtacctcatgctcgccggcaacgatggcgtcgtcaacaccacccaagacaaccactctgctccggggaagaagaagatgcaataattatgaattagattagccaaaaaagttctcaaaaaagttctagatagatttcggttgttcttttatctttttaattatttttttatgttgctgggtagtttaatttggtgtgtgtttatactgtatttcattcttgcttcagtttggctggtgtgttcatcaggttgatttcttctgtgtgttttaatcaaattaatgattgtatagaaacaacaagaagctggcaccatcaaggagcttgtagagaaagtactactacgtgtgtgaattaattagtgcatttaatttgttaggtatgctcgaccattgttgcaatttgcttgttttaaaaaaaatctatgtatattttcttagggcatattcaaagatagagtctgatatagtcttttagtttatttgtagactatgattttataaccattgagataacaaaggctataataattagtgaactaagataagtttttattatctttcttttctcttccccaagcaaagtttctttttataaatgctaagaattgatgttaagtcattgttaagcttagagcaagtttaatagtatagccagctactagctccaaatcatctatagtcaatttaatagttaattcatacaatagttacctatgaatatatatactatattattaatacctggtcccacctgtcatacaaacattgccatcttgaagttagtgctacagctggctataaatctgtagtctgctgctcacctctctcctcatttatctcctcgaaatatgtttatagttttggcttatagtccgctattgtacctactcttagtatgtttctctctctctccttcctcctcttttttctactacctatgttctaaaataagtttatttttttatccattacacacatatcaatacaaaagaaaaggactagaatacacctactttatcaaatcctaatgtaaccattcatcattttatccacctctaaatacaattattttctacatttacaaattccgatgcattgattactctaaaaataaacttaatgtgggacagagtaagtatatcagcaaacttaccttgttacctactcaaagaacctgctattaattattgtacatactctgacatcctattaaatgaaagtgaatatgggaatcatagacttgctgtctctctgaagaaaatcccaaaaggagaaaatggagcatcttggacttgtagtaccacaaattttgggtaaacatataatggaaagtgatctaggagtaccatttatcaactatttattgttcattatgaagactggcatatcctagctgaaagataaaatttttggaagtttgaacattactcctgtctgttggaagaaatatgcaatctatcatgggtccattccatgaagatgacataatagagaagcaacaatgcaatccacatgccactatctcatttaataaaacatttatactagaatatgtaaaccagcacaaaacataataaactgtcgctcttaattttgaaaggatcataatcttctgtactgtctaaattgaagacatgaaaatgccattatgtattttattcaagtatttaaaatggccatcatgaacttaaaaaggaatcagaaaaggctttcatgatcttctatacggtctaaattaaagacatgaaaagaccattatgtattttattcaagtattttaaatagccaggatgaacattaaaaggaatcagaaaagctgaaaaggcttcaggcaagtgaaaaagtgtctaaattaaagacatgaaaagaccattatgtattttattcaagtatttaaaatggacaggatgaactttaaaaggaatcagaaaaggtttcaggcaagtgaaaaaggaagaaccatgcaaataattgcgtttgccgggagtcgaacccgggtctattgcttggaaggcaattatgctaaccgttggactacaaacgctatttgtcagttattaatcaaatttattaatgttcaaagctaagcacaacgtgtgacactactaatcattgtcaggcaattatctatggtgcctaacaaaaagacggtggaagcgattaatggatcataacttcataaggatcgttgcacaatcattttctagcataaaactaattaatcaagaacctctcactgtcatgacattcatgcatagattgacgcctatctcagagggaaaggaagtaaatgtatcacactctatctcaagcaaacaacgaccccaatgaaaacagcggccatcgacccatgcattcgacgtcgatcgtcgacctgcaatgcacactgatctgctttgcttggttgcgttcatgtcggctcagagttcatcagcctacgatgcttgagcttcctgatcatggtggactctgcctgcccctgctaattccggtgaccacgtagtacaacgaacaggagtctacttgacttgtagtagtagtgctgtgcattcaaagttcagtagttgaggtgagcatttcagcaccagccatcacatctccattagcccatacgctgcaaagcaatctatcatcatgggccatgaatctataatcatggaccatgatctatgaacaaagtggtagttacgtactagtagtactgtattaatgcaccgccgagttgtacgcacttacgaggggagagaacaaaaatgtgatgtcatgtttaattcgtctacatcttggtcgccgtctgatctcctcatgatctgaaaaaaaaagctggtgatcaggattggatcacatgctacctaccaacagaataaaggttcagcacaggaacggacccccacaagagaggccctgatcgaattctgaaccaggggaacagttatgttcagtaccatgttattactgttgcagcacgagctccttcgatccccaaatgtacttatgtactatacatgtgtgctcagcttgcgtgcccacactgaactggtagaatcagatctccaaaacttgtagtctagtgtaatggacagaccaaatctgagtagcaaacctttgatgaaaccagttgtttcttgctcgtactgtctcctttcggtgattgaactgccaggaccaccacggcgctcgtccaggataattgaactgccgcgcttctgctgcgaccctgcatgaaaaagcaaaatgttttgtactgaatcagtaattacggtgagttgtaccgtggaaactttaactgcagacttaacactaattaagttcagatttttagtttcagatatccataacatagccaggaagagcatccacaagatcagctctttggtgtagtagtaacagatttaatcatttttctaggaacacatggaagactttgcatataattgcattaattttctcaaggagagaataggaggaaaaaaacatggagaagtcataaaaacaatcgagttctttgttcaagccacccgtcagattgccaagggatcatgatagcctggaggatttgaatttcatatcccaagtgccagacgcaaatgtagaagagagcagaaattaaacaagatgtgtgggatgcaaggaacaaggctagctaagacacaatgatttaatcatggacaacaagcattctgttgaattccctgggcaactgctcccaggacagactcaattaagttgcaaggaaatgtagttgagatctggataggaatggcatggttcatgtcaattattgatcagttccttcattttagtgtatccgtggagtagtatgcaagttgcagccgcagcaagccatcaacagtagatgagaataaggtggttcgaactgtgacattcttgtgaggacaaatttcaaaatcaggccacacagtttctcaagcaatttgattgcacgcattaatttaggtgtccatgtcctcttattcactgtatgtaaatcccatcaagcatatatacggcggattcgaccaacagtacaactatactgcagatacagcctgccaatactgcagacacagcctgctacagaatcactgtccatgccactgtatagataggatgacttccaacaacccaacaactaaatgaagacatatgtgaatgtgagctctaaaaaaattgaattagttgtgttaagatgtttacttgattatattaacaactgatggtcattacataagcaacaaaaggtggctgagacatacttacagagatcaccaaagagatgattatactatatatcagagctgtcactcatccagtggtttcatccagttgcgtctcacctcagagctagggtccgaaatcaaattagcataatcttgatctatgtgtcagttaacacttccccaggatataatttttgtaaatcctaaaaggattcgtgcagccaagtaccatcgaaggttccaaacaagcatcaatgctactagaggtgttaactgctgatccttgctgcagacgaaaaaaaaagaacagattagtctcagaaatactttttgaggctgtagagaattgagagacaccaaccacaacatgaaaagaagaccagtatgataccatgaatcagtgtgacaacattgtccaaaagcaaaagatgtggtcaacattatcccattgttgtcattgcaccgactctactatgaaatctgacaaagacaccaattgtggaaaagaaccatgcaatcagctgatcaatttctcccatctgacactacttgtcaatgcaccaagtatggaacataaaaatcaatgtactggaaagtggaaacagaactaaaggcactcacatatgcgcagtaatgacaatcactgttcccatgcaaagggagataggagttaatttctcatctttatcattttttgttctgtgtcctttggggtgtggaaggatcttctgtaggcatgctcaaacttaaacattgaaccaatagcccatttgtggacgactatctcaccaaaaatctgaacaagaacatgatcctactttgaagtggtgaaacctatatgggtctctcaacacaatttccctattaaaaaccatgctaaccagcttaaataccagatgacagtctgaacagactctgagattcttgaatattcttactgtagatccttctgggacaacgataaggccatatgccaacgcaagtttctcactatggttccaaaggttctgctccttctgctcttcatctgtatcatgcagtgcagatgatgtgtcagcaatataacctacttccctgagtttcagcaacatttcatctaactttgcgtagatcttctctgcatgcttatgaccccggtcaccaataccaaaggtgcttacttcattcttaagcttaagccaactgcaagctggtcttttgtttatattgatggttttcatgtgacttcgtaatttgtcaacatccgcccatcttgcatttgtagcatataagtttgacagaagaacataagctgaatcatcgaatggatccaattcaagaagctttttggcggttttcctcccaatttcaagatttttgtgggttctactagaggacaacaaactccgccatatcagatcatttggtaagactggcatttcttcaataaatttctctgcctctgcaaaccgacctaagcgtccgagaagatccactatgcatacacaatgttttattccaggggaaacaccaaaggaagaagccatagagttatagtaatctatacccttgtctactagaccagcatgactacaagctgagagtagagcaacaaacgttacatagtctggctttctacccgttgcaaccatttgcttaaatgtttcctcagcttccttgaaatacccatattttgcataaccagatatcagcgtattccagcattgttgaggtcgaatggcttggtcaggaaccacttgcaacatttcatccatctttccacatttcccatacatatccattgcagcattaacaacgtatgagtctgaatccagcccagatttcataccaagaccatgtagctgcatgccttcttctaatgatgcgaggcttgcacaggatgacagacattcagctaggcaaacacgatcaagtttgtttccagcatgctgcatatcaatgaagagctttagagcttcctctccatggccaagttggacattcgctgctattatggcattccatgaaacaatgtttttgttggtgatactattgaatatattagtgcttgactctaaattgccacattttgcatacattgtgattagagagttagcaacatactcatctgacaaaaatccagtgcgtattatgtatgcatgtaagggccttccataattatgcagatcatttgaagatgcgaaagaaccatggatatttatcattgtaatgtaatttggctttatccctgcacttctcatccaagaaaatacttgcattgcctttgtaccatcctcaagtactgcgtagccaccaataagtacattgtagctgacaatatcatgagtcggcatggactgaaaaactttctcagcatcttccatagaattgcatttcccatacatcgtgatgagagaattaccaaccagtagatttctctgaagactcaactgcaatacgatggcatgaaccattttgccatctatcaaggctcctggacttgaacatgctcctagagcactggaaaatgtcaggtgatttgggctttcatttgtatgaaataactgacctagtgtcttcaacgcgtcggtgctattacagttctgcacataggatgaaatcatagtgttccatgatattaggtcccttctactcatgttccagaacagaaactcagcatcactcaattttccagcagcagagtacatattaaccagagcattaattactgttactgatgaatccagactgctcctgagacacagggaatgaattccacttccatggctgaaatgatctgaggaggcacagacagacatcaagctgcacagggttgttgcatcaggccttaatccatgatgacgcatatctgaaaacaccagaaaacatttgctgcagattccttgatgtgagtacatcgatatcatcgcgttccatgaaatagtatcatgttcctccattcgatcaaagagcttctcagcatcatgcacccttcccaagttgccaaacatggtaatcaacgaattcgccacagagacctggttttggagtccagagacaatgacctgggaagcaacctgaagcccaggcacctcattctcgagcgatccacacaagctgaccactgtcgcgaacgcatttgcattgcatgggaccccatccctcctcatctgacggtaagctctcaatgcctcttccaggtaaccattggatgacaatgccaccatcagtgctgtccacgacacgacattcctctcgggcatctcccagaacaacctctgcgcatcggacacgatcccacgggagccatacaagtgcaggagcgccgtgccgatgtagacgttgcccatgagcccggccctgtgggtgagcgcgtggatggcggcgccgcacgcgatgccctcgtcccggccccggcgctcgcacgcggtgacgaggctggcgagcgcgaacccgctgagcgggacgccacgctcccgcataccgcggagcatctcgaaggccgtcccgtcgcgtccgcagcggacgcagccggagacggcggtgtaccaggtggatggggtccggtcggccatttcgtcgaacaggtggagcgcggcggcggcggcggaggcatcccgttggcggaagtagaaggcgaggagggtgttgcggtggaaggcgctgagcgggagtgcgaggcggacggcgaggccgtggatggcgcgggcgaggagggggtggtcgccgaggcgggagaagccggcgcgcgggaactccgcgacggccgggtgcgggtggtcggcgaggagggcgagagtagatggagggcattgttgcgtggaggcggtagtggttacgcggcaggaggaggaagtggtggcgaggaggaggcgtggcggcggccggtggatgcgacggcggtggatggccggcggccgggtgcgccgaggaaggagagagagaaacagcatccagagcttcacggcggcgaatttgcggccttttggcccatcaaataagtagaatactgagtaggaatagcccaaaagaatttggatccataaaggcccatgaatatttggcccgaaagataaaaggaataagttcactttgaacctcaaaactaatcgaaatctaatggaaaaagtacaccgaaggtccctcaacttgtcatcgagttacaaaatggtcccctaaccgcaaaaccagataccgggtgtccctcaactaataaaatcgttagtttagatcctccggtggttttgctcccggttttatctgacgtggcggctgagtcagcgtgcaacccacgcgggtcccacatgtcagaatgtcaggttatctctcccctcttctcttccttcctcatctctttctctgacttctttcctctctacagggcggctggcgggtggggaggaggtccggcggccaccgccggcggcgacggcggcggcgcatgcgacctcggggtcggaccatttgacaggcccgggaggcggcggcggcgacacggaagaaggaaggcggcgacggctgcgacgcttgagatgggagaggcgcccggcggcgccggcgcgggaagaagttgtcttcggcgtcgtgcccgctccgcccgccaccgcctgctcggctcgccgctgccccgcgctcacacattcccaccgccgacgccgctgacggcgcgggcgcgagatctgcggccgtggacgacgatggcggcggcgtcctcgctctccccatcccgctccctgtcagtgccatcttcctctcccgcagcgcgcctgctcgccgcttgtctgctccgccagccggctgctccccgcacagtctgcggtggcgaaggtgaccgtgccagcatcgaggtcgtagccgaaaatcacccaggctatatatagctattagccaattctagagccaaacgagaattcagttgcaagaagtaattttcttatatcaccgctctctacaaattaaacgaaccccaccacaagaagctagcacatatgagctagcacgcaggatcgattggatgatgatgattatggaggtttctgggagagcgcggatacgatttcatgggcatccttctcgatatattgaacgagatccatggcaggccgctgtgaaaccatcttcttcatccgctccgtcattgatagcaggaatgtcttgacagatgattcaaggctctcaaactgcctgccgaccgatttcacaagcccatccaattcttccagatccttcacgagtgttttattccaagattaagttattgctgaacaaagaagaaaaagtaccattatattataaaggatgagatgaattccgaagcgccttcttcggcgatcgtcgactccatttgtgttttcagcccctcgtacgcacggttgtaatactctcctacctcctgtgcacaagaatttaattgatcatgcatgcatgacaatgtataataaagtactaattaattaactaactaacattcgcatggtttttgcagcaaccgtcccatatattgattcctggcgcgtagaggttggtaatgcgctaggcctcgagtttgattattctttcttgcctgcggtcagccggagtgggggggtgttgcttgcctggcggacgaccgtctggtctatctcagatgttcaccttgcggatttctctcttaccgcgttggttcggcacctttctgatgttgccccctggtggctctccatcatctatgggacacaggaggagcctgacaagcttcgtttcttagatgagcttcgttcactacgctcctctcgcacggggccgtgggccatcgtaggcgatttcaacctcattctcgaagctcgggataaaaacaaccttaatctcaatcgtcatatgatgggtcgttttcgtcggctcatcgacgagttggaactccaggagctgccgcttcacggacgttgcttcacttggagcaatgagcgcgagtcgcccacgcttgttaagctcgaccgcgtcctcttctctgcggattgggaggagcttttcccctcttgcctcctccaagcggcctcttctgtcgcctcagttcactgtgctcttctccttcatacctgcgtcacctccccaaaagcgcatcgttttcgttttaaggccttttggcccaagttcgacggcttttcttcaagtcgtgcaggacgcctggcatccccctgccaacctaccccctcttgctgctcttgcctggtgcttctctaccacggctaagcgcttacagagctggagtgaccgtcacattggcagtgttcgtctacagcttcagatggcgaaggaacttgtcttccggcctcatgttgcgcaggagagtcggtctctttcccccttggagacctggctgcggcgagatttaaagttgaagtgtcttggtcttgcctcacttgagcgtaccatcacgcgtcagcgttcgcgtttggtctagcttaaggagggtgacactaataccaagttctttcacctgcacgccagagctcgtaggcggaagaacttcatcacgcaccttcgtgatggtgaccagcttgccatctcccatgatgcgctgcaagagcttgcctcctctcacttttgcgccaccttggggacgagcgtcgagcgtgaactcgccctagacctccactctcttggcctctgccctgtgcagcttgaggggctggactgtcccttcacagaggatgaggtctgggcggtgattaagtccttgccctctaataaggcgcccggtcctgacagttttacaggctgtttctacaagacttgctgcccggtgatcaaggtcaaaattctggtggcccttaactccttgttcctgaccaacggccaaggtttcacttccctcaacgacgccctgatctccctcttgccgaagaaggacgaggctgttgacgttaaggatttcaggccgattagccttatccacagctttgggaagctgttctccaagatcttagcctcttgtctctcccctcgcctggacgagcttgtggcgcctaaccagagcgctttcatcaagggccgctctcttcatgacaacttccgctttgtccagcttgtggcaagggcgctccacgccaaacgcgttccccgacttcttctcaaggtggatattgcgaaggcctttgacacggtcagctggcctttcttgcttgaggtgctagcccagcttggcttcagtcaacgttggcgtgattggatctccctcattctcagtgcctcctcttcccgagtgctggttaatggggtgccaggtccacggttcccccatcggagaggtcttcgtcaaggagatcctctttcccccatgcttttcattctagtcatggatgtgctcaatgcattgctccgcaaagcctctgactcgggtggttttcttcccctcaattatcgtgctattcgacatcgtgcatccctctacgccgatgatctagttctcttcctttcccccgttcggcaggaccttgagttcatccaaggcatcctctctgtcttcggtgccgcttccgggcttcggaccaacttcaccaagtgctcgattactccgatccgctgatccgctgctcggttcttgacctggagctagttcaatcctcttttccttgctcgatctcggagtttccctacacctacctcggcattccactgtcagttcgcaagctgccaaaagcggccctgaaaccgcttgtggataaagtctcccatcggctcccccctggaagggccgtctcaccactctggcgggtcactcggttctagtccagttggttctctcttccattccggtctatgtttctgtggcgatcggcttgccaagctgggttatcaaagccattgacaagaagtgtcgcgccttcttgtggacgggtacggactcggccaatgggggacagtgccgggtgtcctggatgagggtttgccgtcctagggatctcggtggaccgggcattccggatctcaggatggctggctttgccttgagtgttcgctagctctggcttcagcgctcggggcatccctactggtctgatctgaaggcccctattaagcggagcgtctccgacatgtttgtagcatacaccttctctatcctgggagatggtcaatccaagctcttctggattgaccggtggatcgatggtcgctcgatagcttctatagctcctgacctcctccacgccgtgcctccacgcttccggggatcgcgcacggttgctactgggttagcgaactactcctgggttggtgacatacgtggcgccctcactgtcccggtcatctctcagttcctgttagtctgggacgcggtgcttcctacccagctctcgccgggtgttgaggatcacctcgtctggagttggacgggtgaccagtgctactcggtgtgatcggcgtatcgggcgttcttccttggccagcactcttttgcctgtgccgacctactctggcacgcgaagggctctgctaaatgcaagttcttcctttggtttgcatttcagcagcgctgctggactgccgatcttctccaaaagcgtggtatcgatagccactctgcttgccccttttgcactcaggagtttgagacggcgaaccacatcctcatcgattgcgtgttcgctcggcaggtctggctccgtgtgatgtcccctcctggctgggctgccctctctccccctcgtggcagctggctccaggattggtggtcatcctccagggcctgtttacctgagcacctccgcagcggcttcgactccttggtactcctagtctcctggcagctgtgcaaggaacgaaactccagggttttcgactctgcgctcgcttcggttgcagtcgttttggagtccatccactcggagggccagctgtggtctttagccgacattgctttttttggggatttcttggagtgtagcgtgcctctaccccctcccgctgtttggagttgtgtttttaaccgtcgtagtagtttctcgcttcaagttttctttttactttgttccccctctttaggcataagccagtctggctgattgctttgtgtaacaaaaactcttttcatgctaatatattgacgagcaattcttttgcgcgttcgctaaaaaatgcgctgtggctcgaactttcaccgcattgaggacactgctcagtatagtcactagctgattaatcaagcaacgcacaactaattaattagtggagtagtaattacctttgcttgtccagtgccgcgttgaagaacagcatgtagcagccacttctccaggcacgatctgccgtaaacatgtccacagggaatgcaactgaaagaggaaatgcatgcaattaacatatataaattaaggaggactactatagtactatatatataattgattagttatcaaattagtactaattaacaatcgatcgagtagctcatcaattgagacgtgtcatgcatgcaggaacgtatagtaccagatgcgatggtcgccgttgcaggtccagggttgcagacaaatgctgcaggtcggcgccggcgcctcctcctcctgctgcttatcaacttcttcgaccagctgcgtcgtagcttggccgctgagtcgccgccgcttgtgaccacgaccatgtccctctagctccatcgtcgtcgctactgatgccgtctcattatccttctgctccgccgccggcatcgacgaccatggccaagaaacgccctccccgccggatcccgccgcggcgcggtggccagcgtccttctcctcctcggccgccacatcgacgcgtgccccgctgctccctcccggccgcctccgcggcgtcgtccctacgtgcggcagtgcttgacgattgagggcgatttagtgcgggattaagtgggatttgttggggaaattgatgcccactacacaaggaaccgatttttgcaattaatttggaggagaaacgatagggcagggagatcaacgaaggcggcagtgcttgagtttcacgggagagatgaacagacgacggacagaggtagaagaagctcctagcgagcggggcccgcctgccagcgcacggacagcgaacggaagagaaagagagggggaggatgaggaggatgatttacgtcggcctcgtatgtcagtaggtcccacacatattttttggtgaatgacaaataggtcccacacatcccttctttctataaagttaatgccaaaagttcaaacctcatgcttccacatcatcatcagttgtgaatcattggatgaatgcattagatcgcttcttagccgttggatggaacgcggcatagagcccaacccatcaggtaccgggtgagtctcttcacctcctcagtgccaaaatgtagcccacatgaacacattggctcatcttcattcacatctacatgtatccggcccgtcaatccgtataaaaagagctttatggccgaacacccctttagttgacattacaatttgttaacttatgttagaccattttgcttctttatagcttacgctttgaatgtgctatctaaattatctacaaaatttggatagggctgctaaaaagaatttctccaagaaagtcatttattttgtccgtttcttcttgagattgtacctcctatctaacaaattgatgttaaccaagtcctgcagcaacgtgcggggcatcctctagtattttttatttctaataccacctaagcgccacgtcaacgccacgtggaaaggagaccgagtcaatactgccacgtaggcgcacgtcagtgaaaccgccctccaaaaccggttttgagagttgggggtcgagatatccggtttcgtggtttagggtcacggattagatttcgatcactttttcagggtcacaaagtgaacttattccaagataaaattaggtttgggcccaccatagtctggacgggtggggaaaccgctgcgagtgcgacccccgccgccgtcgccggagaagaatgggtgggcggggcggaggaatacaggcgattccctccataatctccggcaatagctacatggatttttctagcaggttagtgctaccgctcgttccctcactcttcagggatattccaaaggtaatttccagatttattaaggaaaccggtatcatgtttatattcttttcttatcctctttttgctaaagaaaagataattttgctttgttgactccaagtctccaactcgggtcacccaagtcttcgcggtgcttaacttggccaaattgttaggtgcctgaagcatttcgcccggtttggagaacgagagtagctctgtttgcagagtatcgatcactgttcctatgcagtgatggggcttcaaattttggattcttgtgttttaagccggattttattgctgcttgattcctgcagttatggaggcttggcttctgatcaggtgcaatgccggcgatctgagctggtggagtataccaacgtaagggtgcgcagatggatgtgtagctggagatcgtgcgggtgctgtactgcagcaatcggggctacagaggattgatatatttgcctaaacttccatgaacatcggaagcgtgtcatgcaaggtcatgttggtgctagcttggtactgctatatgcttcttcttttttcaaatcatttgagaataaattgattaaaacaatctactccaaagggcacaatgaactggtggaagaagagaagcatccttttcaaattgccataatgggagcaatagacaaactgcatggtacttgttctatttttatgttaaatattagtgacacatgttacaagatcataagttaattaatttagtgaacctactagattttaccacaatatatattgatgtattttcattaggaacaatctgaatatattattcatctaatgtaaagatatagctatggttctacgcagttaatttctgatttttcccaaaatgttattttgtatggaaataaaaatgaggcttggtttcttctccgttgcaatgattcatttcttgccaacatggattccatgtgcattattgtactctgtttatttttcattttcaacttcaatggaaaactaaaatgaagcttgatttttatctaaaatggaaattgactttttttgtatgcatatatgtggggacacctaaattaggcctggtgccccgaaaatccactcgtgatcgtccaggatttcgattacgcacagattaatatacataacaacttttgattaattatacaaatttgatcatacaagctaattatacaactgttaaaggtttaaaagttccaaactaacacatccttatttgaaaatacaaggaagaatccaaactacccaactactaacctcctaaactactaatttacaactaataaactccataggcaaaagctcgagtgtagacaagcctagaaaaactcgttgttgctttagacctcactatcttctgatcttcttgttagcacaattcctctatatgttaaattatgcaagaatgagtacttatgtactcaacaaggcatattataaataattaaatgtagagagatatgaataaataaaacaatgagaaagtaaaagagtagtaataaaatcatatatcatttttgtgctcaaaattttagttttaaaactacttatacttcaggagtatgaatcacccttatgacacaactccaaaatcgggagtacagcgcattcgaatgatttaatttcacctctgtagatactatctagctttacccacacgatgcccacagctagctagaggctgagaataacagagccgttcgaaggtcccacttactactagttagtgcacagtggggttttggcccatcatagtagttgaactcttgctaggcctaagcaaggttactttatcatcatactttcatgggacccactgttgtgaagcatgcagcccaaactccttacgcacgttcaccccaaaacctgctcctagtgagccaaccaacagtctttcatatagtgggacaatatactaggctaagtccaattacttgatcgtgtggatggacacaaactatgtaatttccatggtataagggggtaattataatccggttaaaccaccaaaattatctcaacatccaaacttccataccaacaaacttcatcattcataaacattcaacattcacaatcctcaacattcacgacctcaactcataaatgcccattataaccggattcttatgtttttaaagatgtttgaaatagtaaaccacataaaatgataaccaatgcatctttctataacctcatgcaataatgcttgaaatcgtttaacatctacccatgagatgttaaaagagtaaggtattatgcatcaaattaaatatgaagattataattagttttctatatgatcaaaattttagttatgtcttgccttgtgccccgaggtttcctgcggcttcaacgtagctatctgagtccacgtcagctccttggatgtcgatagatcttgctgtacagtctaacgtatgaataccaaaaagatagcaaataaagcctataagaaaaatgctacaaagaaacgataaaccgagaaataaataaaattggagcaaggcgaaggaaaaaggaatggttcaaaatatattttaatttgaaaacaaaagagaggtgatggtttctataggttgggaatcaaataaaattgaagaaaaggtaatttggataggtggggtttatttggtggatttggtttctagtcggtgctagagtagggcagcacaacggctagatatttggagttggttagccgatgctaaggttggggagcatcacggctaaatattggctcgtctagttgatgctacagtcaaacaacacaacggctagagagttgggaagtttgtgccggtttgtggggcggaatagtgttactttacagctgtgagttgtagcaaagctgctaggttcgcacagagcccgaaagctagtgtgcggcgtgctatggaggttgatggagtagtgaggctccaaccactgtacgcgttaaggcgtggggtgcgaggagcaatactttgaccttgggattagcttatgccgggttttacgaccaacggtttgacatcggggtttgagaccacgtgaatgtctccatggaaagcgtaaagttctcacggcggctgtttagtggctatgggatggtataggtatggtttagaaataaaaagggtatttaaataaatcaaaggaatttgaattcaaaaaggtttttaattaaagaaatttgaatattcaaaaagggtaataaagaattttgaaatggtattttaaatcataaagatatttaaatgacgaaaatgtatttaaataaattataggaaaatttaatttaaaaggggtttttaaataaaacaagagatttaaatttaaaggtatttaagataaataaaataaattaaaaaggtatttgaataaaatataataatttaacaaggttatttaaaacaattttaaattcagaatgtaaataaataaaaggtatttaaataaataaagaaatttaaataaaatgtttaaaataggtaatttggtatcaaaataaagagtttggaattagatgaatttagatcaaagaatttctgggattgggtttgtggttgaagagatatgggtgtctaaagtttgaaattgaaataaaatcaaataaaagatactgtttatgtgggacccactatcagatgctccttcttcctcctctatttcttcttcttctcttcttctttcttgtgacacagataggggagggagaaaggcacggtagaggaggacggtggctccatgttgatgcgaaaaacacacactggcctaagagatttgcttgagtctagtgtaggtccgaatcttgcttttgggtcaaagggcgtgccagttggtttgatcctgcaactaacaagaaacaaacaaggaaacatagttaaatgcataaacgatagccgatcgaccacttgccgatgacgtatcgtttgtagactagccgatataacgtgaattagatcggcaatggtatataaaacataaagaaagttagatctagtcgatcggctgtagatattaacaatatataatctatacatcgaaatatgtttaaactaagtgattgggatagatcggacagcttgccgagacagtataaatcacttatgtataaaagtacttcaatataaagattatatatgttcatagcatagccgatgttgtagatataacatgtatcggctaataccctgatactactttatattaagatatcaatatagaccaaatatattaaataaggattaatcaagtgttaaggtagattaacgtattaataacaagtttaatatatttagttacagtgagatcttaacataaagggcagatttagcatattaagtaaacataaagtaaacaaaataatcaaatcaggtaagatcggttgaaaccccgatgaaaccctaatcggcaaccaataaacaggctagagattgatattttaatcacgacttataagatcaaaattaactgatgcagttataagtataaaaagaagaacaatacctagaaaatcaagtcattggatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgatcacaggcgcttgacggcatccacgagctagacaccaaagccttcatcttccaggaactccacttctgggtttgggaaaaattgagcaaaactgagtacaaccaccgtactcaacaagacacacccacaagtgcaggataaatacaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaagctaaccattccacattttagttgttaagcaggttttaagaatttaaaacactaacttgggtacattgctcggcttgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggacgtgtgaatccaattccacaataatccaactattccatagtgtccaggtggtgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacatgaccaacggaaaagaaaaggcttttactctgataaactccatataacaagcaggaacaaagcacaaaaatgggttcttgacttcttaaggaaaaattagagacttgaacggtccaattccgagttcaaatggccaagctatggtcatttgaagttatatcctctttaaatgaatatttgcgaatttcttcatttaaattttaattttaaaagggtttattgcgtcagccgaggggaggggacgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcagccactcggcgcgcccgagggcggccaagccggcgcagccggcaggaggcggcgcccgcgcctctatggtcgccggcggcggccataggcacggcggagcggcggccgagagaggggaagggaagggggaaaagaggcggtggtccacagctcaccctaggtcgacggcgacgacgaaaaaggcggccggagcggaggaaggcggcggcgcagctcgggtcgacggggtcgacggcgttccggtggtcggcgagcgaacggaggggtagatgaggtcggcgaggatgcggcgaagccgaaggaggcggcgccgaggtgggaggtggttcggggcgacgacggcggcggaccggagctcggcggtgacggcggagagagagagcgacggcgcgagctcgattccggcgaggaggaagggcggcgagaggcggaaacggacggaggaggtgcggggagggtataaatagagccggggcaagagagggcggccggggaaggaaggaaaccggcgcgggaggtcggccgccatcaatggcgccggcgagatttgcgggggcaagtccgtccgtttgaacacgagagagagaggaaaaatgggtggaaagggagagggaatcacggggaataattccccctattgattgcacgcggggacgatggcatgcgccggattcggcggcggcggcggcgctagggcgcgggcgaggcggcggaagcggcgggaggaaggggatgacgggtgggccccacccatcagcgagggtggcgggcgggcccgcccgtcagcggcgcgcgcgcggggagaggccgagtgggccgcggggagaggagagagagggggagggagatgggccgagccggcccaagagggggagggagggaaaggggacctttagggtttttctttttataaaaccattttaactttgtttattcttaataattattatttgtgctctgaaaattccactaaaatttatttacgcattttaggcttttaggaaatatacaaaaatcctccaagccttatttgacttttaactttgcacattttaatttttttggaggctttcacacggattttaattattctaggcataatttagaggatgtattttagagtcgttttgggacgtgacactatattagaaacccactcagcatatcggcatggctgaataaaaccagcatcatacaaacgtttaatttcggccttaatagcctcaaacatatcggccttacatcttctaggaggttgtttatacagccgatatcctggtttgattggtagccgatgttgaacaatcaatcggctaagtcctggcatctcgaaatattcccaagcaaagcaatctctatattctttcaatagctctattaacttggttctaaattcagatgacaaattcttactgataaatgtcggcctcggcttgtctcccggaccaatgtcaacttcttctaagtcatcggccgacatgaaaccttgtcctagtttgccatcgagatcatctacaatatccttggtgtagaagcttgaaccctccacaacgccctcaaaggagcaattggggctctccatctccaattggctatatgtcaaaatcggacacctttagaaaatctccttcccaaactttgccagacaagcaatcaattccatccatctcccaaatagtcaaatcggcattagcaacattgactgacttgtcggctggcacaacttcaaccttatcgccttgccattggatcaagctttggtgcatggtcgaagggatgcaacaattggcatgaatccaatccctaccaagcaacaagttgtaagaacccttcccatcgatgacaaagaaagttgtaggtacagtcttgctgccgattgtcaattccacgttaagaacacccttggtttccgaaggattaccaccaaaatctttaagaaccatgttggtcgtgatcagatcttctgcagtcttccccaacttcttgaaagtagcatatggcatcaaattaaccgcagctccaccatcaaccaacatcttggaaatcggcttaccattgacaaatcctttgacgtacaatggcctgaggtgccgattttctgctccatctggcttctcaaagatagcttgctcaggtgacagaaccaacttagccgaggattcctctaccacatcttcttcctccatatcggcatgatcaacaccgaacttggcaggcaacacaaaagccatgttaaccgacgaagaaacaacagattttcctttagctaacctctttgcttcatcggctaacacgtctcctcttattcagctgatggttgatttcttgctcacctcctcaaactgctccctattcctcactctgaactctcctcttctggttcttggtgaaagggcctgaaggacaccattgcttgttctcaacttgctcccgttcctgagccgattcatcctgaaagtagtcttcatgaatagggcccaatatctggtgaacaggaagtttcttctgaggtagccgattctccctgggacgtgatcggcttgagcttgcaacatgcccccttttatgattactacaactagggcaatcttcgatagatggtagcctcatcccctcattccagcaaaacctgaagaattcacaactccagtgggggtcaaagctatcatcatcttcataaaatttctcttcatgccgatcatgtctcttctgatatttgttgataatccttgcagaattgagttgcttggaccgataatccttcttatcggctgtcttcccagttgtatgaaccatgtttacttgaaaaggattacgctcaattttcatcagcctcttggagttatcaaacttgatcttaccatcttgtatagccaactagatctgttgtcagaacagcttgcactcattagtagtatgagatccagtattatgccatttgcagtatttccttttgcctagttcctcagccgatggaataacatgatttgcaggcaattgaatttgtttctcccgaagtagcatatcaaagattttatctgccttggtgatatcaaaatcatatttctcctccttggaagatggcttcacccacagacatgtagtaacctttttgtttctgatccattcggctgctgctacttcggactcatcttcataatcggaatcagaagcataattgtaagaataaacactattcatctttttgacaatcttcttagcttcctaaaaccgttgttcatgcactccaactttctgggccagatgagccaagctttcgaagtcctgagccgaaaaattttctctgatcggatgcaataaaccctggaaagccagatcggctaattgagaatctgaaaaggacaaactatagcatctgttcctcatatctctgaatctctgaatatagtcttgaatagattcatcatgcttctacttgactggaatcagatctgtcagcttcatctcatgaacgccactgtaaaagtagctatggaattgcttttccaaatcggctcaattactgatagaattgtatggaagattagagaaccaagtaaaggccgatctagacaaagacaaagggaacatcctaaatctaaaagcatcattagccgatgcctctcccagctgagctagaaatcggctgatatgttcataagtagaaaatttggaaaaatctagcaccttgtatcagtgtggtaatggaatcctatcaaactactcaagatatggtttccgatacaaattaccagaatctttaggcttgaaaccaaactactccctcataatataggctatcatatcggcccagggcttctgctgttgctgctcaggtgcaccctggaactgctgctgtgctagatcatactgattgaattgaggcacaaactacggctgtggtgaaggtgctagccgatactgtccttgaggtgagtatggttgaaacatgttacccccatcataaggtggtggagtctgatgcaccatgtggggttgttgaattggatcagtgtcacaccctgaaaatcgctaaattataaatcgttgtgaaaaaggaatttttagaaatcatttaataactaaagaaagtgtgtgaataaaatctatgaaaaatttgaacttaaacttgagctagataaaattttattaaatactttgtatgcccaagtattttctggatttttcccagaattatttgagcattggaagtatttttaataactgaaagatcatttcagcaattatttaaattaaaaagttaattaaatcctcttcctcagtctgggctgaatccggcccactcctctctctcccttctcccttccgcagcccgtgcctctcccttggccgaagtctgcattagcaccctcctcctcctttctctcttccgagccgggcccacctgtcggactcgccttcctcctccagccggccgctcctcccgtgacgtgtgttgcagcgccgccttctccgttcgatccggtgcatcccgtgctccgtttccaaaattggttgcaaaaacggattcccctcgatctcctctatcttatccccaagaaatccccttgaatcccgtggtatatcgcgtggattcgacgtggttttgagttcctattttccggcgaaccctaactaatccgtcgccaattccatccgttcctgagccgatctctccctcttccggctataaatagcagtcccaagacctcctcttccgtttccctctttttcccgagtttttccatagccctagccgcctccccacgttcggcttctctctcctttgccggccgccgctccagccgcgctgtgctgcctccccggtcgtccccgatctgcgccgtcgcttccctcggcttcgcagtgaagagatccacctcggccacccgttcctttgcgccaaatcccgccggaagccgctgtcaccgtgaaggccgagttcgctgcctcggtttgatcttcggcgaagctttgccgtcgactccgtggtcgccgaaccccgccgtctcctccgttggcattgcagcgacaacagcaagcccggcagccacctccgcgaagacgcaagccatcggagcaccgtcgtcactgtgaagccaatctgttccatcttcagccgcgccgttcgtcgccgtccatcgccgccttcgttcaccgtcgccaccctcgggatcgcaggagcgaggtgaagaccgtccgcccctcggttgctgcctctcgttgccggaaagccgttgccatcgtcaacccaaggtcgccgccttttggagttcgtcgcctgccatgtccctcgtcgtctgtcgttgcgtaagtggtggtaagggtcgccttgatctcctctctctcccggtgccctccgtttgcatcattgtaccgtggttcgctggtaactgccgttcccgtgcttgcggtcgtcgatcctgcgtggcagccatgtcatcgctggcatcagcgccatcttggccatccaaaattaatataaatttgtcatctcatttcaatgacatattattcctttttaatatatgtcatctaccaaatatgatctaatatttttccggaaaatgttttaatcttctgtctcagctataaatcatttgtaaattgtttaatcaatttggaatagtcttttctttaataggtttaattagaattaaatcttgtaaaattcatatctaattcatacgaactcagaatgaggtcgttcaagtctcatgattcatctaaattcaagctctacctatttatgaactttaattgtactattcatttgttttttattagtgttttactttgttttgcgttctaggtttagttttccgttgttttggaggatcgttcgttcgttggagaagttcctgaagacgaattgaagatgcttgtttgcaaggcaagtcacacaaatcccaaacacaattcctttgagcatgttgatcctacatttaaattctctatttatttcaattgtgcatttattttcgaatgtcaccgggtggtgagcctttcccatttaattatggccgaagatgactttatttacctatgggttagaatttgattagctagaagcttatatattggtttggttcagctagatgcttataatagattcttagccatgcttagaaaaaatagctcactaatgggataaatcatacttcactatcacttatggatatttaatggaagctcacgatggttaatcgtgattggttaattaattaatatgtcaactaaaacttgataaaggtgggttgtgagcacatggttttgatggtcgtgctcatgacaattaaggaccggttcacgagtttcggttgtgaaacattaaccgtgccaaccacaagccagcatgggcaacggctttaccttttgtatagcatggttcattgcggagcaccagactgagaagtggcagagataagcccacgggggtcgctggggagtccatgccttgtttataagggggtgattatgatccaggaacggtgcactgtggtggattgtgttgtgcgaggggtactgtcacagctcctttccgaggtaccgtggtgatatcgaggcgcatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataatgaaagatgatataactggtaataatttgattagctcctggtttggaatggtacattcctggtttggagatagatctgtacagacgggtatggttgttcaggatggttgggcctgtgcggcatgggtatgttgtatagtgttgattaatattgatgattaattgctctactgttttacaattctcaaatgtttgctaaatgctgcttttgcaaataagccctatattatgccattctttggtatccttgtgcacttgcatatttgctgtgtggcttgctgagtatgtcatatgctcaccttgcaataatcatcaaacctcagttgaagaaaaaggattcagaagaagaagacgtttggcttataccccagttgagctgcctgtgggagtggagctgaagctcgttaggttttatttttccgctgcagctttcttcatggtgaggactaagtgcctcttatgtaagtatttattcgctttagttattgatgaatctgtatattaaattgtcagtttgtgtacctcggctgattcctggacgaggattttatgcacaaatgagttcggaaattactagtgaatttctgggcgtgacaatcagacatgaactgagcaccgatcaactgagtttgctgaattggagtctaaggcctgatcggtatgttctaaatcggctgttgaacaggctgttgaatctgctgctgaattggctgagtgacatcgaacatagacgatatttgctcttgattaacttgaggaatgttgtgaccaacgtgctgaggttgtggtctcatcaggatacgaggtctgaactctggttgtttgtgagctgatgaaatcacagttgaattcggctgagccgatgctggcaccatcgggttaggttgagccgaatttgtccccgtcaagttaatctgaggttgatttggtcccaacgggttcagcagagccgaagtttcccctattggattaggttaagccgatgttgatgcaatcggctatcctgaagtaatcccagaaacaggcagtccatctgtaaccaaggtcctgtaattaggaaacttgtcaccagggaagaacgctggacctctggctcccctttcttcaaacttgcaatccatcatcttctccatcacattgctcatcacattagctaagattcctgactgattgatgagagcatgattaaccgcatagtcaacactgtcttggaaattcttgaactcgaggttggcatcttcttgtttaagtccttctttgccttcttccttgttgcgtccagaagtaccagaaccagaagcttcactgtttgaagggggtgggatttctaccttatgcttctggatcactgttccttgtcgagtcagagcaaaagaatcaaagtatgtgttctgtagcttgctcaaccatgcatcatattaacccctttgctctggtgtcagcatgtcgatggttatcggaatcttgtttgtggaatcaacttcagtcctcttgccatcatcatcagtaggcttgacgtccaccatgatgaaagattgtcacactcgtgtcccaccgggcgtgccaaaagcgtgttgatgcgaaaaacacacactggcctggaagatctgcttaacttcagtgcaggacctaaaatctctctttcgggttcagggcgtgccagttggtttgatcctgcaaccaacaagaaacaaacacagatacaaagttaaatccacaatagccgatcagccacatgccgatgacgtatcatttgtaggttagccaatataacgtgaattatatcggcaatgataaataaagcaaaaggaaagttagatctagtcgatcggctgtagatattagcaatatataatctatagatcgagatacatttaaaccaagtgactagtatggatcggaccaagtgctgagacaacatgaatcacttatgtctaaaagtactttaatataaagattatacgtgctcatagcatagccgatgttgtagacctaacacgtgtcggctaatactccaatacaactttatactaagatatcattatagaccaaatatattgaacaagaattaatcaagtgttaaagtagattaacagattaataataagcctaatatatttaataacagtgagatcttgatataaagggcagatttagcatgttaagtaaacatgaagtaaacaaaacaactaaatcagataagatcggctgaaacccccgatgaaaccctaatcggcaaccgaaagcaggctagagattaaaattctaatcacgacttataaggtcaaacttaactgatgcagctataagtatgaggagaatcacaatatctagaaagtcaagctgttggttgattcatagagtggtagataccctatataatctaagtcaaagttgatatttaacttgatcggctgccttccagtcatagatgttagccgattgaaggttaaataacaatattgccagaaactatataggatatatgataactcaacaaacaatattagagtgtcataaatatggaagcactaatcccgagaacacaagccgccataacaagttttacctcttgtcagagatcgaagccgatgcagcccaactcgaaagcaagaactcgtcgaaaatagaacaaaacgaaagggtggcgatgcgccgaatttgattgaactaagcgttaattgtttacaagggttcgggcttacttttatacctgagatacatgatatgtccctatcggacacgacttcgagccctattacaacttaggatacgaacaagtccctaaggcggactcttaccgactcaaatcataaggaaattacataaaatatcctaactaatagatacaattgcctttccaggactcaaatcgtgtgcagcaatccatatgaagcactttgattcaacccaatgatgtataccgagtcgtattgccaaaattcggctcaatcggctaaccttgttcgactcgaactctgccaatcttgaccgcagccgattcagacttcagccgattcttactctgttttcgaaacagtttatctcttagattctgcttcgattttatccttatctcagatacttggattaccaaatttggtcgttaacacatgccccccaagtccggaatatttggtaatgtttcggatttgccatatcatatctccaagaaaatcgcacattgccatttttccaaccgttaccacacggctttaaatactaaccgacctccccgagaaaattcacaccgttactttgccctcaaccgctcaagcgatttctgtcttctttctctccggcaatcccctcggcgcaaaaagacgatctcaaggcgactccctctccggtcaacttccacccgcggcaatgtcgtcttccgccggtccatccaccgctccatcggctgagtacgcagaggtaagcccttatcggctaaatcccttcttttatgcaatagatcggtttctcttggtctcagtttgccttctcttccctttgctcttcttttgtagcatcttgcaaatctgattgtgatccctagcttgtcccgcgagcatcagtactttctcggtccgattggtaactctcaccgggcagagtttattagtgctgaaatcaataggatcccctacaggatagccaatcctagcctaggccactggaaaaacaccttcaagtcttggccttctctagagaaaagctggcccgcatggtacaagcgcatatcggctagcaagcagagccactgggatgagctgggaatcggccaggctttagccctaaccatagcaaattcggctaaagatgaacccttgatagcttctgcagcctatttctggtccaacacccttaatgcttttatgttcaaccaagggccgatgacccctactctgcttgacatcacaatgataactggcttggacattacctcatcggctaaccacatgaacctgaactccaagaacaaatttgatttcaagactaagagtataggaggatggtcagggttcatttctgctaatatgggccagggatctgttaacccccgagagcacacagcctatctgttagtgtggctagaaaagtatctcttttgtggatccagttgtggccctacttcgaattggcagcacatagccgaggcccttgaagaaaagaagcttgttattaatatattaaaagaaaatatattaagcttgttattaatctgttaatttactttaacacttgattaattcctatttaattatttaatctatattgatatcttagtataaagtggtatcggagtattagccgatatatgttagatctacgacatcggctatgctataagcacgtataatctttatattgaagtacttttagacataagtgatttatactgtctcggaaagctatacgatctattccaatcacttggtttaaacatatttcgatctatagattataaactgctaatatctacagccgatcgactagatttaccctttttcttgctttatatatcattgccgatctaattcacgttacatcggctagcttacaaatgatacgtcatcggcatgcggccgatcggctatcgtttatggatttaactttgtttctgtgtttgtttcttgttggttgcaggatcaaaccaactagcatgccctttcacccagaagcaagatttgttcctgcactagagctaaacagatctctcaagatttttgatggggaaaataaggggctctcaccggcttttataggcggcgaaggcggcggagggagagaagccgatgacagcacggcgcggctttgggagagaggcggcggcgcgtgtcgattttcaaatgggcggcaatggcggctcagtggtcggcgttggctcacagcggcgcgtggcatagctcagtggttggcgatggcttgaacaatgggtggcagcggcagagcaatgggcaacagcagcaatacagcagcggtggcggcatagccgcggcggccacaggatggccatggcggcggtggcggctgttggggtggcacggggtgcccctaggtttggcagtggcggcggcgcgtagcggcgtggcaacggctggtgaaaggagcggcgcggcagggcgatgtggtagcagttgggcggcgtgtggtttggggcgaggcgatggtggctgtcacgccctgaagtttccccctttttcttgctttaaaaatttgttgaataaattgcccaaagaaattgtttaaataaccatgagctaattccctaattaataaatgcattcaataattgtaaatggcatggtgggatttcgactctagaggatccttgggttccacatgtcacaatacattaacagcatttttagtggaattttcaaagccctataaataattttaaccaattaaaatcatgaaagtgcaatattttaaatccaaggaaatcaatttcctctttttcctttttcttcttttctttttcctcctttctctctttttcttcccgcgccctctccctccttaccgggccggcccatttcctcttcccctctcgaagtcaacccggccaccctctcactctcaggcgctgacaggtggggtccacctgtcagtccttcccctacctccagccggttggagctgagctccaaccgccggcgcccccacctccccacgctgcctgccttctctgctccacctcgcgccccgactccgcgccgctcccacgtcgccgcccctcccccgctcctcccgcactcacgcgcacccgagaatgggcgggattcgatttcgaatcccaccccccattctctctctctccgcccccacgtcaccggtgatttcggccacctccttggccacgtccgcctcccccttcacctataaatcgctccccgcgtccccctctctcgtttttcgctctcgccgcgctctcccgtgcctcctaccaccgccgcgccgtgcacccgagctccgccgcccgccgcccacctcctgccgcgcgccgccgccgctagagccaccgccgcgccgcgccatcgccgccgtcgtgctcaccgagtccgcccgcacttcagccgccactcgattgccgcaaaaacccactggagtccccttctcctcgcacgctggtgagtttgtccctcccctccgcctccggtcgtcaatggcatccgctgtggtcattttccctactcgtagctcctctcctcccctcctttaggtatcgccgccgcccatccgcccctccgctcacagggtcatcgtcgccgcctttgccttccgttccggccgccgtgctcgccagtgaggagctcctctcctccctccttccctctgtcccgcacgtgccgccgctctctgcgctcgccatcgccttcggccgccgccgccagcctatgcgccatccgccgccgcttgccgtcgccggcggtcgcacgccgccgccgctccccatggccggccggccggctttatgccgagccgagccatgcctagccccgcccgcgccgtccgatcggccacccggccaatctggaccgtcggtcccgtggaccggcggtggaccacccgcgtggtcccggtccacggtagaccggccgccttgtgccgctgccaagtggggcccaccagccagcgcctccctctcccttgagtcgctgacccatggggcccacctgtcggtgcccccctgatgacgtcagccctgagaatatattgcacaataaataattaaggcatttctttttatagtaaaaacacagagaatcttctaaaaatcataactaattcatccgagctccgtttaagtccattcaagtctcagtaaatcaagaaaaatgcaatgaatccattaaaaatggttttgttttctgtttcagtagtcttatagcatgttttgcttgtgtgctttgtttgtcgcgtagatttcggccgtttcgtcgatctgcggttcctcgaagacgttgctgaggtctcatcagtgcaagagcaaggcaagtcatgcattacaattgatcatattgtacccaatttacaaatatcccgtatttctattaaatgttgcattcttttacaatgtcatgtgggatgggtcctattactcagccatttattgtttaccttatgccattgataacttgggtatcaaaatgactagatgttggtttaggaaaatgcttagccatgcctagttcaactagtacacaaatggggatcacattattacatagactttgactatgagcatagctttggattggtgccaccgcaatggtgttagttaattaaaatacactaaatggtgggctgtgggtgcatggttttgctggtcgcacccatggcaattaaggaccggttcacgggaaaccctgggagacttaccgtgcttgccacaagcgggagtgggtaactgcttgatctgaagtatagctcgaccctttcctaggcaccggtggcgagggtgggagtgatggagttgggtcggtcgaggtgtccggttgtccagctgccggattcaccgcggcgcacgaggggactacccactgccttttgaggggtgggggtgaaaccttagcgtggtgtggatggttaggggcgggttatgcgaagggtcttgtcacgatttcctcctttgcagtgctatggtggtactcggggcatggtgacatgtgtggaatcgtgtcttgtgggtacagttgtgcacctctggccagagtaaaactattcgaatagccgtgcccgtggttatgggtgatcaaccagattcaccgtgattagtctcacccctagtttagcttaatgaactggtgtagttcaggtggtgggttgggcctattgcaacgtggtgtagcgttggacagtgattgggtaatattgcttaatctactgcaattgttttactgttttcaactactgtttttaaatgctagctttatgcaaaagaacctttagcctcttttggttatatcctgcatcataccttctcttccggtatgacttgctgagtacagtgggtagtactcagtcttgctctcttttcccccacaccagagctgaagatcttcctagttggtgatgtcttattgaagttggtttcgtcgctgccgtcaaggattgcctgtggagtggagtcgccccgctgctgaagtcaagcttccaagtttagctcgctttttccttttccgctgcatttgtaatcttttatatttttgtaagacgtggatctgtatgtcagcaattgtcgtttgtgtaccctggctggtcctagacaggggtttaatgcactttcaacttggaaattctggttcgtgaatttctgggcgtgacagtggcgcccgcggtggcgtggtgatggcggcggcacgcccacagtgagagagagcggaggcggctcagttgggctggcttggctttggctaggccgacagcccgagggggagaaggaagtagaaggaaaaagaaaaaggaatgggccaaatgagagggttttatctcaaattgaataggaagtttaaataattttgtgtggagggttttgattggaattcaatgaagataaaaaactaaaggatggatggatgtggactttttaaactttgaacaaagaatttaagtataattttgaagggaatgaaaatgaagagtatttgtttggagactttttgaactttgacaacgaatttgaataggatttctaggaaatagaaactaagggagaagtttgaggacttttagaattttgacaaaaatttaaatatagaaatttttagaatacaaaaggagtttgaaatctttttaaaataaaactaaagatatttattttaaggtataaatttgaaaggataaaataaagatgctccaagtttatagaattcaataagaaccaaatataaaacttgtcacaaaagattttctctaatattttataatttaaaattgaaatagttcacaaatgatttaatttctgactttggatgaatttttgggatggtggcaaaaataaaaggaagggaataaattggactttagcccaagattatgtggtacggatttctgagtgaaacatttgtgggctaaaggaaattggactttctaaggaagcgattggaaatagtgttcttaacacaagagcaatcatttaatatttgtattaatattattcttctgccgaggagaatcaaaccttgggaatcaaattggcggtttgatttatataagaatttggatagtggaacatctagaggagtttgtggaaggtgttgtatgaaggagaaacataaggatttctaaagataggtatagatcaagggtttgatccacaataaattccagcaaaaaggaaattatactggtttagccctaaggataaaaagggttaatgggatataacagaaagttgggccgattagagaaacattggcccaaactaatttgtagacttggaaattttgaataggtaatttagatatggaggattccaaagggagagtatttgttggaggataaatttggatttggagataaatgtaggtggggaattataggaatttttataggaacggatttggtggtagtataataagctctaaaactatgttgactcagagggagattgaaagttgatattttatgtactctagagatatttgggtagagatcaaagggaaagtattaactctgaggaaattgaaaattattgttttatgtactctagggatggttggaaattattatttcatgtactttgaagatagttgagtgggaatcgaaagggtatttgtagatgtggagatgttcgggaatggattcgaaggaaatataatctagagccaaagttatagattaaaataaatggaagggttttgtaaaatttgaaataaacaaaataaggaataaaataaggattttataaaatttagaagagagcatttaactttgcaaataaaatttggatccaaattaaaagatattaaaagaaagcaaggttgctcaacgtaagaattgagaagagcatgacttaaaacatttcgcaaaaaattttcatgaaattttgagtatgttacaatatatattgagtgtgcaatgcaaaatgttgggctcaaccaagatataatgcagaaaagaattttgtggataaattttagtggttattctaaccttataactatcattctatattcgattggtaaactattttgatccctcaaggaatgtccccttgtttgattaaaaatcatctaaatggttatgaaaaattctaaaaaaattgtcaacactcatggaacatacttatacaactccacaaaatcttaagtccaaaatcaactcatatgtcgagatatgaaaaagacaaattcagcgtatgtgttcacttctaaatttgtatttttatctcaatgtgtaggtcaaatttgaacttgatttttggtggaccaatagatatcactatactctacattgttaaccttttcagaatttttcacaactatttatatcgaatttgaaagaaaaaaagtacgtgagaggacatccctggtgggattataatacactcccatattcgattgctaaaacatgtattgtaccaatgtctcttacatgttttattttgaataacaattgccaccgtagcgttagcacaggcatattaatagagactgttcttctctgaaaaaggcaagtacttatcttctgtcaatgtcttgagcgagtgaaacactggtggagaaaccatcttttgtcgatcggccgaattccacaatagtcccggttgcaacaaaaaccgggactaaagatgatctttagtcccggttaaaaagggtaacgggcatatttgatctttagtcctggttggtaacaccaacctctttagtcccggttcaaatgctgtcagggcttgtcaggtccccccgggatctttagtttccggttggtgttaccaatcgggactaaagatcgtaactttagtcccggttggtaacaccaacagggactaaagatcccccctctttatatatgccttcttcctcctccagcccgagagcaagcttcaaaatttcttcaaaaaagaggggaggtcatgccaaaatttatagtgaatttactttggtgattatatacaaatcggaggtgcctaaaaggttagcaacttcatcctccaattttttttggtcatattacatttggagctatgttttgcacactttttttgtctccaaaattttgttgtaagttgatgagagagaaaatttgtgtgggaaaagaaagaatatatagaaattttgtttatttgctaaaaaaggttttataaaatagttgagtaggaaaatatagtgaaagttaatcctaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgaatatttgtgtacgatttttttttcatttcatgtagatggatcggcaatggatgtacgctgaccggcggtccaaagagtttattgatggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatggaagaagatgaagtggaagacgacaatattccagactttgctcagtacgctggatttgaaggaaatcaaacgggcgaggaggatagagatgctgattataacgacattgcggatgatcttggtcagatgttgcaggataccaaggaggactgcgaaagtgaaaagagggcccataaattggacaagatgttagaggaccacagaacatcgttgtactcaggttgcgagtaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactagaagttcagaagattcacgcatgtcctaatgattgtatcctatatcgcggtgaggagtacgagaacctagaagcatgccctgtttgtaaagcactataatacaagattagacgagatgatctaggtgaggttgacgggcagctaacgaagaagagaattcctgctaaggtgatgtggtatttccctataataccacggctaaggcgtttgtttaggaacaaggggaatgctagaatgatgcgttggcacgctgaagaacgtcaataggacgggatgctgagacaccccgcagatggttcgtagtggcgaaacatcgacagaaaatttaaagacttggaaagcacgcacgaaacatatggtttggtttaagtacggatggcatgaatccttttggagagatgaccagtggccatagcacttggcccgttacgatgtgtatctacaacctccccctttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaagaggggtttaacctatgagcgctgctgttcgtaaccatcaacgattggcctgcacttagcaacctatccgggcagtcaaacaagggttacaaggcttgcactgactgtatggatgaaacagaaagtacgtatcttaagcactgtaggaaggttgtgtacacgggtcatcgtcgatttcttgctgcaaaccacctagtacggaagaaaggcaagcactttgaacataaggcggaccaccgtacgaagcctaaacatcacagcgggaaaacagtgtttgctatggtgaaagatcttaaagtagtgtttggaaaggggcctggcagccagcctatagactgcgaagatggtcacgcggcgatgtggaaaaaaaactccatattttgggagttaccctattgggaattcttggacgtccgccacgcgatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaaggaaagtatgtttcaatgcttggagagcatcaaggtaccatctggatactccacgaatataaagcgaataataagcacgaaggagaagaagttcacaaacctaaagtctcatgactgtcacgtgttgatgacacagcttctaccaattataataaggggtatcctcccagacaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataatgatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggttgttgttaaagataagatctttactcccggttgttgttacgaaccgggagtaaagataactctcaccaaccgggagtaaagatctgggggtatatatattcccagtgcgccctcgtcttctctaccaacacttagacgtttttcctccgatcggcttctagctccttcgccgccactgcctaggcatccccgtaccgacaccgccgtcgtctctcgccatcgtctcgcggtcctcgccgcctccgccgccgacgccgccgccgccgcatctctcgggtgagagccgccgctgcctccctctcttttgatctcgatctcgatctctctctctctccaaaccgccaccgcctagctcgttgccgacgccgccgccgacgtagacgcgccgatgccgacccctcctccgcctgccgccgatgccaaccccgacttccacgcagccgccaccgacgacgccgccgcgtccacgcggctgccatagccacagcaccgacgcccccgcctcgagctcgccacgccgccgcgccgccacgccgcgtccacgccgccgcccccgcctcgagctcgccacgccaccgtgccaccacaccgcgcgacgccgccgcgacgccccgccgccaccacgccgccgcgacgccccaccgccaccgcgacacgctgtcgccacggctgcccgaacgtgtacgaggatgtgaccgtggaggatgcgctcacgtggaggatgtggccgtggcagccgtggcgaacgaatgcgaacgaaacgtgaacgaacgcgaacgacgtgaacgacgtgaacgaacgcgaacgaacgtgattgaaacgtgaacgaacgcgaacgaacatgaacgaaacgtgaacgaacgcgaacgaaacgtgaacgaacgcgaatgaacgcgaacgaacgtggctgaaacgtgaacgaacgagagtgttagtgaacgaacgcgaacgaacgtgaatgaaacgtgaacgaacatgattgaaatgtgaacgaacgtgaatgcacttgaactaaaagtgtgagaacgaacgcgagcgaaacatgtacgaacgagataaattaaactattgttgaacttagcatatatatatgattatatatacttgaaaacgtgaaatacattatatgttcctttgcgtttagactaatacatttttttgcatgttgcagagaagacgtcgtcgtcgtcgtccctcaagccgaagtggtagctagccctcaaaggaattcacgcagacaagtgatgtaaagatgtgattgttaaatatataatataagattgttagatttctaatataagattattagattattagagttagcatatgtgagtattagagattattagattattagacttagaatatttgagtgttagagatagttagagatttaatataagattattagaggtttaatatacaaaacttaattagacttagcatatgtgagtgttagagatttaatataagattattagagatgtaatattcgaaacatatttgattgttagaaatttgatataagattattagagatgtacaaatacacgacacttagacatagcatatatgattatttgagttttaatacaagattagtagagtgttaatattacgcttagcaaatatttcttctatgaacagatagctgatcgcgatgaggaacagatactgtacgaaacaatcgtagagggaagcagccagtactggaacgaaaaaaaggggaacgaggatccaaactagtacttgaatgaggaggagaacatggagagggatgaagaggggaacgaggaggggaacgtggagagggatgcggaggggaacgacgaggacgctagtggaagtcatccctccgctggacagaagagggcacgcggacaacaaggtgccgcgaagaagatagagggtcagcacatcataactgaggtggacgcagacggccgacctagtgccccggcaaaagcagcgaagaattttgtacgccacatcggttgggttgtgagggataacgtgcctgtcagcaaggtgtactggcgcagaacaagggcacgcggggataatgacagctttgtcccggaatcagagaaagagatgctatggaccacaatgctcgagacgttcacgctccctgcgggtacggagaacatagtgaaacagtggactcttaagaaaatggcagaagagttccagaccttcaagggagatctgtaccagaaatacatcctgaaggggcagacaccgaacttcgacgtattcccgaagctaagggatcactgggatgagtacattgcttacaagacaggtcaacaagggcaggcgatgatgaaaagaaacaaagaaaataccgccaagaagaagtaccatcaccacttgaggtcaggcggctatagcgtcgcgatgccgaagtgggaggagatggaggcaagcttgcttgagaggggtatcaaaccggccaccgctaaatggcctgatcgatcgaagttctggtactatgctcatggtggaacgctcaacccaattgatggctccttggtctttagcgatcagatacgcgaggctgcgaatcgactaacggacgcagtggaagcctcttctcagggcacattccgacccgacagagagaaggacgagctgtcactcgccctacagactcccgagcatccaagacgaacacgagggaaaggcgtgattccctggaagatgggattcaaggaggacatccacacgtacaggagtcggatgaggagcaagagagataccgaggcgaagattgcagatcttgagtacagggtatcgagctaagagctcagcatgcaagaggaggtggcccggaaggtggatgaacgcatggcagcacatcggtcacacgatccccagccgtacatacctcctccaatggtcagcccatcaggcaatcgtagcagctgcgcctcaacagggcaggtaggatcacatagcatggacgccatgcaaacccaggacgaaaccacctgccccgttgatgagatcacgcaacggacaccatgtgagctgcatattcccttcaagaacttatcaatcaaggtatgctcgatgtaatatatgatttttgactcgtacgttccgcaagttgctgcttaggttgattactaatagataacctctcgtcatgtgaaggtggtgtcaggaatggccatcccaacagacatttcagggacttaccactgtaggccgattccagcaggatactcgatggtcgaagttgagctggtggaagccgtgtacgaggacctcgagttggactacccaggaggagacggtgagacgcatctacgagacacaagccacgccattatactatggcgcaagcggtacatcatcctccctaggcgacaagcggcgtctcgtgcaccatctcctccggctctgccgtctcctcctgcaccatctcctccggttcctccgccacgtcctcctgcaccatctcctccggctcctccgccacctcctcctgcaccatctcctccggctcctctgcctcctccacctccaccgtgtccgcctgcacctcccaagacaaggtctcgccaagctccacctcctgccagcacaagggcaacgaagaaggccaaagttgacaccaccaaaaacaaggagccgccatacggttgcagtcaagaggagcttgacgcttatgtggcaggagaagtgaagaggcaactcaagcctcggagtcctgaaaagaagatagctattgacccgagtgtgaagaatttcttcaagggaatgtccaccacaaacaaggaggccttaaagctatcggattatgaccgaacacttaggaaagcctattacaagaagtccaaaccagttcctcagcttggagaacaaccacaccaagtgttcgagccgttggtgaccggcgaacactttggcataacggatttcatttcggacaccggtctaaccatggctcagttggttggaggcgcaccaatcccgaaggtggaagtggcatacaagtttgaactcggtaaaccgcttgtcaggcctaagcagctgcagtatatacatatatgtgtgtacatatatatgtgtatatatatatatatatatgtatatatatatacatatatatatatatatacacatatgtatatatatatatatgtatgtattctatatacatgcataatatatatattacaatgcatatatatgtattttgtgtgtgtgtgtgtgtgtgtatatatatatatatatatataatcaaccatgcagcaaacagggccatgcaaataaaaaaatggtacatagatctttagttcaggttggtaacaccaaccgggactaaagatggatcagccggccacgtggctgatcgatctttaatcccggttatttcacccgggactaaagatcgctatctttagtcccggattcgtagtttcggttggacaaccgggactaaagggggttacgaaccgggactacaaacgatttctccaccagtgaaagaggaggtcagtaccttgtcccgtgccttccatctagctatagtattttaacttgttaacatcacgattatttcagtagattaatcatgtgcatgcttgaatgtaacattttcctctagagtgcttcatagagatgcacttgatagtgcagtggcaagagatgtgtggttttaaccgtaaggttctgtgttcaatccctaacacactcacaatttcttcttaaaaactatttggaggtacgtctcttcctctatacagtggcgccaggaagcaaatagcgcgactctgagcattcatctctaaacaatgagtaaagaaattacttctatctctgccctaatttgtaaagggagtaaaaaaatcactctcgagtaaaatatttttcacatcacttttgatcagttaatggtcaaatatttttcacatcacatatagttaaaaattaactaacttgttcaatgtcagtcgaaaaaagaacatttgatttacaaaaaaattaaaaaatcatagacatttaatttttcaaaaacataatgaaacagaagaaaaataataataacaagaaaatactaaacgtttatcatagtaaataactcaatatgctaggtcacgtttattatagttgatgaatcacacatagttaaaatttaactgactaaacatgaatatatatggtgcgctatatagtagtaaaaatttaactcgtgaatcaaagtgggtggagtcgggaggggagtggggtggtgtcacgcccagaaattcactagtaatttctgaactaatttgtgcataaaaccctcgtccaggaatcagccgaggtacacaaactgacaatttaatatacaaatccatcaaaataataacgttacatacttacaaaagaaaagaaaactgtagcggaattacggtctagcgaagctccggctccactcccacaggcagctcaactggggtataagccaaatatcttctccttcgcaacttgtcttcaactgaggtttgattgattattgcaaggtgagcatatgacatactcagcaagccacacagcaaatatgcaagtgcacaaggatactaaagaatggcatagtatagggcttatttgcaaaagcagcatttagcaaacatttgagaattgtaaaacagtagagcaattaatcatcaatattaatcaacactgtacaacatacccatgctgcacaggcccaaccatcctgaacaaccatacccggctgcacagatctatctccaaaccaagaatataccattccaaaccaggagctaaattaattagcatcaattaccacattattattaatgaatagtgtgggactaatcacgaaagacattgtttgacccgcccataaccgcgggcacggctattcgaatagttttactctggccaaaggtgtaccactgtacccacaagacacagccccacgacatgtcaccatgtgcctcaataccaccacggtacctcggaaaggagctgtgacagtacccctcgcacaacacaatccaccacaacgcaccgttcctggatcataatcacccccttataaacaaggcatggactccccagcgacccccgtgggcttatctccgccacttctcagtctggtgctccgcaatgaaccatgctatacaaaaggtaaagccgttgcccatggtggcttgtggttggcacggttaatgtttcacaaccgaaactcgtgaaccggtccttaattgtcatgagcacgaccatcaaaaccatgtgctcataacccacctttatcaagttttagttggcatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaacatgctcaaaggaattatgtttgggatctgtgacttgccttgcaataaagggtcttcaattaatcttcttgaatacttccgacgcactcacgaaccttcgaaacgacggaaacgacaagctaacatgcaaaacgaggaaaaagactaagaaactccaaataaacagtacatataaagtaaacaaacatgtagatcatgattttagatgaatttagagacttgaacgacctcattccgatttcatatgaattaattacaaattttacaagattaaattccaattaaacctattaaagaaaagactattccaaattaattaaacaatttacaaatgatttataattgagagaaaagattaaagcaacctccggaaaagattagattatattggtagatgacatatgataaaaagaaccaatatgccattggaaagagaggaaaggatttatatggctgagattaatcttgaccgagtcgaccaagatcggatggcttagattgatctggcaagcaggcctcacgggataccaactcaacgagtcaattctacgtgacacgggatcacccaaatgatcaaccgaaaccggcgaacggaaccggcggctctgaactaaaggacgactcaacacggacgaacgaacgaagcacggggaacaccttattcgaacgaacgagcgaacgattcaacaacggctgcaactaaaccggtcggctagaaacgattcacggtaaagccccggtacgacaaacgatagaccggtaggaatttagggatacacctacggctagacaacttggctaccgagcaacggctaaagcggcggctaggttaaagcggcacacagctgcgacatggcggcactagggcgacttggtttggctaggcggctagcacaacggcggcaacaagcaacaacggcacaaccggtagtgacggtgcacagggcagccggcaagtgacgcggcagcggctgcgctagggttagagcaacagcggcggcgacatgaccgagggattgaaacctaacccgaggggacacggatagaagtctcaccgaaccaaagcgatcggagatagatgacgacggtgaaccggcggcaacacatggagacgacgacgatgctagacagacaatggattagattgaattaagaccctagggataaagtacaccggtgaacgacataggagcggcggttgccgacgaaataatgcaaacggagggcaccgggagaaagaggagatcaaagtgaccctagccaccacttatgcgacgacgaacggcaacggaagatggccggcgacgagctttgaagggcggcgaggtactggccacggaggcgacgactttccggcgatgtgcggcgacaacggaggggtggccgggcttcacttcgcagctgcgaatccaatggaggcagcggcgaagcttggcgatgacgggaggagcagcagggcttcgccggagatcaaaacgcgacggcgaacttcgggttgacggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagggctcgacgttgcggagccgagggaggaggcggcgctgaccggcgacggccggggcgacggcgaatggcggctggagtggcggccggaggtggagagagagggagctcgcggggagagcgtttccggcgacggcggcggacgggacttgaggggatgaggagaggacgactagggggtcctttatataggcacgggagctcgggtccgggcccaaatcgacgagaaaaaaaatcgggaaagtctagggttttcgccggtaaaaggaaggatttgatctgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctagaggtagaagaaggagcactgtagccacagggaggaaaaacagacttctatgtgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatccagatcatttaatgataaatttattatttaaataattgctaaactgttctttgtattattaaaattaggaattgagctctgaaaaatctgagaaaattccagagagtataactaatcatggagaatttaataaaaattaaatccatccatgctttatatttaggaaattttatttcccacatttaacttcacttgtaaattaatgaacatttaatataaattctattaataatttattaaatgatttataaatccttaaacgaaaatcaggctgccacaggtggtgggcagtgggtgggtctggtcactatgtcaggtgccgtttaatacgtagacgtttaaattttgcaaaaacattatgaaacagaataataataataataataataataatattaataataataataataataataataataataataataataataataataataataataataataataataataacaaaaaaaaattaaggcatgagcaaaaaaaagtttcctttagttaataaataactcaatatgctaagtcatgttcattatagttgctgaatcacacagttaaaatttaactgactcaacgtgaatatatatggtgggctatgtagtagtaaaaatttaactcgcaaatcaaagtgggtggagttaggaggggagtggggtggtgggcagtgggtgggtctggtcactatatcaggtgccgtttaatccatggcacgccacccagccccacccgctgtgcaaccataatccacagttaaaatttaactcacgacgccccacacatgcgccactcctccacacccataatctgactaaaattttaagttgatattcccaacttttagcatatatatacatgtgttgttcccccaccctgcaaccaaccacatactgatcctatttttccagacatgagagaggcgactgagggcgcgacgtcggcgggagggagacgcggcggctccacctccactgccgagcgacggcgggcacggcatcggcggatccagcatggcatggcacggctacaggcgtggcggcgacgggcgatggcgtgagggaggtgaggaggcggcgtatccggccaccgctccgtgccccacgcatgtggatccggccgcggtcgggcgaatccgccgctgatctggcactgggaggctagcgtagcgtcggcggatccggcacggcacggctgcgggcgaggcggtgacgggcaacgatgagcgggaggcgaggatgcggtgcgacggcggatccggcactgatcctgcacggggagacgcggcggctccacctccaccaccgagctgcggctggcgcggtgtcagcagatccggcgcggcatggctgcgggcgaggctgtgatgggcgacggcgagcgggaggcgaggatgcggcgcatctggccgctgctccacaccccacgcgcgcggatccagccgcggtggggcatagccggcgcggctgtgacgggcgactggggcgggaggcgaggcggtgatggatccggcctccacgccgcctccatgcgcacggcggcgacctccgtggtggcgagctcggactccgatggataggcaagaccagtggtgccacctccacgacacgccgccgtcgatgtccggagcaagtgtaaacaaaattttaacttttgctcataaattgtgaggatgtatatgttgagtaaaacttttattgtcataccaagttaattttttacttagtaaggataccaagttaattttttacttagcccgccctccaatgtttttaaccttattcagctgcatcccgtgtaaaatacggttttgtaatgaatacgtgaaaacttatacgtgttgggatgtattttttgataacaacaaattacaaaacaatgcgaacaatcctctgaattaaagaaaaatgtcaactctacaacgatatcatcgcaccctaccacacaactgtatctcggttaaattttaactccgcgagacgggttggttgtctcggtcatggggtgtcacgagttaatttttaactcagcagtgaccaggttcaatcacatatcgttcaaaattcaacaacaactaaatttttaactccaaaaccatgtcatcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtgtcgtgccgtgtagcgcgaccgtgtctataaatatatatatatatatatatatatatatatatatatatatatatatatatatatatatatatatatatatatatatatatatatatatatatatatatgtatatatatgtatatatgtatatatatatatatatcagggttatggataccacatatctaatagtagttgattgaatcttgacaggacccaccacttgatgaaaccatgagcacttgagcaggagcatgaagtcacatggaatttcttctttaaaaatgcatggagggacacctctccctccaaatctccttttttttcctagagtgcttcatatatgctatatatatacatcacttgatgaaatgatgagcacttgagcgggagcttgaagtcacatggtttgtctttttttttccgcacttgtgacagcatgaacctaagcttaatctatgtttttttaatgtactgatgtacaagcacaaaagattacagatgggaggcttgtgggtcagctgctgaacctgaacaatggccccaagctcctgaaccaactgaaactcaacagatgcagcccattgggatctattcctcaacaaagcgagctgttcactgatcttcgttcgctcgtgatttggtgttgcagctgggactccttaccagataacatggagcgtctcaagtcactcgagaaactagagctatttctttgccctcaaatcttgctgcttccagtgctacccctgtctcttaagacgtttcgactttatcgctgcagcgacgtgctcacgagttcgtgccaaacaattggttatgaaaactggcaaaagatcaagcacattccaaacaagcatttataagcatccatacatgttcaatgtaaagtccatgtgtgctcctccatttcttttttttttatttgaaaagttatgctctacggtgattatactgttactcatgttgattctgttttgttgatcaggaagtaattaagcctgtcaaatatactaaatgctgggggcggatcatggtgtgcacatgcacgccaatgcacggcatttggaacacagccagagaagaggacgttaagcatggtggctgagatcagtaagccaaaataaaactggcatggccagattgtgaatttgtgatctttggattatttcttgctaatttcagtataataccgtacattctgtgtttattcattcatttacctgtttcatgtttctcttattattccttgtgttggtcaagcgcatggccgggcttgtcggtgcagcgccctttgtgtttgtggtgttcctcatgcgtgggatgcatggcccgcgtcgcggaggatcatgttgcatttccacagatttcctgttcttgcttgctgttaaataagagaagaaaaactaagaaaagctgcacagttctggtagcacaaaacattttgttcaagtgtttgtctaagtgcttgcttaagtacaggagcgtctcccgtcagattgataattactacctccatattttaatatataacaccgttgactttttatccaacgtttgaccattcgtcttattcaaaaaatttatgtaattatcatttattttattgtgatttgattcatcatcaaatgttctttaagcatgacataaatattttcatgtttgcaaaaaaaattgaataaaatgaatgatcaaacgttggttaaaaagataacggcgtaatatattaaaatacggagggagtatattttctctttacatgtgacttaaaaatatgtgcagtaaaaacgcgtacgaaacgtacaatattttcacattaccaagaacacatgcgtgttttctccctaacatatttaattacatgaaattattggaagcacaccggatgcgttcaaatggtcgatagatatttcttcattcattcatgagggcgtcgggccgtcgcctcgcggagccatgcggagactccggacaaaagacttgtggagtcattggtcaacggcacgtcctgttgatctgttgatcgtgccgttgaccaatatgttttgtgatcgttatttttgacgcatcattttttgtcgctgttgatgatatatagaggactatatacaaaatatatataaagactcgaatatcctcgacgcatcgctgttgatgataaagaaaatctcaaatatagacgacaaagacttgactacttgagtacgtaggtactcagtcatcggcacaatcgagatgcatggataaaaatttaaaagcgcgagtcaaaacttgttctgagtctctcactccctgcagtatgatatatttttcaatgtcttcacgcgggcccttggtacaattttatcgttggtattagatcttcgatagaggaccgtaaaatcgatcataactgaagcgtgtggagttgtgggtgcgtaagtattccataacacacgcgtacatattccctgaattcccgtatgttcgtttctaacccatgctcacatagacggttcatgtttgccgtcatcaccataatttttgaaagcatgtccatgtgtgtctaatatttatgcacactaaaaaaatagcccgcgcattcgtggtggacatgcgtattagtttgtttcgaaaatagttctaacaaaacaaattatttaaggtaaggtatttttgatttttttaattgagtgttcattatatcttttttccttgaataaatctcgacaaacttttattgtttttgttggtaagaaatgtattttttaccaccctactaattatatctttaattgcttcacatatatgcaaattcgttatgcatgtgaaccaataaagatagaaaagttctttaaaaaatatttattgtattttgaatttagtgattgagtgattctaatttcgaatttatattcaaatcaaattattgttttattctaaattgtatttttaggaatttgaaattgtacttaatctcgtaacgtgttgtatttggactcttctaattttaatacttattttattattccaaatttaagatatttataacttatacttttatatagactcttgatattttatattctacatagtatcttgttatgttttttagttttaatttttattttatttttaatgcgtttttaatcaaattgcttgttttaatttttttctgaatttaattacaaactccttgtagtaatccagctgtcaccatcggcctcgcggatcatcttgtcggccttctcattagtgagcctctcttgatgtattggacatgatgtggcaaggctcggcggtagagatggaaccattttctagtctttgtcaaagacgtggaacgtctccctctgcctctcctctcagtccttgcccttcacctaatcatctagtacgctgttagacctaggaactcgtggaagtcattgatgtcactgtcgtcggtgtccatctctccatcagtttcaagcccaaggcatgcatcatggttccaagctccttggtggtgattgaacatggattttagactcacatatttcatcgctttcgaagtgctattatgctcaaatatttgttgtcagaatgaccgcactatctaacttctatatagcaaaatatgggtaatatggatcttggattatgtatttacttataaataacacaacaaatcaaataattgagaaaagtacatttaacttgagagtcatgattatttagctattcttttatatattatgtgttagctaatagtatcctagaggtgagtaggagagtggagggagtacgtacgtacgtgcgtgcatgctcacataggtatttgctcagacttttaaaaaacacacacacatatacaatatctactcagggtgcggtataattaaaacacatctaatgttagtaatcattttattgagagtggaatcatcataaatcttcatattaaatctaacagttttactatcaaatatttaagaacatataacgtgtagtaaaacatttcttttcttttggactaagcatttcataaattattagaatactggaaatttaaaagttaggccaatgttatccaatatactataaacaacttcaagggtcgtttatatttttttcattgcaatggaaaacctatatgcacatatacatgtgcgtaattttacacacttcttggagcatttacttttaaatcaacaataatatagatataatgtttaaccccctaactatattttggttgtcattttttttggcctgtcagccttgagtaaacaggcacgtaatatgttagaatcaaatgagctagacccaatttaatcctaataaattttatagacctacaattaatgttaacaagattaataccatcttgaaaaccaacgagaaagaacctcaacttaaatatgctgctatatgagagcacttgttgagcgattgaggtggtggtgagacttccacacacgcgctgggctagtccatgagcgagggtgaggcgtgaccagcgggcgtatggggacttgcctgcctccctaatgctaccttttgttttgatgaacaaaggcataaccgacgggtgacattacttgaagtattggacgataacttaatgcgcacacaacgttatctccgacgggtgacattacttcaagtattggacgagacctcaatgcgcacgcaacgttatctcccctactagcatgtacaaaaacctctcttgattctaagcactttgagcacacgagtgttcaggacaaggttatcttccccattgggaaagacataaacctctctcggttctaagcacttgcgcgcacaagtatttgggacgagcaggcttccagaactccattcgcttgagtacgtacacaggttagacgagcgatcaagtttttgaggagcacgttcttcacacggctgctctcggcactgcatctccttccactacatcaacatgtcgcccgtaacctgaatggcagcaacggaggtggaggcgagaatgacaatgacaacggcaatgaaggcaacaacaccaaccatgcctcatccagtaccagaacatacactctctgggtatatcactctattcaccttagtattaaacatgttgctagatgatgctattactgttattagcacgttcatgtttacatacaactgaatcatcctattatatacatgttttgcttattatgtttttttgattaaaatataccgaatcgtaactatatttccaatgtatagtaacatactggtatatatttcacactaccaaacaatgaaacacgcatgggtgttttctctgaacataaccaattaatcattgaaacaccggatgcgctaagaaaaccagccgcccacagctaagccaaaatgctggagatgtcattgttccaaattgacaattttgcctactaagcacgtgggccctgcaaagactctggacagaagactttagatcaagtcaatcaacggtgatggattcatgtctccggtctccctagagggatttactcaagtagtctaaaaagttataaaaattaaaaaaaaaagtagtaatagaaaattagtaagatcacgacgagactacggatcatgcaccctattctttttttttctaaaaaaccgggcgcccatctctagctagtaaacctgcacttcactccctgtcaactgtccacttgtacgcattccattccctgggatggctgagcactactttttttttatctgacacgcatgcaaaccgtatactcccttcgtcctatagagaaccaatctattattggatttaatattttctactacaatgaatttggacaggagctaaacaaatctggacttgttcctgtccagattcgttgcactagaaaatatctcatctaatattaggctggtttttttgaactgaggaagcatatgtgtctttttagtcgcatgcaataacattcaaaatgattgttattttaaactattcatccaatctaaagatctaattcaaccattgtatttatcgcaagtaaatttttataacaatatctcgcatgactattttctgataaaaatattattttatatttttagcaaaggttctgttttttatgttgcacatcatattctttatatatttcgatacgtacttcctgatgtttcactaggacgtttgcagttgttgcatgtgatgttctaggtgttttatagtaagcattttgtgatatttcctacaattaaattttccaataaatttaagtatttgaatacatataatatgttccttatgaattctttttaagtttcattagttgggattcaatgttaatttcctgcggtgctttttgtggttgttgcagtatgacgtcatgaggcatttttcacccttctctgttggttgtaggagcgagaggctttggcaaccggccgcaatatgcctatttcaccgggtgccaatcccatctatgtcttggatgagatcacctaagatttcataattggaagtaaaacaggccaagagcatgcggtaggcgccggtagggggtttggtggcgatccaacacatgtacttttttttactagaaaaaatgtccgtgcatatttaacaacaggtgaagattattttatttgtattgttgttatacggtctagttaagatgaaattcacttagatatatatttttttagaaaatcataagctgcaattagaagtccgatcgtcttagcatgcaagtctttttaaaaagaattcttatatgactctttctatattttcaaaagcgaacgaacttaaaaaccgacttaaatacggatatgtatttctaaaaacgatcgaacttaaaaaccgactcatacacgaatgacttattaaagtaccggcaaaaatatttttaatttttataacagtagagatagaaatagagatggagatagagatagagacacgtaacagtacgtaaaaattagagattaggtgggatatgatttggcttttttaatctaatccaattagaggatttgccggttatacctttttttgacatgcaatacgtacatatgcgaattacgtacttacgtgttagagataggagggtgtgattagccgggatgaccatgaggagtgattagtaggattttttaaattctaatccaatggtcatctattgatttactgaaaaatccagggatatgtactttttttgtcaaaatttttagaatttctaggctttgtatttttagaaaagatagatctaatggtctaatacatatttaagtgaaaatcgatgaacaaataattttattaaaaattacgtgaaaaaaaaggtaggtcaatatttgtacattcgttcctacttaacagaaggaaagatgagactatgtaaggaaggagtttggttcggttttttttgagaaatctaatctaatatagtttataatattagacccataaatttaagtgaaaatcgaggggtatatgttttgtttttttctcagagtttctatatatgtttttctttaatttattagagtgccaagtgatggcttgagattgttttgagaaagtttgatagactttataatagatagactaagatgcatgggtgttaccgcactctacacacacagtattgccccgtttttaaatatacgcactagttgagtctatgtacttttaaccattcatcctaattaaaatttataatacaaatataaaaaagtagaagttgtgcttaaagaacctttaaagataaaataagtcataataaaatatattgtatttatactaaatttctgaataacatgattgatcaaacgtatgtctaaaagttagctgtattactctctccgtttcaaaatgtttgacaccgttaatttttcagtacgtgtttgaccattcgtcttattaaaaaaattaagtaattatttattcttttcatattatttgattcattgttaaatatacttttatgtacacatatagttttacatatttaacaaattttttttaaataagacgaacggtcaaacatgtgctaaaaagtcaacggtgtgaaatattttgaaacggagggagtaaaagttacaagcactttaacacatacatagaagatacactgcactttaacacaatagagaactatagagcataaagcttggcaccggatgtacgtagtaaaggctattggtgctcatacgttttgagctggaccagtgggtcgctccaagatgccaccatgtgcaagcaaagcccagagatgtgtgatgaactctcctccccttggcagggtttccaggtgcgctttggcatcattcgaaggtgcaatgtacagcatcatctctgcccagaaatcacacagcaccttccatctgtcccccgggtgttcgatctcgatgagattgtttgcgagccgaccgcccacaacgaggagacggttgtcgccatggtcctggcttcttagcgcttccttccgctgctgcattgttttcttacccttcagcaattcgcgggcttcctcgaccagggcgtcaaatatggattcggagacgaagctatgatccggtaacaattccggagcaaaggctactaggtaggcacagtaccttgacaagctacaagctacgtgctgattagtagtagtagtagtactgtctattccatgttgatcttcgtcttccacctcgcaaagagtagtggcgatgtgccaagccattatgatatgtgttgtagttgggagtgtggtgcatgaccatgaaagttggtagtatacctcgttagcgtgcagagatatgacacagtttcccagttggccaaggcctctattcttcttcagggtttctataacggttttctttacatccatggataatctgacacgcttatcttccttgcggcccttcttggtcttattgaccaaggagaaggtagcatggtacagtatgttcatcgatttgtagtcaaaacttttgagcagtgtgtactgaccgagtttatcttcccagctccggaagtacctgaggctcgtgatgcatccaatcaacttggagaacaatacgctactgttccatgaatctgtggtaacatatttcgatatcatggctactttgctccaggccgaggccaggtatatgtacacctgtaaaccctcaagcagagcgattgcgatcgctgtcacggaggtgaagagagcgtcgtagttcctgtggttagcattgacgaggaatttgagctcatcttcatcgggtacccggaggaaatgctggaacagcttgtaggcaagccaaccgcaggtcgggaccatggcaaaagacaacgtgacgaacagatggtgactgctatagataaggaagtacttggtgtagaagtagtcgtgcacaaaggctaattctacctcgatgaccctgaaggttcgttcgacgcacctgtcgccatggagcaggccaccgaagaggaagtcgcgggtcttgtggagatttgattcggcgagcacctgaaagccggcaaacctgcggttcagcatcttggacaaggccatggagaggcacacgtccttgagcctgccgccattgccaccggagagcagactcccattgcagttccagatatcttgaacggtaacgagctttgcccggtcatcgtcgttgtacctaagatggtactcgggaggctccaccctaggattctgctcgtcctctcctgcaaccacatagtggtacccttgcatgtcgacggcgtctcgtcgttggaccccgtcgccggcaggtcgcaggtgctcgtagctcatgtagtctgccacccatttggtactcttggagagcatggagcttctactggctagcttgaacgacgcgacccgtgtgccggatttcaatatgactatgcagtatatgacccatagaatgtactggaaatccgagccaccagaggaaaccaccagccaacccacccagaaagactcgatgagctgcttcaagtagaacctcttccagtcgtcgttgtctagtaggctataagcagagaaagaatcggcgctgccgaggaagatgaagaggatgatggcccagacggagaagaggctgttcttgtaaggggacgactgcatcagccccagggtgtagctcaccatggggatggaagcagcgtacgccacccagatggtcattttgacagcttcacagctggaccgccggcggtaggagccgaggatgaggagcacaaacagcccgacgacgcccaggaacacgagaacctcgatgcggatcaatcgcaactttgggctgttgagcccgtgaaccatatcgacgagtgccatatatacgtaaatatgctatctaggcctaggtgttggtgtactggttaatatataggcagcagttgcacgaaggatgatagccctaccagctgctgctaggtagctagctaggtcatcgataattatacactttatccaaccatcccccctgccttgtccagaccatctgacggtcggacccacttacacataacaactccacttacaatttcatttttattttcattctcgtttcgtacaaaagggttaatatagttgaagggacaagctcttataagttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcgatggcctccattcccacacacgtaagtaacacatcgcgtaaagcggatacaacacaaattcaatagatacaaaatctaattggacaattcatatgatatttcacactattgataatatattataaaaaataatgatcaaattataaagtttgtttaaaacttagacaaagtataatattggagactatgcagacacatattgtcacgccccgaactagccccgagcggaactagcccgtgacgctccaaattaacctgttaatcgataccagtcccaggaaacagtgctggtatcacaggaagacagaatatcacagcaacagatgtctctttattatagagtaggagtatagtcatgttgggctgcggacagatcccgagctcacaactgcattacaaaagggaagcagaagccaagacttggaccaaacatcacaggcgcgacttgggaactaggccgaaaccctaaaactcatcgtagccgacttgctcctagaagaactcctcgtcagcgggatccgcttcatcttcttcagcaactagggaggattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcgcgcgcgcgggcggggaggagagagagagagccggtgggccgggtccaccttgcgtggtcccgggtaggacccgcttgtcagcggctcggcttaccatgtggagggagtacgcggcgcggcgctagggtgtggagcggggcgcggtgcatgcgcgtggctcgcgggggtgcggatgcagcgggcccacgcgcagcctcacggctcgcggtggaccgcgcgcgcgagcggggcggagggaagcggcggaccggggtcagcttgacccggtcgcggccgaggtggcgccgacgtggcgcctacgtggctgccacgcgggccggcgggaggtagatgacgacgtcggccggaacggacggcggacggcggcagcgagcggcggagcgaaccacggcgatacaggcaaaagcgagcacaccgggaggttgcacgggacgaggggagacgagccaatgactcggattcgccgggggttgctcgactgcggtggattgcggcggcggcaaccggcggcgagagaaggggggaaacggcgacggcgcgacgggagaccaattcgggcaagctagagcatctacgcgactccgggaatccgttgctagcgtcggattgggcggagctacgccgagcgaggccggcgacgagcggcgctacggagcataggcggcgacggcggcgagcacacagcgagcggcggcgagcacacagcgagtctaaggggaggagatggaacgaggagggaaaacagagggaggcgagcacacaacggtcggggcggcgccagctagctacggggaggctactcgtgctactacccgagtctaaggggaggagatggaacgaggagggagaacggagggaggcactaccgtgcggggtgatggggagcagtgacgaggggccgatggcacgggagtgatctctccggcctcgggccggggaagaggaagaagacgagcacccggagtccccttccgcgtcctagcgcgcaccggctcctccggcacacgcgacggcggcggtcggcgagagagacagagggacggcaatggcgcgggcgaaaaacggggaagattgggagggaaaaagggaagggagggcgcctgggtttatagggcggcaatgtcggtttggaaaccgaccttgggcggtcaaggcgcgagctggcgctcggcgctcgcggccaaaacggcgacagaggcggatgacgccgacggggaagagggagagagggagagagggaaaaaggaagggagaaagggggcttgccccttgcctctttgggaaaagaatgagggagagagggcgatgaggaggagccctgcctcctttccttggaagcacgcgcggggagaggcggggccgagtcgatgacgacggcgatgacggcgggggcggtttggaacggagcggcgacacgggcggcaggcgcgggctcaggcgcggcaggcgctgacggcggcggcgtctggccggtcggccaccatggcgcgcgcgcgcgggaagcaacgggcggcgccgcgatttcgcgggcggggagctcgcggggatggaggcggggagagggagagcgagggggaggcgctcggcgcggctcacgggcagagcggggagagagggagagagagagagagagagagatgaagagagatgggccgagaggaattcggcccatcgaacctgagggaggcaaaacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattccatataaaacttggtatatggtgggccccgctaagctcaacctaaggctattgggtttgccttatccataacactggcagtacctacatagttcatcctcacgtagttaatatttttttctcttgtttcattaagccatatcacatcaattgtttttagtgcttaaatgattaatctatggtccaaattatctctctcattttcttctctcattagtccatattacctcaattatctttaccctttagatgattaatctatggtccaaactatctcaatacttttcttctttcataaagtcatatcaccttacttttacatttgaatcatcattctatttactatttaaatttaatttatcataaacctcattaacttacgtaattgttaacggaattttgcatctgattcggagaaggaagaagatcgatcggcgaagaagatggcgaagccggcgtgcacgctgatggcgagggaggccgagaacggcatccatgatccaatgaaaggtaggcatcgtaccttctgttgtttttctgttcgcttttcctttagatcaaaagcgatgggtttccttctttcacttcgcgatgtacttcgcgagagcgaaagtgctcataacgtgttgaaagtggataagattgattgagcgagagaaagaattgaatacaatagagcgaaaaacaatcgttaattaatttatattaattaagttagatgaccagataaaaaaagaaaagtgtgtgcatgcatagagggtatcgaactttggagttcgatagcgtgtcaaacaaccgtagagttcgattgggttgtttattagataaaataattcgaagtgcatacatgcatttgcatgcaggtcctatcgaccaatgtctgtcgataggtcctgcacacccacatgcaacaacaggccatttactggtctatgcgcatgcattgtacttttaatattttttcaccataccaatccctatcgaacatacatattgaacagtgtttgtttgatatgtacctaatagaacatcagtagcaaaagtgggaccagcggaggggcctgtcaggtgatgaaagggagccattgtaggtggggccgatggagaagtaaagaaagagagataagaggaagagagagaatgacatgtgggcctcacaggatgactcagcgggatagaataggtcaaagcgttacgtaagtgaaatcgtgttttacatggctactgtgtgtaattctttttcttgcaaaagattcgcctatgcaggtgtccaatcggatgttacatgtatataacgtgattttttttctaaaaagaaaaagaaagagtccttatctacttcaaattctcatattttttattttattttatttcaattaatatgagaatttatagaccttgagagctacagtggagacttttttttctattactttattaagttaattaattaataggtttatgcatctcataggaagacatgagccatcgagcccattagccttctgttttccgcaacgattgatacttctcgcaagtttcttcttgaagatgacgtcatgacggcgaatatattccagcgataatcagctgcggttaatttgttctggcaggtcggcaccttggccttcagtagttcagtgtccgagggagattccaaaaccaagttgatcacggtggaattacggacgatgatgagctactagctcttgattgttttctgctttgtattagtggatacttttgctgatatactacgcgaaagctgtcaactttgacgccggatttctcaagtagcttagcatggaactggacaacgttttgtctcaaggtgctgagatactaaacatctggacagaaaaataaatgactactagtgacatgaacatttaaaaattgcaacttcccattcacaaggcaacatgccaattgtaaattgatgtttgacaattggtttgctaaagaattcgagttggcgatggcacttcaagttgggacaactctgtccttataaaactgatcatcgagactgtaccgttatatgaacaagtatgttttttcccccattgactacaactcatttgagtctgcaagtcaaatactgctgtgagcaatcaagaatctgcattctaccctcctgttatgaacttttttagattgtaaagactctttcctgcccaaaaacgattccattagttgagatgctcttacactcatatattaaattccttacccttccataactaattttgaactattcaacaatatcctcttcatacattggtgctccccagccattcattgccccttcacagtacactgatggtccctcgagtcatcaatctgaatgtaagtatcctcctcctcacggccaccgaagagctccgccataaaaatcgacgatcgtgcggcgagcacgtccgctggcgaggaggtcgcggagatgccggtgcaagtccggtggtggcaccaccacggacgacgatgacgccgcctcgcgacggcggtggagggcactcagtaaccacggcgatgtcacacctgataccatagccctaacgttatttgtagccatggacaattaaaggagaaaggtcaccggcgacgatgggggaattttcatgcggaccatgtggccgctcccgtcgggtatactgaacacgtattctgcggtgacgacgtcggcggcgtcggccggtcgaggtagaggaagacagatacccagtcggcgaactcccggcgatcgccgtcgggtagtaggcgacgtatatatataccaggtgtccaggtgtcacccctccgtcgtggaacttacaggagttgatgctcttgccgacgccgatccctttggttctactgtagccggcgacctggatggtgactgacccggtttccattgctctcttgctgtcgatggccgacgacgacgtggttttgccgccgtcgccggtggcagacttggaagttgtgagacccattagattttcaatcaactttgctatacgtccgacgcatgtgtccgacgcttgtacgactgaaacagtggaaaaacgagcaatgacggcgtcagatatgactacgggtcgctgggcctcgttgttgtttgcttgcgtactgggctttctgtacactggggccagtctggctgagaacatgtatcagcttaggttgctattaaaatgattcactccagatgttagattagtttagacctttaggatgtgaaaccaatatattctcacagccataacatgcaagtcctctaaaaaaagccataacatacaagtaaaaaatgattgaccagacctgtgaaaagcaacgcaccacggcttcaatttccatattcatggccaaaatcagttcattaaacagaatacaggtagagtgacattcaaaatacaggtagagtgacatccaaaatcacaagcatactgtctaacattgaataataataaactagcaaatgttgtttagttcgtcgattgagatcacaagtaatgcaagcaaaaaatcattctctctttcatccattcatatgctgggatagaagctccgtcaaatcaccatttccctgcaaaagtaaaaggaacagagcaacaagttaggggaaagtactatgcactgatatatactagaaggcaacaatgaaaattagcacctgaagaagatccatgtaagaactaatgtgagatggtggtgccgggtgatttgattggagtccctgtacaacaatattgtcaaatcaattacagcaatgcaaaattatgtatggcaaatcagtcacacaaattacctgaaactcatttgcagcaaactctgcactgcctgcctcatatgctccaccatagcaatgatcaaaatttacctaataatgaagtgcatatattcagaaacgatagagagatgaaatatttcaagtacttaatactactgaatagaatatgctgtacacattttaataaatatattacctccatttgtctagagttctgaatattgataagctgtttatcttttgatataacatttttggtccttgtctttctccttcttcgactttgtacttcaattgtagattcttgttgcttcttcattctcaatctccttaccacttgatccaattttgattgttttctcagtgaaggaggacgacctcttctacgaactgatattgggcttagcaccatttttccttgtttcagcaccatatctttattcttcccattttgctgatattcctgaatttccttgctgccatggtgtgcatcaatctttatttgcaattcatttaggccatccatcactaaattgcacaatgcatctgaaactgaaccattctctgccacttcattaaaacgcttgcacaacgtatcaaaacgcctaacaattggcgtgtcaagctgatcatcataggagcatttaataaatgtgtgcttgcgcttgaaatcctttctccatcgttgtagtatatatttggaagggactttttctatatcaacaagagggagtattgaaaggatatgtctacacaagatccctcggaattcgaaatgccgacattcacaatgcaagtcacaatcctcttggttgaacaaaacaagtaactctgaaacaaccctttgctctccaatttttcggtcctctctgacactgaaagtatgaaccaacccttctgtcttccgaagagttgcatagtagtagattttgcctcttagctcatcctgaaactctttaaacttcttgttggtatatgccacctgaaattgcctctcaaattcatagtgagtaatgcaaggaattgcctcttggaatgatttacaatcagacttgttttctttctctactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgcc

SEQ ID NO: 74762 - DNA, 4228 bp, Oryza sativa
gcacagatataaacgaagtggaaggctccagagtcgaacaaaattgtagcagggatggaatggatgagaaccgtaccaacgatgacgtctggagttgtcagcacgtcctcggccgtcacgtggttcacacgaccccgaatgacatccttgccaccgttgttggggcggggaggcgcttggccttgctgacgccttggcttcgggcatttatccgcaaagtgcccgggctcgaagcagttgaagcacagacgctgctgaccttgagcgtccctgcggacttgaacaggctgcacagttggcgtaggaggacggggtgcacgagtccctggttgattctgctgctgctgcggctgtgggacgcgcaccacgaattgaggtcggggcgcggagcgagattgctgctgctgttgttgctgctgtgaggaggatccccctgggtagggattggtgtagcggaccctttgattagcaccctgttgattgcggaagttcgccaagcggcgcttgtgcgactccagctccttgtgcttggcctccaagcggatgctcttgtccaccagacgttggaagtccgggtagtccccagagactagacgaacggacagctcagggtccattcccgccagaaacttctcttgcttctcctcatcttcccgcacatcctccggagcgtaccgggccagattgttgaactcatgcaaatactccatcacggagcggttgccttgcttcaactctcggaactccctcttcttaagagccacgactccggcgggcacatgggttctccggaaagcggcggtgaagcgagcccaagtaatcggttgcccttctggctgcgtagcctggaagtggtcccaccataaagatgcgggcccctgcagctggtgggcggcaaagatgactttctcttcatcactgcactgcacagtgtccagcttcttccccacggcatgcaaccaatccaacgcatccatggggttgttggagctcgagaaggtaggtgggcggatgcggaggaactcggcgagtttagagtgttgtggaggtggtggtggagcattctgttgtggcggattttggaggtggtggaggaaagcagtcatcatgttggcttgctgggcgaggatttgggtgagaatggcgttggtgtctggtggtggtggtggtggcggagggggaggtggaggtgggttgccctggtggttgtggttgctgccttcgggttggttgccatcaccggtaacagcggttctcctggtcgtcaccatctgaaaaccccacacagaaccagcaaacagaaagagctaacaattaaaactaaccacccacgactaccataattcttgaatttattactgctattaaattggttcattaaagttcaggttgcttaagcaaataaaataaagacaggctccgacacagttatgccacacaccggcataaccatgccccacacgactcaaaaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcaggctcggcacgaggggtctcgacgaagcaagtccacgccagggactgacgaaccagctcgggcctggaggtgctcttgcgggcagtgatcttctggctgcggcagacgcggcgacgcttggggcggcagtcctctccctgggcgatcttgagctgctgcagctgcgcctccaccgcgtcgaggtccttcttgagctgcaggttctcttgacgcagctccaggatcttcatgttgttctcgaccatcccacggtgcaccatctggtggaagtcgatacgagccgcgtcgtacgcctccaccatgcctgccaggtgcacgatggtagcgtcattctccgagctagcatcccggaaggtggcgtagtcgcgggctcctccgcgacgagggtggtagcggtagggcgagtgctgcaactcgtccgggtagcgctggcgaagagtgccgatggcgaggagagcggcgttctggcaagcggcggggaaggaatctccacccgcggtgactgccagcgaagtccgctcgggagagccggagaggatcactgtagtgacctcccaaccagcgtggggctctgcatcctcaccctcctgctccgggagcggcctggcctggtaatccactccatgtggataccccaggaccacgcacatgccccgcagctccaagacgaaaccagtcatgtccaaaccacgacgggtgacgctgccggccatctacaaacaaaacaaaaaaaacaacatttcaaaggtcagatttttggcgataaatgaagcagcaagacagagagagactagacaattttcacaaataatcaaagatttttatttttgaaaatattgctaaggcttgggatctacggctcgtcctagggtcaaatgtggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacaataaaccaacaattccaaagtgtccaggtgatgagaatatcccaaagtctagagttgtaaaaccacctaatgttacctaattaaacagcgaagcatctacctaaaatcatactagtggtaccatgagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaatgccggcttcaacttccacgaagagcggatcttccgaagctgcagcgtctacacgaccaacggaaaagaaaaggctttaactctaataaactccatataacaagcagaaacaaagcacaaaaatgggttcttggcttcttaagaaaaaattaaagacttgaacggtccaatt

SEQ ID NO: 74763 - DNA, 1813 bp, Oryza sativa
ccggcgagctctccgtcccgagccggccgccgtcgctgacgtcatgccgacgtcgtcatccagggctgacgtcattatccttagggctgacgtcatcgttcccttttcttttcctttttccttttctctaatagtttaaatctttggaaaatcatatctaaataaccgtagatccgttttaggtggttcaagtttctaaatttttctaaaataaagatctacatattaaaattgtccatgaattgaattaaatttatttaattctttttaaatgggctttaattagattcaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttctgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgaattgaatatcctattccttgataccttgggtaataaattgattagcttgaaccttatgtattggtttggttcagctaaaagttatatatatataattgcttagcaatgcttagaaacattagctcactaatgggatgaatcatatatactacattattatttatggttatatttaatggtagctcacgatggttaatcgtgttatgataattaattggtaattaaaatatgattaaggtgggttgtgagcacatggttttgaaggtcgtgctcatggcaattaaggaccggttcgcgagctactgttgtgaaacatttaccgtaccaaccacaagccagcatgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacaacctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaatagtttgcttagctcctggtttggagattagatctgtacagccgggtatggttgttcaggatggttgggcctgtgcagcatgggtgtgctgttcagtgttgattaaaatttctgattaattaatttactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaagaattcagaaggagaagacgtttggcttatacctcagttgagctgcctgtgggagtggagctgaagccctcgctagaccgttaattccgctgctgttttcttttcttttgtaagtatgtgatgttattattatgatgcatttg

SEQ ID NO: 74764 - DNA, 804 bp, Oryza sativa
acgcgtcgaggtcttcttgagctgcaggttctcctgacgcagctcaagaatcttcatgttgttctccaccatgccacgacgcaccatctgatggaagtcgatacgagccgcgtcgtatgcctccaccatgcgtgccagatgcacgacggtagcgtcatcctccgagctagcatctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaggtccgctcgggagagccggagaggatcactgcagtgacctcccaaccagcgtgcggctctgcatcctcaccctcctgctccgggagcggcctggcctggtaatccactccatgtggatatcccaagaccacgcacatgccccgcagctccaaaacgaagccagtcatgtccaaaccacgacgggtgacgctgccggccatctacaaacaaaaacaaagaggagagcaacatttaaaaaggtcagattttgttgataagtgaagcagcaagatggagggagaatagagggttttcacaaatacgggggatttttatttcgaaaatactgctaaggcttgggatctacggctcgtcctagggtcaagggtggctctgataccaacttgtcacgaccggaattaacccaccgggcgttccttacgtgcgtgtattattccttgtcccaagaagcaaggtacaccaaa

SEQ ID NO: 74765 - DNA, 646 bp, Oryza sativa
tcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagcgtcgccgccgcgtgcacgaagtccgccgccgccgccggccatcttcggcatcgtcgcgccgccgtctccgccgtcgcctttggtcgccgccaccaccgttaggtgcgccgtggtgtggagaagttcggccgcccctccgttttcgccgccgaccaccggagcgccgtcgtcgccactaacccgagccgccgccgccttcttcttcgtcgccggccgccgtcgtgcatcctttgactacgtggtgagtaccaacgggttcgcctcgttgccctctacgcgttgatgccctccaatcccgccgccgatgtccctagcgccggcgagctcgtcgacccgagccggccatcgtgctgacgtcatgccgacggtaaccctagggctgacgtcatctttgccagggctgacgtcatctctctctctttttcctttttcccgattttctaatagattaaaacttcggaaa

SEQ ID NO: 74766 - DNA, 20938 bp, Oryza sativa
cccttatatgaggagacagagggagtagatggcactcccatatttcaaaacctgtctaggaaaatgtagttgggatgtttttagaaaataaaggaagtcatacccttttgtacattgttgtgccctgaaccagggctggaattaggagatccacttttgcaaaaagatcttgacttcaggtctgccacaagctgatcaaataaagggattcaggaagaaacattataaagtctgtcttttttggtaaaacatgcacaaaataatagcttacttgttcccaagaactgttgaccaaggaaagtgtctcattatgagtcctctgcttctcttttagcccagcgaatttattttcaagagcacgatactcaaacttgtgggcttctagttgctctgagagcttttggtttttgtatttgagtacagtaaaatcgagctgccaaacaagacaatataagtaggcagtgtgcgaaatcaaaactaaagatatgtgtttggcaacaaagagaaatcactaattcaagcataaaaagaaaagctgaaccaacattcaagtatcttttatttacaacttgaagaagagcagagccaaaacagaacataaacacaaaaggagccgtactgatgatatcaccaacatgataaataggttcatttcatgctacaggacaaaagaaaaaaaaggttttgtgcatggatattccatattggaccaaatacggtaacacatgagtaaacgcataaaaggtatcatccaacatgccattatacccttgacctatccctcccaaaatttaaccaatcttttcccatatttccctcttgtaaaattaaataacaaagtaggcgaataattgccagttgtcaccggtagtaacagcgattaattgtcagttgtcaccagtagtaacttggtgacaaatttcattaatattaatttaacgacccaatttagacctttatctatatcaaaaaacaatagcatatgctatggaaaaataaaaggcgctatgattgtaaataagcattggcacattatggtatcattgccagcaagaaaattaaatttgtccaaagcagcagcggagctagggcccggccaccacgggcaggtgcccgggctccaccgtattagccagtggattaccacttaatgcccctgcttaatctgcttcttttaatagaggctaaatcagctatgcaagcaacaaaggagtcaagacacagcctcacaccaatgtttgctgccatcagcctaaggccaaagctacacagttctccaacagccattatctacttttgacaaaaaaataatacttattaatcctataatctagcccattcgtttaggtttgcccaagctcaagagaacttctagatccgctactagtccaaagttaaccatttcaatatccataaatgtagccacaaaaaactaagatcatttaaaaaactcaaaatacgaaggtttaccaaggaattgccactttctgctatcatgaacacgggaaaacaagaatgcaatgtaagtcaagtaacaatttcacaagtcagcctcccatctatcaccgagtaataattatagaatacatcaattgctctaaagaaccataaacaatcgtgcaatagttgcagaatccgaaacggataatgcatagctcattcctactagtatttttgttttcactctgacaggaggcaatatacatagggcttcttccactaacgaccacaacacagcaagacttgcaattgcatagagctcagcataagtacaaaagcatcaaacacttgtcaagaataaactcatcgatctatactcaaacagtccacaatagatcttttagcggatgtatggattccatgacataacaaaacagctaaaaatcagtcaccatgccaccatctagctatcatacaacaacatatcaaacagtactaccaccataaacatgaactcaaacaaacagtactaacacggtaccaccataaacattaactcaaaacgatacagagctggctcgagatgcgcaaataccttcttatcttcggaggtgggtgcaaccgccagccgcttggcaggagaaacaggggccccgccgccgggcgcgacggagctactgagccgccgcttccggtcgggctcccccgtgctccccataaccctaaccctaacctctcccaggtcctccgattctccacatgcggcgggtgaaaccaaaccccgaaaccacaagggccaaccctcccggccacctaccggtccaatccaccacccaaacccccgccccggcgactcccgaaccctaacacgcggatcaccaaaccaatcgcacccaaaaaaacaatcgcaaaaaaaacaaagagcggatgaaggacggaattggagcgcgggacgagcggatcgcggcggaggcggaattcggctagggttgtaggggggaagggatcggatcagggaggtgtgggcgagaggtgggagttagcggtggttttggcgtgtgcactgtcaaggggggaggaggtgagaaccgtgaggagaaagaagagaagggggggaggagagctaggcgaacggcgcagagaggagagagaatatgcgtgtggggaggcggagtgagttatctcgggcggaggcggctgttcgccccgctgcacggactccgtgcttctgtggacagtggacaccagcgggcatagggttggacctccgtcagtcggccttttaacagccagcccagaatggtgagaacgacaatgttcaatatagattactgtcacaaattatttattttgttatatatatgataaaatattgtttttaaaattaacaggtactccctccgtcccataatataagggattttgacttttttgcttgtactgtttgaccactcgtcttattcaaaaaatttgtgcaaatatagaaaacgaaaagttgtgcttaaagtactttggataataaagtaagtcataaacaaaataaataaattccaaaaatttttgaataagacgaatggttaaacactgcaagtaaaaagtcaaaatctcttatattataggacggagggagtagcgtataagcaagtactggcacctgaacctaggacatgcattatttgatcttcatgataagtctttcatatgaagttctttttatacggtgtgaatccagtgtattacaattttcaatgtaaagctttgattatcagtgccatacaaggtcatattactaagcaatagtaagttgttggttcatgtggttgcaactcttgttaattaactcagatagcttgtttttaagaaaaggttaatatggttattttgaagtagtcttggtctttttcattttaaattttgttttaccatagttgaattggtcatgaatatagagaggttagccaataatctattgcttaatactattagttaaggtttcagtgtttaccacatgacggacatgagcaatactctggtttctacatgtgataatatcggtcgatcataacattaatgtggtaggttggtaacggaaggttaaagcatgataactgtcgagaggcaagatgaaaactaagatgttcagaaatacaaagatacatatatatgaaccatttggtcgaggaaaagtagtcctagagaagcataccacgtggggaacaggggatgaaacatgatggtatgaaaaaaaaaacatgtcctctatgcacacacatgatgtatgtgattgtcgtattggggataaagttggttcaaatgcacaatgcttgttagtaccatattttctacttatttttactcaattacaagtaaaggcggatggtgtatggatacattgagagtatctttttgttcttctaatattgcatgaagggatgttaacgtttagatatattagatcatatgcatggattcaataaaaaaaatacatagtacatattcaagcaagataatactacactatgttatcatgtagtgcacaaaatgaccgatttctcgcatctaaaacatgacaaacatgtaaaaaaaacaaaggttagccaaactaattgcattagatatttagatgggtcttgagcccttgacccattttccgtgtcattgaagtgcaatctatttatgcgttcgcgaaaaaaaacattttccatgtcacaaggtaattgaataatctaaacaatacgttatctaacagtagctgctaaaaagttcaaataatctagttagattttgaaataccttaaccgcatttgtcagctatattaaggccctctttgtttaggcttataaaccaacttataagtcgaaaagtctaagcctaaacaaacaaacagcttttccgtttggcttttttgaagccataagccactctagcactattaagccaaaagctaggttggagaagtttttttggcttatgtgaggtagatatatgactcaactactaaacttaggacattaaatccaccggcttataaatcatataagccaataagctgacttaaaagtctagaccaataagcctaagcctaaacaaagagggcctaacatgcggaaaaggctctatgcacataatttttcgtataaaattgttacaaacattgacatggcatgatgcaaggaaatctggatttccaattactcctatctagtaaatcaagaggttgagaatttcgattgtaataaaaaaattaattatgtccagcaaatgctcttaaaaaataatgaaagttattgacttgtcctaatcaaactaaatttggatttgctaatatctatattgtttttagcatcgaagccgcttttacccaacaaaaagggactatattgcgaagtcaatctaggagtaaagaatttatatgctaatccatcgaaacaaatgttgggattccactaggattgatttgagggatggcaggattttgtgcagcgctagcaggaaaattgtttactatgacccgatggagcataatatttaacatgtgtattcaacagatgaaattttgaatctgttagataaaaggaaaatgcatccatctttagttaaaatgaatacgttccaatggtttgcaatgccaagaggagtaaaaagaaataaatactatagttattcctttctactcctacgtcttatacggagatagtctagtttattatgaacagatgaccaaaatgagaaagttacataagtcttttaaagtccacttcccaataatttttccttatgtaacttactcattatagcttcggtcatttacttcttattaaaaaaaacatggagctacttggttccttattatgatgaatttaaagcatctacgatggctattgttattgatgattgatgaataatgttactcgagtgagagatgctagatggctgacggaaaccactatgctctaggcaagattaaggatttgttcgtctaaccctcatctaaagggattgagatatgaagttattcccctcaaattctcctataatcattttcttgtgaggattaaccgaacaatttatgcggaaattggtttcgagctcaaacatgttttcattgaagtatttttgttatcttttcggtataactctattatatttttcttcttgtgttgtgtcaaaaacatttctgcttgtgtagtggttcttgtggatagatcatgtatgatctttctccggttttgtgtttcttttgtttcggagagctgatctggatagttcactctttcgtttgaatcaagtagtccagtatgagatgtgtgacaatcgtcagactttgaatccggagacagtgtcagacaaaaaaatcgtgttcactggccagcctcttctacccttcttctgatcctctcccgtatagccatttcgtcgaacaccttcccgagccgactgccgccgccgccgccatgctcctcgcgaagccccacctctcctcctcctctttcctcccatccacgcgggtgtctagccccgctccgggtcccaaccacgcaaagcccatcgccgcctctcccgcccctcgacgctgcctccgtctcgccgtcacatccgccgcggcgccggctgcttcgtcggcggaggcggcggcggcgctgagccgcgtggatgtgctctcagaggcgctccccttcatccagcgcttcaaggggaagaccgtggtggtgaagtacggcggcgcggcgatgaagtcgccggagctccaggcttcagtgatccgcgacctggtcctcctctcgtgcgtcggcctccaccccgtgctcgtccacggcggcggccccgagatcaactcctggctgctccgcgtcggcgtcgagccgcagttccggaacggcctccgcgtcactgacgcgctcaccatggaggtcgtcgagatggtgctcgtcggcaaggtcaacaagcacctcgtctccctcatcaacctcgcgggcggaaccgccgtaggtctctgtggcaaggacgctcgcctcctcaccgcgcgcccctccccgaacgcagcggccctcggcttcgtcggcgaggtctcgcgcgtggacgccaccgtcctccacccaatcatcgcctccggtcacatcccggtcatcgccactgtggccgccgacgagaccgggcaggcctacaacatcaacgctgacacggcggccggcgagatcgccgccgcggtcggcgcggagaagctgttgctgctcacagatgtgtctggaattctgcccgaccgtaatgaccccgggagtctggtgaaagagatcgacattgctggggtgcggcagatggtggccgacgggcaggtagctggtgggatgataccgaaggtggaatgctgcgtgcgtgccctcgcacagggcgtgcacactgcaagcatcatcgatgggcgtgtcccgcactcgttgctgctcgagattctcacagatgagggcactggcactatgatcactggctgaggtgattcatcccgtcgtggtattctccggtgcctctcttctcatactgtaatgtaatttgcatttgatatgcctcatgattgcaataagaattgtattcctcacacctgtagctggttgagataggttctgccatccgtttgttctgtgactttgttcgcaatggtgacatttttgtagtttgtgctataaatcgaatcaattcaggttaaactgtactcaagtaaagttgttcttttactgttgtttgggaataacatgggcatgattcaccagcttcaaacctgagtgctgaaagagtatgggtgtagtagtgttaggttcataaatatggaatgtgtgagctgtgagcttgtgactgagataaccaattcaactttagctaacactgtcttttgacccactgatcgtagaaggtttatattaatcaggaataccaacttcaacaaattatgtaccttatccagttgtttgctattagccaatgagagtattttcctccatgcctctactgccctttatcatcttatcccattgttgagatatctgctacatctatcatggaatttttgtgagtcatacagcacttctgatcttagtcaagaaagctccaatgatgaaagaagcaaatgaaaattctttagttttgttcagcctcatcatgtttgtatttaaaatgcacctagtatgcagtgcactatcttaaaaaaataacagattcaaacattcactttcatttgacactatgccagtacttcctctgtctcacaaaaaacaaattagtataggatgtgacacatcctacctgttcctattcgtagtactagaatgtgtcacatcccatactagttttttttatggggtggagggagtataacttccctgtcccgtcgcttcgtctttagatttgaatgtcagcagctcgttaacggtatgacaatcgattgacatttatattttcacttattgttctatttattgtattttgcattattttttattattcatgacttctatgaaatcaacctgcatatgtatatctattgtagcttacatatattttttaagtattgaatattgacatcaaggtcttagtttcctctttttgtcttgatctgttttaatcatatcataaatgcaaaggtaccagcatggtgtggtcaagagtattatagtttgcaaacaagctgtctatttcttatggccaacatagcacactggctatttatatacaatacaatttgctttggtattgcttggagttcggatcattgttcaatcccagtgtccagtcggttactgatggtacacataaaactttgtccaaaacatgcatcgcaatggacaaaatagattctgagttactgtggcattccgcctatggttatttatgtctgaacttggaataatatatcacattcactgttccaaatactttacatgttcatacgtctaaaaattttcgtatcttgattggaatcatggatgctgcatccatactgcttgaacatctttatgtgaagttccaggttcacactcaacttattttgttccaggtttttgtcattctttttggagttggcctggtgtgatatgatagattgaactgtgaaccacaagtgaatggagaaaatgacttgatttggcaccactataccaaggttctagctgtgactcatgaggtttggagaaactgatggcatggagggctggactggtagagctctgggtccttgcagacatcattcctctgttctttccaccaccatggcatggtcagagcaaattccacttgcatctaatggaacggtgccttcttttccgtatttaagtactgtattagtggaaactttcagtctttcattgtgccattcgtcatttctgatctgttgtgtgagagaaattttgagaaaagggaggaaaagctctaccccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcggtcagtgtttgtggtagccatttgtcgttgcaatcagtgtttgtagtaaccattccattagcgaaacactttgctgtcccttaggtgctacagtgtcgagacttgccagtgttcagcatgtatcacgtttttaggactttcagagttcatttagaaatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggccaagtccaaagatggcaacacaagcgattgcaccgatgcacgccgccgtcgtgcaccgccaccacgttctaccaccccgccgctgcgtgcgccgccgtggcgtcttcgtccgcgcctcggccgccgccgccgccgccgccgccgagacggacacgctgtccgcggccttctgggactacaacctcctcttccggtcgcagcgcgacgagtgcctcgactccatcccgctccgcgtcaccgagggcgcgatcccgcccgacttcccggccggcacctactacctcgccgggccgggcatcttctccgacgaccacggctccaccgtccaccccctcgacggccacggctacctccgctccttccgcttccggcccggcgaccgcaccatccactactccgcgcggtaagtcgcgccgcgcgcatgcagcagcagcaggtttgtcagtgagagcgacagactgacagtgcacgcgtgagtgacgcatgcaggttcgtggagacggcggcgaagagggaggagagccgggacggcgcgtcgtggcggttcacgcaccgggggcccttctccgtgctgcagggcgggaagaaggtgggcaatgtgaaggtgatgaagaacgtggccaacaccagcgtgctgcggtggggcggccggctgctctgcctctgggagggcggccagccgtacgaggttgacccccggacgctcgagaccgtcggcccgttcgacctgctcggcctcgccgccgccgacgacaacaaggcaacgaacgcgtctgcagcacgacggccgtggctgcaggaggccggcctcgacgccgccgcgcgcctgctgcgccctgttcttagcggtgcgtgacactgtaccggagcagcggcctccacttcgatcgattcggaccgaactgatatgacgctggtgcgcgcgtgcgtgcgtgcggtgcaggggtgttcgacatgccgggcaagaggctgctggcgcactacaagatcgacccgcggcgggggcgtctgctgatggtcgcctgcaacgccgaggacatgctcctcccgcgatcccacttcactttctacggtcagctcgccatcgcctcgaccaaccacgcattttccattcgctcctccaaaaaaaaaaatcacattgaacggcgtttccatggcagagttcgacgcccacttcgacctcgtccagaagcgtgagttcgtcgtgccggaccacctcatgatccacgactgggccttcaccgacacccactacatcctcctcggcaacaggatcaagctcgacatccccggtaaggaagagaaaacaaaagaaaacttgtccatggaatgatggaatcgtgcgcgcactggcgtctgatgctgacgtttggtatgcttggttggtgccgtgttcgggcgtaggatcgctgctggcattgacgggcactcacccgatgatcgcggcgctggccgtggacccgagaaggcagtcgacgccggtgtacctgcttccgcgctccccggagaccgaggcgggcggccgcgactggagcgtgccgatcgaggcgccgtcgcagatgtggtccgtgcacgtcggcaacgcgttcgaggaggcgaaccgccggggcggcctcgacgtccggctgcacatgtcaagctgctcctaccagtggttccatttccacaggatgtttggtaaatttcaacgccacaaaaaaaaaaacagtaatccatatttgctcgttcttgcatttgcacattgctggaacacaacgatcatcgagtgatctgcatcacaggttacaattggcaccacaagaagctggacccgtcgttcatgaacgcggcgaagggaaaggagtggctgcctcgcctcgttcaggtggccatcgagctcgacaggacgggagagtgccggaggtgctcagtcaggaggctgtccgatcagcacgccaggccggcggacttcccggcgataaacccaagctacgccaaccagaggaaccggttcgtctacgccggcgccgcgtccggctcccgcagattcctcccgtacttcccgttcgacagcgtggtgaaggtcgacgtctccgatggatcggcgcggtggtggtctaccgacgggcgcaagttcgtcggcgagccggtcttcgtcccgaccggcggcggagaggatggtggctatgttcttcttgtagaggtaagacggagtgcccgttccatcaacatgaagtacgagtgttttgttttttcttaagatttagtacaaatgtttactactgaattaacatcaagacatgtgatgtctctttgcttcttgacagtatgcagtctccaagcacagatgccatctagtggtgctggatgcaaagaagatagggacagagaatgcacttgtggcaaaactagaggtgccaaagaacctcacttttccaatgggattccatggtttctggggagatgaatgagcatagagcaagcatcagatccagtctaactctggagagaaattgtcttgaaaaggcaagaattttgcctcgtgtattgataaaagagagttttgtgataatctgtacatggtggagaggaattatcaggggaaccaaataactactgtacatccagtctcggaatgaaaattcgtctcaccaattcattaaaatcctgaaatactaatgttttaaggcaataattcatagtattcccatagggtaaacatataagacctccactgagaatcttgatgtcttggcaattttaaaatgaaagttcttgaactgacaactaagaatgataccatccatgatcttaacccattcgacaagaatttaaaaggctagaacatatcctgtacacagctaacagaccaccaaatgtgaagtcgacgaatttttggcatcacttaatgcgagccacagtcaccacaatgaagacgaacactgcgagcatgaaggacattctcactgtatcgtcatacaaatcatagtcctcactctgagcttgaaagagcatgttcacaagcttaagtatgctctcaaggaattccttgatctttgcttgggtggtttccatgacccacttcatcactccaggagaagcagaagaacttccattgggatcagcctccttagctgaacgaaagtaccaaccagattaatatcgcttatccaggcccaaattgatcttttattttattattaaaagatgtacttaaaatgctaaagctaaaagccacataccatcctgaaaggacttcctgaattcttgcaccacctcatttttcatcacggcatcccatacagacttatcagttgacaaggccataaccattttctgcatgttgggagatgaatgttaggcaaagaccgaaagaataataggtcatctctggaaaataatatttggtgctaccaaacaaacaagttcatcattgctatacataaataggaactgaatcaaacccacattcacctggacagaagaatctacttgcaataggtggaatgcatccagcacattccgatgttcccttgtcaaaagagcagttgagttaaggacaagcatagcaggttcaatacattcctctgatgcagtgtctggtgtagagtgttctaagctggctaattggtcaatcttaacatcagatggagtagaatcctcaatcttaatatcagatggtgtagaaccttcagaaaaataattaacaaacattccagatggaggaagtcctgagatgggggacaatgcaagtgcttgggcaggtgcatcagaatccaatccaggatggttttcaaataccctgcatgcaacagaaaacagtgtgtgtttttttatataaaatatgtaaaaccagattgcataaaattaatcaactgaagagctgataaggtctatcaataacagaggggataacaaagcaatgacgagcatgtgtatgcagttggagaagtactacaaaaattgcttcttttagcaggataagttgaaaattggagatccaaccgcattgtacggcattccacatctagacggtgcatacacaacgatttcaggaacatacaaacatagcttgaccgtggctataggcataataacttccacgcaacaaatttgtaattaaaggacgattatcaccgataacaaaacatggaaaacctccccccccccctttttatattattatagaagaaaatcaattagcaagtaattaaacaaggcagttccgatcttttctagataatcaaagatcaaaacttgtaaacctaagagcatcaagtagaatcttactcttggatgctagcaacggcggcgcggacttcctggtcggtgggcggggccccgaacgcctccgcgtgctcatccgccgcctcctggacagcgtcgaacgccccagaatccgccccgacggcgtcatcgccctgggcgacgaccacctcccagtcctcatcgccatcaaggcggagcgcgcgggactcccagcacccgacggaggcgatggagcaggccgggggaggcgaggcggcgcgcagggcacgggccccggctcgcgtggcagggcggctcccgctggagatggagacggcgggagacagggcggcgccaccgcggagcgaggaggagccggcgaggcggacgaggtgcttgccgccggccgggttgctcatggcggcggcgccctggtggagcctcgcggacgtctcgccccctctccaagagctctccctcctcctgtacaccacgtggacaaccatggcaggggcctcgccgtcgccggctcgcagctgatgctcctctgcctcccccgccgcggtttgttcctcttcgccttccggcgaggcggcgtacgaagtgggagaaccggcagatttgtttgggttccggaaccaaatcagtattcggtttattattaagatgggtggggtggtttgttaactgatgatatatttccgcaggggaagtgtttgaaagtacaactagtaagttattatctctatctctttctaaatgtaacttgtagcatatagataaataaaagaattaatttttatagggtgtagctatatttatagcgccatatttttcatcaaaaaatagtcggcatgtatttacattgtaagtccctaaattacatatgtaattttagtgtatttacaatgtaagtctcaaaattacatatgtaagtactaaaattacatatgtaaattcaaaaattacatgctaattgcatatgtaagtggggtgtaaatgaggtgtaactactgtgtaagtggctaaaaaaaatcgactgtagcatatggcgccatatttctagcaactccatttttatatctatctttgtgaatgtttaactattaaatgaaataatggacttttcatatctactttgttaattgtacatacgctagtttttattttttttagcaacatatgtagtgacatactaatttttaatatatcacattgtgtttatttttttagcaatatatgtagtgacatagtaatttttaattgtaaatgtgcttttaatatatcacatttgttgattttttgtgtaatatttgaagttctacatttgacacatgcacttgtatttaggctaattattctttaaatggtgacaacgtactcgtagacaagggggtgcccgcgatgtctatgtcaatatcaagatttactagccaaatatttatgagttgcttttatggtaaggtgtgcgtgtgaatgttcacgagggtgaatatgcgcgcattataagtgtctgtgtttatattatattttttaaaaaatatattatttaaatattagttcttatttattttatcattaaatatacttaacattgacttatattttttatattagcaccaaatttttaatgacaccaatgagcaaatgaaaaatcaacggtatcatatatgagagtatatgaataattttatggcttgcctctccacataatatattatcagtaattttttatcttaatgtattgtagaaaaaagtttatatatttctgcaagaattcaactagagaaacttccgcccatcataattgccaaaatattttaaaatataaaaaacgaatctaaagctttttaaaaatgaagggatgtcctctttatttttccttctctcacaaggcatcgtgcaatacagttcgttgtttagatgtctattcggtcttatttactactagtagcgagtatctacgtcattttcgcttttagattagagaatgaagcttatccacgttgcgtttagcattaggttctgcaacaacgcatttacaatgcgtctatgcgctcgtatatattagtctcgatgctttctcactgacacgtggacacaaagaatatagggacgaatatatcatccccgacgtacctgtctaactgatcgtaagaaattaactcatttttgataaataaaaacaactgcgtgccgcccaaggctttggtgttgcttactctaatacttctactttattcgatttaggagtagaaaattttatcctttggtttgacacggttggcatgactgtaatgtatgccgcatttgctacacagcatattgctgcgacttcaggatgtcgagatcgaacatcatatgttaaaggggatttggtcgtatacatctctgtagtccctaaaaaaaaattgaacatctctgttacagaaaacgggttgggttccacgatcactgcgggcggggtgcgtacgcgattttgtggtataccatcacatcattgcaagaagcagtatggataaatagttttgctctgctccactaggattaacgagcctccactcttgatcatcgtattgattttgcgtgtaaccagcagcgtccgccatgagcagtgcttcgccctagatcgtccaagctgtatgctactacctgttggtgctcccagcgtaacgagagctcggagttgacgaattcagagaccaaaaaaagagacgtggggatcacagtatatcagacggcctcacgtcgctttccagatggccgggtctccgaaccgtaacgcgagaggagacatggtgcgcagcgccagatgagagagacggcgaagcaaaccaacccaaaggatgagatttatgttgagcacgagaccatcaagcaacaagcatacgccgatacgcggattgtgcggcgagatctcctaaccaatatgcgcatcgattcgacgggagctcacttgggttttcgttttgttctccccgcgacgtttagttagtttttcaccgtttagtgtcgtggattacgtggtgagaaataccagcgcgtttaaaaacgtgtgcgtcgatataaaagattacatgcgaagtttatgaaaacacttgtttttctttttcttttttcccttttattatgggcttccatcagcagcgtatcgcaagttgcaatttgcaaccggatacttatccatgacgctcgggctggtgaagaccgcggtttttgcgctgcttgtgcttattgttacagaaaaaaaatccaacattgattagattatcaaatggttcgtgagacacacagtagctacgagaaaacagaagaacggtaagacgtcgtttctccaaacaatttgacgatttgataatatgtttcaattatgcgtagcattctcccttgatcaaattccggtgttgctctgctgccagttttttttttcgccggtctgctgctaaattttgcagttctacagtatgcacttctccggttctgcactagtactatcaggtactagtactatctacaaggccattgttgacttctggaccgtctatatgattagcaggagcccatttgacacaaaagtattcggccgattttgttgggcccttctatattttagatcaaaggaagcccattaacaaaagtactacccaaaccatccattagtccatcacaattcactaggatcaaactgcctactatactagattacattgctttctttccttcaaacatccacaaatccacaacctaataaagacacagatcttacacacatactacatgtaactacacgaaaccaaatgcaacaaagattctaacacgacaaacaaagatttttcgtcagggtgacagactgccagaatgatttcatcacacgaccaccgtttgcacgctcccatggcgcgccgactcgttcgtcgccggcgccggcgccggctccggcacggtcgggaagaccagggcttgatgcaccagcgccgccaccgccgcgccgaccatcgggccggcccagtacacggcctggttgctgtagtgcccgctgacaaccgccggcccgaacgagcgcgccgggttcatcgacgcgcccgtgagcgaccccgccgccagcacgcacgcgcccgtcacggccccgaccaccagcgcgcccagcgccgtcgccgcgggccccttcctgccgccgaagcctccaccccgcgggtcgccggcgacgtgcaccgtgtacaccaccatgaacgtgagcaccccctccaggatccccgccccgaacccggtcatctccaccgcgatcctcgtcgtcggcacggcctgtgtgtgcaaacgcgcgttagtctacgcaaagttaaggacatttcgatcggaagtgatcttgcctggccggcggagatgtagtggaggacgaggcaggcgaacgtggagccgagcatctgagacgcccagtagaagatggcgctcgggacggtgatgtggccgccgatggcgtaggcgaacgtcacggcggggttgacgtggccgccggagacgtcggcggcgatgaacaccgcggcgaagagcccgaacgcctgcgcaacggcggtcgccatcagggacgaggcatcggatgtttcatccggcgtgagcatccctggcaacagcgcgcggcaagttcacagagcgaaatcacgtatgagaccaacaaagcagagcaattcgcacgacatgcggaacgtaggttgcagtgaaacgcatgacttacgggcggagatggtggagccgacggcgatgaacacaaagaggaaggtggagaagaactcggcgaagtacgcccggagcgccggcggcgagaagcagcgcttcatgttggcacagatgttcgccattgcaagtttaccctgtgtgtgtgtgtgacactgtgtttacagagcagtgaagaacacgattacacgaattcgcacagttcttcactactcggggtgtcacagactttatatagaagggccatgggtcgcgaccgtagggtgaaacgttgctatacttcgcagcggttgccgccgcgcccgctcccaaactgaaccgtctccacgcgggcacgcccgttgcgcgcgttcgcacaccgcatgttagagaacgtgtacgtgcaaacttcacaacttacaatgaaccgtgcatatatggtacagatcaatcgagcagttttgctacatattcttttgtaggattgaatcacaataactaagccaaccagggaggtgaatgtttggtatacccaaaaaccaaaaacttttagtggaaataaaagttaccctcgaaatcgacggagatcggtttgaccgagattgatctatcggtctgactgagtggatgccgccggtctgaccgatgtagaacgatcggtcaaaccgccgaagtcgcctgccgctcgctgtcgccgccgccggtctgactgccgtgctcccgtcggtctgaccgccgcaatgccgtcggtctgaccaccggtgagttgccggttagaccgccgaaacccggtgaaacacaaatcgaagaactattaaagtagatgacaactttattgcttctctctgtgtttacaaagtgcaccaacagcactccttacaaaaatttcgactaaactcgaaaccctaactaaactatcaactcaattgctctcaaaagcgataccggaaagcctcacgctccccctctatttatacatgaggtaggcagcctaaagccacgaaccaaactcatactaagagtcctaaacaccttaggaaaccatacagtacaagacacaaactttacataaccaattgtaccaaatttggactccttccaaattcgactccgcatcccatacgtacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgaggcatcgagtcacctacacatgaaacaaataaagaaaccatattctgagaccaagttatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctcgatcaccgctggtctgaccggcatacacagcccggtcagaccggtcacataaaatagcagtgaatccgatcatcacctgaaaattgattatctccaaaaccacttcgatgataatctccaaatatcaaaaccaataatcacagatgccag

SEQ ID NO: 74767 - DNA, 13209 bp, Oryza sativa
taacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctatttggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagctatcagacgtaagcgggcttggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactagacacatggacgtggccaagagaggacgttcctggcctagggttgatcgacaggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcatggagcaatttgggatgggtgaccgaccgggaaattcttcccgggtgcacacgagtgaggacaaagtgtgcagaaaagacatgtgttggtctgtgagggtagtctatgacctatgaaagccaattcatagcatagccgatcaggtagatctagcatgtatcggctaatactccgatactactctatactaagattttaaagcaagtaaataaaagtagttaaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctggaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtcctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttagctcttggagtgttcccgtcgggcggctatagcttagctctctcctccattatttgcatggccgtttcctcccccctcacagccctataaattccgaacccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggacttggtggttgcccccacccccacccgt

SEQ ID NO: 74768 - DNA, 2561 bp, Oryza sativa
ccattgtgcccgtctgtctccgccgcgcccgttcgtcgttgccgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccacgtggtttccacgtgtgcaggccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatatataacagcattaaacttcggatgatcatatcttggtcatacgagctccgaatcgatccgttcaagtctcctaatgtttgttataacctaaagaaccctgtgctttgttttttatgtattgttattgcttctttataggcttgaagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttagtttaaattaatgcattatcgctttatttaaaattcccgcgttgtcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaacattaggtggttttataactttagactttgggaatattcatatcacctggacactatggaattgttgggttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatgaacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttggaacgagctggaacacagggtcgggttgccagttcggtctgaatcatcatagaccttgggttaaggcaggtccgtgtgggttcacggccttgattaataatattatatagctctaggaccgtgttaacaaaatagctttgagcaactaagtgtcttctaatgctgtttactgcaaaccctaaccccccctatattatggctcccttgtactcccttacatttattctgcacttgtgggtgtgtcttgttgagtacggtggttgtactcagtcttgctcaatttttcccaaccccaaaagaggagttccttgaagatgaaggctttggtgtctagctcgtgcctgccgtcaagtgcctgtggtcgtcgccctagtcttccgctgtttctcgtttgtttttgtgtgtgctgggtcttccctgcccatgtaataaattaactatttatgattccgcttgataaactctgaaatgtatcaactcttggtgtaccttgcctcatgggacaaggattaatgcacgcccgtcaggaacgccaggtgggttataaaaggtcgtgacatgtgtgctagttgaactaagcatggctaaacaatccctaatccaacatctaatcaagttacattccaagctagcaaaggaacatgataacaaataatatggctgagacagtagggtaacatcccatggtaacattataaaacaatgtaatatttaaggaaaacaatagagcatttgcaatctgggatcaacatattcaagtgacaagcacgacttgccttgcttttgggctgaagaaacctcggcgactatctcaaagtacaccggagcgtccgaagagccatg

SEQ ID NO: 74769 - DNA, 652 bp, Oryza sativa
atccgagggagagagagaggggaaagagggggaaacgggggaggggaacgcggggagtgattcccccctctttattgcgcgcggggccggcgggatgcggcggaattcgcggcggcggcggcgctagggcacgggcgggcggcgggcgcggcgggaggagggagatgacaggtgggtcccacccgtcagcgagagtggcgggcgggcccgcctgtcagcggcgcgcgcgcgcgcggggagccgatgggccgcgggggagaggagagagagggagggaaagttgggccgagccggcccaagaaggaaaggggggggaaagaagaacttcttttagggtttttctttttataaaccatttcaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacattgaattttaattattctttgcacaatttcgaggatgaattttagagtcgttttgggacgcgacaaacctaccccccttaaacggaatctcgaccccgagattcggaagaactgccgaaaagatcgggatgggctgcctt

SEQ ID NO: 74770 - DNA, 668 bp, Oryza sativa
cccgcgggtaacgtgaaaaccatgtttaccgatgcagttacaacactcttccctttggccaaactttttgcttcattggctacaacctcatcggctgttgcaacctggcttttaacatgccactcttgcctgggctttgctttttccagccgatggttgatttcttgctccacctcttgaaaacgttctctgttcctcaatctctgaacccttctcgtcttattcctcgtgaaaataccagaaggacaccattgagtctttctatcctcattatcttcttgatcacggtcttggttcaccgggcccaatctctgatgaacaggaactcttgtctgcctcagccgattgcttctattgtaggatcagcttgagctctctgcggcatcactgcatccagggcaatcttcaatagatggcagcctcataccttcgttccagcagaatctaaaaaactcacagtcccaatgaggatcaaaaccatcatcatcttcttcataatgcctctcctgttgcttgtcgtattttctctagtacttgttgataattctagccgaattcatctgaaagttgtcgcgaccgggaaaattgccttttcccgaacgcgagtgtattaatcccagtcccaggaaaagccggggtacaccacacaaacatgatataaaagacac

SEQ ID NO: 74771 - DNA, 1145 bp, Oryza sativa
atatattttagggtcgttttgggacatgacaaaaggcctatagtttgggaaaacaccacctggcagatagactggccctgtagcttgatgctgagctattgtgccatcaaccaatgacttcaccatttttgttaaagtattgactaagactcctgattgattgatcaaagcatgttgcacagcgtagtcaatccgatcttggaagttgttaaactgaggttgtaatccattggcatctggaccaagatcttcaaccattccctcctgaaaaccatcacatttgtcgtgtagttcaccatcagtacctttatcaccttgagatgagcttgagccgacttcatcggcagcaactacttttaccttgtacttttggtaaactttcccacgggtttctacgaaagacttcatgaattgctcctgagcattcttcatcattatgtcgaaaatccttcttctgttctggtgagagcttgtccatagtgattggaacaatgttcccttcatgaacttcagacccagttggatttggaggcctgttttgaggatctgtcgacttgcccgtcgaggacggagattgcttttctactgacatgcttgccgtctcccactgggcatgccaaaagcgtgttgatgcgaaaacacgaggcctggaagatctgcttaacttcagtgcaggtccaaaaatcttgcctttaggttcgtgagcgtgccagttgatttgatcctgcaataaaagagaaataaagacaaagaaactacggttaaatccataaatggtagccgatcggccagccgccgatgacgtatcatttatctttgagccgatgtcatatgtgaatcgatcggcaatcatgaatcagtaagaaagaactaaatctactcgatcggctgtatatattaacaatatataatccttatgttgatatatacttaaatcaagtgattgggatagatcggtcgccatgccgagacagtataaatcacttagatcgaaatatatattaacaatgagattatatatgttcatagcatagccgatgagatagatttagcatgtatcgtctaatactccgataccactctactattaagatattaaagcaagtagaatatatcaaacagaagcctgatatactttgggggat

SEQ ID NO: 74772 - DNA, 1239 bp, Oryza sativa
tgttgttgtattacatggggttcgggatctatttataccccgagattacataacaaaatatgtccatatcggacacgactcttatctctaacaaactctaaaataccataagtctttacggctgacttttgcccaaacttatccttaaggaaattacatgaaatatcctaattaatagatacaattgacttttcaggacttaatctggttgaattgttgtttaacaatttcatctccaatacttgaattaccaaatttggttgttaacaaattgttgttctatctttcaaccgataaaggcaaggagaagtagtgtctcgtgggaattaggggtaagggtaagcccccgtgctaaagattatttaaactaagagagaatacatataccttgcacctgtacctttgagatatatagtataatagcaactcttgatcaacaaccaagtttttgttcctttcgtccttcactcgggacgagcaaaagtttacccttgggggttttgttgacggtcattagcgatcactttcgaccgttaatattacgaaaatagggggaactagttatgcttgcaatacatatatatgttagaataatatattccactagtattaggttcactaaccttttgcagagaataaacataaaagtggagcagaatcgacatcaactcagacgataaatcaatcggacgatgtcgaaaatcatacttatgcatgaatgggccaagaactcagaattgacacgatgaattgggccaaaattcacaagtctgcataaaggagcaacagaggaggccacctgtcgagtttgggccaggtgggcccagcccatggttcagccaaaacccgccgaacttcccgtggcgcctatgaatgcagtgtttggatggacggctgggactgttccccaatgacggttggagggtattaccgaccattccaaccatcacaaccgtcattacctacgtataaaaggagctcctcttctcacttcactcgtacacctcaagcaaagctctctcatattctctcaagtttagtttagtgttcttaacctaatggaataggaatagagtagaaatcggagtccggtagccttcggaagagttcgggtatggctctagaagctattctcttctcttttgtaagcttgaactttatttaaaacactcttctttatacatttatggtattgaaatacttcctgagtatatgaatcccaactttacattatgttaa

SEQ ID NO: 74773 - DNA, 1096 bp, Oryza sativa
accacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccttctggccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcacccctagcccagcccaaaaccattttaggggttttgaaaggaaggagcggtgtgaaaccaattccacaatagtccaccattccaaagtatccaggtgatatgaatatttcccaaagtctatagttgtaaaaccacctaatgttacctaattaaattgcgaagcatctacctaaaattaaactagtggtgtcatgagtggagtgtccactagttggggttttgtttgtctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaaacgtcggcttcaacttccacgaagagcggatcttccgaagctgcagcgtctacacgaccaacggaaaagaaaaaggctttaactctaataaattccacataacagcagaaataaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaactcatt

SEQ ID NO: 74774 - DNA, 10626 bp, Oryza sativa
tatagggcgaattcgagctcggtacccgtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgtcctcgccgtcgagggcgcttcgcgggccacccgaaaggggaggcctgcgagcgacaaaaagaaggaggccggcgcttccagcagggagcgcccgaccggcaagtggtgcaccgtgcacaacacctccctccacgacctcgcggactgccgcgcggtcaaaagtttggctgagcggatgaggaagtgggaggaggagaggaggcaggagcgccgtgagggcaaggccccggcggctccctccggcaaccggcgaagtgaggccaagcagaaggcccccgccgaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcattgcccggggaggacagatcgcgatggtggtttcccccaccgtttgcaacgtgaagttggggcgtgtcctcatagacgggggtgcagccctcaacatcctttcccccgcagcctttgacgccatcaaggccctggggatggtgcttcggtcgtcccagccgattataggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccaggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtctaagaccacacgaatcggtggtcttctggacggcaaataggaagacgcgctcgtctccttcctgcgggcaaacgccaacgttttcgcctggagaccggcggacatgcccggggtccccagggaggtgattgagcaccgtcttgccgtgcagccgggcgcaaggccggtccggcagaaagtgcggcggtaggccccggaacatcaagccttcatccgcgaggaggtggcgcgacttctggaggccggattcatccgtgaggtcatccatccggagtggctggcgaacccggtcatcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctggcggcaaccccgcaggtggtcagcgcggcgttggttgtggagcacgacgaggacaaccctcaccccgcgcatccccaccctgtgtcgactcgacccgggagagagcagggaggagaggcccccgagccgaacggcggcccgaggcccccgacggccggagctggccctccgcctgcttgtcagacggtgccaggcgcccccgacccccaggatggccccggggccactgcgggaaggccgcgcctgtcgccctccgaccccgaggtcgtcggcacagaagccgagtgcgccccgcacgacctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttatcccctcggccaaatcttgcataaccgagagggtactggacgggtggtgaaatgggcaatcgaactctctgagtttgatttgcactttgaaccacgccacgcgatcaagagccaggccctcgccaactttgtggcagagtggaccccggcccctgagcccatctccgtccccgagaccagctcgggcccctcgcagctgcctcccaccgcctactgggtgatgcagttcgacggctccctatctcttcagggcgccggtgcgggggtcacgttaacctcgccaaacggagacgtcctcagatacctggttcgcctcgacttccgggcgaccaataatatggcggagtacgagggactccttgcgggactcagggtggcagctggactggggatccgccgcctcctggtgttaggcgactcccagctggtcgttaaccaggtctgtaaggagtaccggtgctctgacccgcagatagacgcttacgtgcgccaagtgcggcgtatggagcgccaatttgacggaatagagcttcggcacgtgcccagacgggataacgcggtcgccgacgaactctcgaggctcgcttcctcgcgagcccagaccccaccgggcgcctttgaagaaaggcttgcccagccatcggcgcggcccgaccccctagaggagacggacgcgcctgaacggcccccgaggcccgtcggagtccaggcctcgggacccgaggggagcgctcccagctcccttagattgattgcttggatcactgagatctaggcgtacctcacagataagactctacccgaggaccgcgaagggagtgaacgcgtccagcgcatctccaagcgctacgtgctggtggaagggaccctctatcggcgcgcggctaacggagtcctcctgaagtgcattcctcaggaacaaggcgtcgagcttcttgccgatatccatgaaggcgagtgcggagcccactccgcctcacgcaccttggctggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcacaccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttaccagcggtgctctgggcgaaccgaaccacgccaagccgagcaaccggggaaacgcctttcttcctcgtctacggcgcggaggcagttctcccattcgagctcaccctgaggtcccctcgggccaccatgtactgcgaggccgatcaagatcagctttgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtactacgccgcgtccaaacgcgtgctggactgagcaaactctcaccaatgtgggagggtccgtatcgagtgatcggcgtcccccggccgggctccgttcggctggccacggccgacggcacagagctgcctaatccgtggaacatcgaacaccttcgtcgcttctacccctagtaggggtcaggtgtcaggtctcgggctcgggccaaccccgcgccctcccaggcgtgcagagttggccgggggctaccacatgcatatccttatcttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataatcctcggtcaccacgttcccggcctggccagtctcgacacacggatctccccaggcactagccccgacccgcgccatttgaggctgggacctgggcacgagccctcgttcaagccaagacacagaaggaccgcggcacagaccatcctcatctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcatcgctgtcgtccgcaccaccgtcaccgccctcctcgtcggagtctggcctcttcccaagcggcttcctcagcctggcgagcccggacagcctcctgggcagcttcctcggcttcccggaggcggtttgcggcttctcgccggtcagcttcccgcctccgggcctccgtggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggatgaacctgcgaggaggtcggctaaacgaccaccttggggggagatgagctttccccggcatggttcggtcccccctatcttgcggagccgcttcttttttcgctccccctcgggctacgacgtcggcacagcaccctccgggcgcctgctgctggcacgcaccaccccgccccctcggggaggagatggggagggggtatcctcctgtttcctcttcccccgggcgtcggcagggcggctgccccccgggcccccgtcacggggcccagaagcacgactccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcctggccggtggcagattccggcatgaatcggcgcggcagcccggcttgcctctcgctcacgatgcgagaaggcggcagcacgctaccgtcgagcggtgcggagccccgtgccatgacaccggcggaggaggggtttgagagcgagtgagtgcggcgagggtagggcacaggaaacgagaagttagagcgcaagcggcgaaggcaaggggaataatggcgaagaggaaggaaacgaatctcttcctcggcgtctttatacccttgccaacgctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcgggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtctcggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaataaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccggcaaaggggggcccgcgcggtctcccggtgaggagccccacgctccgtcatctggcgcgccaggtagggggcatgtgtgtttttctaagctctcgtcctctttcgtgtgcgccaagcttttcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatggagaaggacggcgagacggggagcgtcgccttctcgtctacggcgatggtagcacgccccagggcgcgctccaagctgcgggcgtgctcttgtgtcacccgcccgtcgtccccgatccagagactccagcccaacgttggctggatgacgtggccgacttggtcatgacggcgtagcatcgcctaggcaccggtgggcggtcctccgccaccaaggcctctggcgctgctaccgccggctccgtgtcgtcgaggcggagggcgcggcgagcggcggccgttacccgccgttcgtcagccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagcctcctgtgcccccggttggtggtgtcggctgtcgagcctttgtggcgagccttcggaacgtccgttggcccccaaggttccggcccaccatcaccgagaaatatgacggaagcgtcaaccccgccgagtttctccaggtctacacgaccgggatcgaggccgctgggggtgacgacagggtcatggcgaacttcttccccatggccctgaagggacaggcgcggggttggctaatgaacttgccgcccgcgtcggtccactcttgggagaatttgtgccagcagttcaccatgaacttccaaggcacatatccgcgcccaggtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgttctcgccgtcgagggcgcttcgcgggccaaccgaaaggggaagcctgcgagcgacaaaaagaagaggccggcgcttccagcagggagcgcccgaccggcaagtggtgcaccgtgcac

SEQ ID NO: 74775 - DNA, 31851 bp, Oryza sativa
atgacttacattgtgaaacggagggagtacctgtgatatgtatgatctgacccaattatcaaccaggaattgatttcaaagcggttggtggaaattaagagattacatgaagagagaattgaaattttgaacaaaatagcaacttttcaggtttgttgattggtcaagcacagaatgcatccttgcttagccttgaaggcccatgcttaatatttattgcatgggagaattttttagtatcagaacctgtatgactaactttgtgtgtgtgtttttaatctcctccagaatatcttgatggatttcaagagcattcgttcttcaaaagcttttcagcttgttaatgatcgacttcagaagtcacaagcagaattggatcactaccagacattattagagaaattacaggtggttactggtcagtggatttgttggattccagagttgtatagcaaaaatgtctcgctagagcatttgatcttttgttgaattcctatttgatatgtttcaggttgataaggataagtttgtgtggcaagaaaggcaatttaatttgaaagttgatctggctgagattcctgagagggtttctacatattgtgagtctagcattgctgatctcaagaaggatattcagaaactatgtgatgaaaaaaacatgcttattctcaaacttgaagaggcttcaagagaacctggtgcggtagttactattcactttaccaagagtaactttcaaacttgtcttgctaaagcaggtaataaggaattgtttgcacttgtcaggtcggaatcaagttattacaaaatttaaagctttagtgtcatcgataccaagggaaatgggcgcgatgcagagtgaaatgaccaaacacaaggaggcttccttggagttgaattctttgcgagcagaagtccattcactttctcgcattctgtccagaaaggtaaattgcttgttattggcttgcacatatgactcgcaagtgttatggcattgattcgccaatgtgtcaggctgtttattttgttttataggaacgtgataatgaagaagcatcatgcagatctgcccgtgcgggatctgatataacacaacttcaatcagtggtatcttgtttgtttagactcagcttattttttctcttcattaaggtgttttgtttagctattgcaggaatttgtcctcccatgataatttgacatattgaaaccaaaaccctgtagatttctgatctgaagcaaactaataaggagcttaagttgttcgcggatatgtataagcgtgaatccactgattccaggtatttcaattttatatcatatataattctcaacacaacttttttttttggctaagacttgtgatattttgtagagatagatgcatctcacttcttaggacagagtgcagtgtaatgccgtgtttaattgtttacctatcatgtatttaattcattgcacggtcactctactatggccatgacatttcatcactcatcaccagtaacttaagtttatttattttgtgatggaaataacctttttttgtgtgtgtggcagggaaataatggaatccagagatagggaattccttgaatgggctcatgttcatgccctgaaatcatctcttgatgaaagtaagctagagcagcgtgttaaggctgccaatgaagctgaagcaatcacacagcagaggctagcaactgcagaagctgagattgctgaatcagggcagaagcttgggacttctagaaagtacagaattatgcttctgaacattgtttctcttagaactgttgaagtaggggtcacttctcttttagggttactaaaggaaattgatgcttactgctgaatgttcactgtgttcagggatctagtcagtttatcccatatgctgaagtctaaacaggaagaatgtgaagcttacagagtggaggtcgaggtgtgtgccatcttttatgcatgcagttcaagtatggctttaaacatatattaaacattgtcatcctgagtttgaaacttttactaacctattccagtgtatcgggcaagcatatgaggacatacaggcacaaaaccaacaattgctacagcagattattgaaagagatgatgataataccaaggtagtgactcaatgatttctttaaagctattatctcagataatcctctcccaagcttatagttttataagagttcccatttaccactgtaccaaatctggttgcacaaatagctttcatgtttctgatatattcataggatgttagatttggttatattgttaatttgattgttccggagactcagtacttcattgaaaagctgtttacttgcgttaagttggtgatgcggaatttcataaaataggccaaagttccaaacccttgtggacagcaactactggttgccaaaaaaaaatccttgtggattcctggatgagtattgcctgccctttatttagatatctttttgaaaagaaagttagaacatttttctaaatgaccatcaacagttttttttttgggtaaatggtgttgtttcaaggtcaaagaaccagagaaaatcaggacgactgcgccttttaatagtagagataaattgaaaatttttagccgtgctatttgtaccatagctccttactctttggagtgcccttgataatccaggcagcctatccaagggtcctgaactcctgataaatctacagttccagtgattgtgtatgttttgatccaaaattttagtttgatgttttattgaaattttactgatagtaaagcttgtttacttcggatgtattgaataagaaatgtgctaactctgcatttggtatttcaatcccattgaggaatggaagctttaggatgaatcaatctggtagtaaactattttttcagtagtcgtaacatttttgtttggtgaaatctacactgcagatttttatggagggtgttaaagcaaaacagacacaagatgctttgcatttggaaacatattctttgcgcagaaacttgcagcaggaaagctctttgatggatctgtacaaccagaaaattgtttccttagaagatcaggtaggttgaacgcaaatattgtataatccaatacaatccttccaggaggtgctgaatattattttcccctgattcccagcttaaaatgtggtctgatcgggttgggaaacttcaagaggatggatggcaacaatctgtttcattgagtaattaccaaagaaagctggttgatgtgcacagagatgctcaaaagcttatgcaatcattggatggaatacaagcgaatgttggaagcagtcgtttggaagtcgctgatctgcttatagaacttgagaaagagaggtgctctataagaatattttacatttctatgggctaattttttccaatagctgatctaacgagatgagttacattccaggtttagtaagaagagaatagaggatgatttggaggttatgtcaaggaaagctagctctcttagagccaaggcacgtgaatcagcagtcctggaaaagcttcgtcatgaggtcaaggagtatagggggatattgaagtgtggtatctgccatgataggcagaaggaggtaaatgatcttgatttcgttctttgacactcttgacaatataacctgtccttttaacaatataacctgtcaaaagacactttaacagtgagcaatcaacattggatattcagatctaatatattccaattgcaggttgtgattaccaagtgctaccatctcttctgcaatcagtgcatacagaagtcccttgggaaccgacagaggagatgtccttcatgtagcttgagttttggggctaatgacgtgaaacctatctacatatgaggttgttaatttcaagatggtatcgcaggcatctagatcaagctactttgatggtcattacttggtcatatggttagatgaccatgcgagttgaagatatgacaagtactagcttgtacaaccaaacatataagcagaatgtagtagcctaatttggttggctacatggaattgcaggtgtctggcattcgtgatgctaatgtttattcctgctcccttgtatagttcgggattctcctggagtagttaagtcgctagattagtctgacttttgctatatccattctgttcttttggggaaaaaacatccaacaaaaggggtggtgcttcccgccatactgaaacattgtaccatatatagcttgtagttccattgttgtagcagacaataagaatgtaggtcttacgggttttccagattgtacatttcaggagattggcaatagcgaaatttcagttggatgcagtttgtttggtcttacctgaacggctgagtacctgaattttagtttttgttttggggctattaagctaaacctatgctgattgtttggttcgttgtacgcttaaaccttgatatgtcctctttttggcaggcgtgactgttaagcacaaagcgcacacccagaaatgaatcagctgtcagtgcgaaatcccatttgtgcactcaattttcaacctttcacttaaagtttgacatttgcgaaatcccatttgtctgggataggaacgctttacggtcccccaattccattggtgattgcattcaattgtagagctgcgtaatctccaccagctcttttccaacatctcctatcctctaacctttgcgacatgtgatgtgatacatccattttgtcttttgatgtatagtagcttctgacttttggcaacgtgacgctccgcatgtatgaaagctgacactgatcaccaagctcgcggacgatgcttagctttatccgtggagacaggttggtagagatggcagaagcatcctcttcttttccctacctatcgccgttctcttctttctttcatgggtgacgctctctccccatcgactctcatgtggcatgttgttgaatactagtaccccgtagttggttagcaatctgccttcgctgattcatctgataacaagctgaaacgagtagtcgttacggagaacggacgctcaagtgaagggtcacgtcgtgaaagttgcctcaatccggaagctaggcatcactcgcatttgacgctttgaggcctccacttctggaaatgcaagtgtccccctcctggttccctttttgggctccattccttgtggaaaagttgatgaatgtgtgtacctgtaacatgtgttcaggtcaatactgttctctgcgccttctacgacgtacagctagtcagcacctggagggttccactcagtcgcattgcattgtaatcatgtaaagccggggcgagtcctgactgcactcgatcaatcatcgcatcgtaacaacagagacatacccaaattgagcatttgactcgtggatagtgccatagtggcatacccccttcctgaagttgaacaaacaagggggcatcatccggcatgtggtttgtccttccagaacgttggagcagaggcagaggcgcagagcatttgctttgcagtttgcacagttccgtcgtccacgagacccacgcggtgatgagacgccctcgtcctcgtgcccgaaggctgtagtgcgggctgccaccttgcctcaccttcacctacccacctggtccttcaccggaacgaaatcacaaggagagggactgagggagtcccggaaaacggcgaagaagaacccagccgcgtgccgcgcgtgatgagccacgtctcgctcacgcccgcccgcggactcaaccgcgagctgattgcgtaaggtgacgcgcgccagcagttagccgggagcggatccgtggcaaattaggacgcgtgggttgttggtctgatgactctggcttcgtcggtaccccgcgggcgggcgatacggtgcacgcgcatgcgtgcaccaggccgctcgtggagaagggggatcgcacggcggatttcgcgtgcggcagcttgctcgggccgtggcaggaagccgagaaccgatcgtgcgctcgggctcgtacgcggcggcgcacatgtttctcccaccggcacactgggtccgacaacgaaggtacgcagtaggacatgggagggatcgttccggttccgggcgggcacatggctaggcgtaccgcgcgccacatatgcttcagcccgaccggatggaccgtctcgctcctctctagtgaactgcttgccttttacatctttcacaggctctctcattgccacggtataaattagtggggcgctttaacatggcggttaaggctctgtttctttcagtttgggattattataatctaaattattgagtaatctagattgttataatctgtagtaaaataagcggttagttgtttcttttctagattattagagcctagattattgggtttgcaagtctaaatagggagtggggtggtatggtgggtaatttttcatccaatattctggaaaaagctcacctaaatgaggttatcagattataataagttgggctacagattataataagctacttcaataagttgtctatttctttcagcttactcctaataatctggattataataatcccaaactaaaaaaacagggcctaattctcgatcatctgagttagtgagttacctcaggaattatatggctgcatagggaatttgcagtactactcagagagaaggcacattaaccggcatttccaattaagttccaacacatgagaaaaatgtggcagcgcgaatatgcggcagcagtgtccggtgtccgtacacgaacccagaccatagtaacgtcgttttgctgcttggaatgtggggttcaggaccacaaagctatagcacacgtagtaacgtctgtatggtccaggccctgaaccaagggatccgcccgagatccatcgcccttgcttgccccgggcatccgagacagcatcatacgggagtacatgacaacgtgttaatccattgtaccgccacatgacaacaccggtagccccagtttaaaccccacaccgatgggaatacgacagcttttaattacgcaccgcactctcactgcctgatatacttctgtggtgtatcgtgtgttctttatttgcttgctattgctgaaccgtcggttcctgtctaaggttttccaatttattttaatcttttgtggtgttatttgtgtcccctgcttttcatgttgtttatgcggatctagagattttttttcatatgtatacagtcatatgtctgaatgtccccacgtaaattgcttgtgctgatgtgcatgtatgaccacctctatatatgcgtgggtttatctatacacgttcaagtgaaaaggattgacaaagagtgaaaagagcaaaaaggcaggtaaaaagtagtactacatactattcgtacatagtagtaagatttttctttatcgtgagcaaggattcggattacccctctaatcttagcttagctgtctgtgatcatgcctacttggaatcgccagacgaaacccgcgggccgcggcaagtgtcgacagtcgaagcaggaatggacttcatatccctcacatcatctaccctagtacgtactactactggtactttcaaatcttttcacgcgaagtttcatatcgcctccctttctcttttgctcttttgcaagagcgtataatccagcgtacaacgtcatggatgaaccccgaccattggccgatcgggcaaatctcatggtgtctaatccctgcacgcgcctttgctccacgcccagttgtccactgtcccttttaattattcaccatgtcttctctaaatagtcgctgcccatcaaatcctccggtgggtaagacgttcctgtcagtctctggagctagctaacagcagctgcggctgtgttaggtcgatcgatcgatgcaacacgtgcacgggcgccacgcaaatctccttccaaacaagccagtcacgctgattagcggatggctaagctgtgtgtgttggtgccagatggtaataataacaagtggccactctgcagacgcatttccctgtctcttaaagctgggtgtcgatatgctcttgatcggtaaaaaggacaacgtatcttaccgtgatggagatagacggcctaactgtcccccatctccgtcgtttcttccattccggcgctgtacttttatcaaattaccattagctatcaccatttgtctacgtgcgtgcacagtatctcgcgtgacttctacgactcttatgttcggtctgatactctgatgagtgatgagaataaaccaactgctcatggtagcagttgccgccctcgcattgcatgcatgcacacatatgatccgtgcgtgcgtgcatggcatgacaaaaaagtatagcacaccgcgtctgcatgctaatggagacgttgatgagttgctcggtcgatcgatggcgacctgctgcatgcggacgtatgtatctggatcctagtaaaaaaatattctacgtgccgccgaacacctgtcctgctaatcacaacgatttcttaatttaatttcacttcttttgcctggccacttgttaacctatctgccctgttttggttaaaaggaatcaacgccctcggataacatacttatatggcggcctgcaaacctcaaccgttgtcgttttacatacttatacgtataattgtacgcgactaaacgggagtaggcatcatggatcagctggactccatgcgtagataagccggcaattagaatcgtcaatgttattaggactagtactagtgtcatttttttttaaagacgcactatccattaattgctatctgaaagacacagttttctttttaaaattttgaataagaatgtactagttcgtctataaacttgtggttgctaatgggaggtctcatgtggccaactttagtttggaaattctaaatcaattcatgatgacttgatttgtgcagactgaagcagattgggtgcagggtactgtagatatactgcaagtcccagtcctccaactgtacgtacacactgcatgtcaagatttcggcgatcgacgatcggttcatccccgacatgacgcgcatgaaatttgtgggaattgatttggacgtgatgcaaaatcaacgtcggggacaacgacggcatcggaaaggaggcccgcgatattcttctctacacgagcaccgctttcacgtagaatttcttggccaaaagctggtgtcgatcgaaggctcgatcgctgcatgctagctaagatctcgtcgcgtcgctctcagggtgccgatccgatattcaattccagtggttggttgccgatggccatcagcgtgacaggcacccccgtgaaacctcctccactggagacaaaattatattcaggtgatggcgaatttggcgtcgacatggcaacagcacaagggagaccagtgcgtttttcagttgcttctttttaaccagttgggctttctgcattgtttctgcgaacgagcacgtcatattgatcgactaatagtagtttatattgcacgaagttagataaaaagagaggccacgccattactgtggaattacagcgagaggtgtcctaattggcacgataatgatgccaccaaaaggtaccatatatctctgttagaaaaagtactaatactatatctttggcaggttaagcgttagtagtacgactttaggcaatgtgtatatgtggacagttcatattcagatacagaatactgttcgaaccaggcatgcaccagccgttaccaattacacaaacaggggcaggattggaaggagaatacttggagagaacgaacggttttaagaagataatgatttgtgttccagggattaaatacacaagtttaggtaggataaacagaaactaaacagaagtcaatggtttttttaagcttttgttaaattttcttctttattattcaattgctcaagctacttacccagggctggttgactcgatgcaaatgcttgtctagttgtcttgcaaaaaaatatcagggttagttggacaggaatcattcgatttgatttactcctccctttgattcctactacctctgtcttaaattagcagtcgctttaacttttttcttgtaatatttgatcattcatcttatttgaaaaattagtataactataaaaacagagaagatatacttaaaatacttttgataataaagcaaatcacaaacaaaataaataataattctataattttttatataagacgaaagattaaaagttataaacaaaaactcaatgacaagtattctggaacgtagtcagtagctgccttttcccaccatcaccaatctgatgaccaacgcaatctgatgaccaagagagcatcaggccattctagtgcatcacatttggcatcagaacagaaacacgagtcaaagaccaaacagcattatacgtatgcggcagcatatgttcttgttttcgaaatccaaccaaaccttactacagtactcttatcaaaaagagtgaattacgctttggaccacattttattacctaagttttactttgaaccacccttaaacatatcttttcattttagaccgaataaatttgctattgttacgatttggaccaccacgaacaatttttttaagtacaattaatgacgttaaacacattagctctagtatacggccgaacttctctatgtgtggttcatatgtttgccgaaagggaagttagacatgacgagaaaagttgttcataatagtccaaaccgtaacaatggtaaatttacccggtctaaatttaaaaaatatatttaagggtggtctaaattaaaacttgggtaataaaaggtgaaccaaaagtacaatttactctatcaaaattaaaaaccgcaccgtgatgtgcagatggggggagggggggtcgaggaaacttgaaacgcgccaggaggagaacgcggcggggggcggtgcggattgaccaccggccacgcggcggggagcgcacaccgatgcgtggacgcgcgctagctgccgcctgcgcgatacaccgatgcgtggacgcgcgctagctgccgcctgcgtctgccgcctgcgccccccatcgcgcaggcgacagcagcctttcgcaccccccgcgtgtcgatgaaactccatcaattctccgtacactagcgatcgggcgacgtcgcggcctctctctggccatccgtgtcgctagccagccgcggccgggccgcccaacccagcttttcacaatccctgtgctgcgtcgggcgcatgcctgctgtacggaagaagagcacggcgacgcgctgctgctgttgctcatgctctttagcgccaggcagcgttgctcatgctctttagcgccaggcaattttcattttgaccgagcaacgccaaactcaaactactactcttttcgttccaaaatataaacatttttaacacagtgacaaattaaatatttttaactttgaccactaataacaaaaaaaaataaaaaatcaatcatataaaattgatgttactagatattatttaaaacatctaataacatcaattttatatttataaatattgttggttaaaatagtatctcggagatcatgtaagagtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaattcatgacataattagactcaaaagattcgtctcgtgaattagtccaaggatatggaatgtgttttgtaattagtgtatgtttaatactctaaattactgtccaaacatccgatatgacatggacttggaataagtctctggaaaccaaacaggccctaaaaatatttatattttgtgacggacggagcagtagtactaccgtggagtacgagtactctacttctactgcctccgtatggtccaacgacctcgcttcagtacgggatgctactagcctagattacgagctactactaggcggcacataagtgtaacacaccctccaatctccgtgagtgctttgacttttcttttgttggtgaaactgcaatcaatcatatccatgcctatgccatggccataccaccaataatcaggcacaagcaagcacaaagatttggttcgtagtgtcccccgcgtatgccaactacacgctcatcctgatccgaaaccgaaacatagtcagtactagaagtatgaaaggggttgcatctagaagaagatgcactttatgcatgcattcctactacttctactgctacactgtttagttctttagctattgtagcatcacattatcaaattataacgtaattagacttaaaaaattcgtctcgtaatttacatgcaaattgcgtaattgatttttttttcatatttaataaatcatacatatgtctaaacatttaatgtctaaacatttaattttatatttttaaccaaaattttttggatccaaccaagacctgcctaatgtacaccagccaggcaacaaacgggctgctgctagtatgctccatcctccaattctactcgtaccgtcaaaagacccagctcccaagagctgagagacttgaaggggatgcccctagacagtgacaagatgaagccaacagctcctcctctctctctctctctctctctctctcttcagtcctcacagcagatgcgcagctgtgtcccatggcgagcaagagagagcgccgtactgccgtcagcgtgcgtgacagtgcctccagattggtggtacgactcgccagcctgtaccccaagcatctggtctcgccagttggacctcattaccacgaacttgccatgggatgggacacctggctcccccccggcctgaacggctgaacctggtcgccgcacgcagggatcgtaaacacccttctcgccgtattaacaaaccggttcgcgatctaacaacggagaggccgagaccgtatgcacgttggggaggagacgaaaaaagggacgggaaaagattagcccgtcgctgcacgtaacgtgtccgatactccaaggaaattggcagtggcagcacaacacacaccatatggccccgatcgatcagtctttttttttttttgagttgccccgatcgatcagtcattcagcgatggatggcatgcacgacgacggtctttattctccgcgaccttttttcatgtggttttctcatcactgttgcttgaggagcagagcagtagagaagcatcaatccatgttggtctgcgtctctgtgccttgtcgtcgtgccgccatgctcgacagaatcttccttttccatgccaatgcgagccaaatcaagagctcctgctaatgcacggacagttggatactcattgcaagtggttgcacggatcgatcgacgtaggtgtgccgccgtgattttagacgtattctccgagcacgtatctccagttctccactggctagttatggcgggaatgcatgtatgcagtactctgattgattctggaacgtactacgactagtatttctatagtactatactaatagtgatacaatccgtatacttaaccccaatatagattgaaattggacagcggagacttgtgcttaactcaagtgtcgtttccgacgaggatccgacacctgcctgaccgcggaatttataaaagcatagcaggagtattgatcaccacgaaaatcgacaggcttacgtgcacaacgtcgatttgggcaaaggatttggggatcgcagaaaccgcgattcccccatgaatgcgcccccactgcaaagctatgagtattcaatttgtgcctcagaccatcggcaacgacgagtcagccggacctaaaggaaaattgttcacgcaatccatccacaaggaccgagttaaaagcagggtgggtgcagtgggagtaggactaactggtatagtacgagagtaggagtactcgttaagatgttaaccccgggacaagttgttggtaggcaaactagcggccaggttaggctagttaacccagcggatcaagccaagccatccgtctaatccgagccagccttcccccacaaggatcaaatcgttcgcgcgccggcacatggtctcttgcacgaaagacaatcatcgggccggcagcgcggactggtcacgcaccgtctcgcaggcttctcgagcggccgcattggcgtcttccggagctcgcccatcacccacgcgcacgcacacgttcctccaggctgacgcggcgcggacaggcgagccgccgtggccgcgagcgacgacgtacgtacggcgggcgaagcgtggcccgggctgtgcgacgacgagacggcattaactttggcgtagccgggaagccgctgtctttacgcggaaaccgtcgctttcggggcctttatgcgctcccgctcactgccgcgccacacgtcgccatcgcggcgcagctctgaaggcagtgtgcagtgcagtcgtgcaggtccaggacgacgacgagcgggaggagtcaatcgattaatcgctagcgcgtctcttctcttttcttgtttttttgttgttgttgttgttgtgctgtggttaaggtggagctggaaggctgggacgattttgaatggcgtggacgaatcttaccgtggcttccaaggccggtgacgagctgctaaaacaccggaaaggtgcaaatcggatgcgtcatgcgtgaatatcacactgtccatttggcccaaatcttgctggatcactttttaccactaaacaaaacaagctagaaaagggatagtcgaagataagatgcttgttaattatacatattcttgtcccccaaatcaagcaaggcgaggaaaaggaactgactttatacaacctcgcatgctagatttggcaaagaaaagaagaaaaaatggaaggaaaaaaaacaaaatacaaagggagaaaagaagaaagagaacagagcagaagcagagtaaagaagaagaaaagaagcaccgccatgtacaagccactgatcgatctaatacacggaagcatgactggctcccatgagcagccacattgatcagtaatcccacagcatgggctcctcgaggcggaacacgacgccgccggccacgtcgtcatcgacggcccacgacgccccgcacgagaggctcgaggacgtctcgtatctcaggtccaggagcaggtccgggaggtcgaacagcgtgctgtcagggtccgcttcggcgtccggcggtggcggctgcggcgaggcggcgctggcgacggagcaggtgtcggggctcttggcattggcgtcgacggagacggaggggaagtcggctgcggcggcggcgagcagcgccgccgcctgcacgtccttgggcgccgcggtggccgggcgcgggagcaggtgcgcgaggtccgggaagttgaggtgcgcggtgcggcccttgatggcgagcgcggccacgtcgtgcgcgcgcgcggccatctccgcggtggcgaacgtgcccagccagatgcgcgacttcttgcggggctccctgatctcggacacccacttcccccagctccgcatgcgcacgccgcggtacgtcgggtgccggccgtcgttgcgcggccgcttcttcggggcgacggtggcggaggacgatgatgtcgacgtagacgaagacgacgaggacgccgtgtcaggggaggtcggggaggccaggtcgtgggagtcgtccatggctgccgcggtggtgcgggtgtggactggagtagttggaggcttggaggggagcggagtggagagggcaatggggttttatggtgtggcgcagtggcgacgtggcacgggaagataaacaaagggccatacctggtttgtgggccaggcctctttttcctgttttttttttcaattttctgtttgagatgattagtagtagtatgacacggctggaattaattttcttctactccctccgttccacaatataagagattttgagttttttattacaacgtttgaccacttattttatttaatttttttttgccaacataaaaaacgaaaagttgtgtttaaaatactatagataataaagtaagtcacaaataaaataaataataatttcaaaaaattttaaataagacgagtgttcaaacgttgcaagcaaaatcttataatcccttatattatggaacggagggagtatataagttcaatgcaaccgatctacccgtgttaatcaggtttatggcatccaggtcagtgtggaatggattttttttcggccaaaaagtgtgaaatggatttattgcattgtgcacagcaatgtggtgcaaagatatttggaaacgtggaggcaagtgttatctctaaactgagatttactattttgtcatggttcaattacctggatatcacatatttaaattctaagctagacagaatatgctttcaccctgtcattttcctgagtaaggggacccaagttcaaatattctttcgtgggccatttatgtgtatatatgttgaggactcgagaaaatcgtcatgactatcatatttcttttgtagtttaatgcttcccaacaaattaaaacatgttcaagaaacgtttttttgttggtttccaccaaacaccaaatttgcaaaagagaacaaaaatactactactcattttcatcttataagtcattttaacatctttcttaatcaaacttaaccaagtttgattaagtttatagaaaaatagtaacatctaaaatatcaaattagtttcactcaatctagcattgtatatgtttttgtaatttgtttgttttgtgttaaaagtactactatagtttttttataaattgtgtgttaaatctagaccgtgctatgtctaaattcgtagttataaacgtcatgatttaaaactccagcagatacatgcatgtacgactctataatcacataaatgacaaatccacataactcagttttagcattataatgcagattttccgcagggacacgcgaaaatttcatttagttgagcaattctaggtgaggatccttggtggaaacaagccctatggtagttcgtgtttttttttttgtcaagatatcctataacctgtcccagatgggaaactaacaaaactggttgttggtagatcactgctatataaacaattttttttacgagaaccatacaatttgcaggcggatagtaagttagtaaccaatagcctctacaaaagttgacctgcattttcgcgtacggtttgttaagagacccgtataaaaaacagttttctcaagtgggtctcttaacagagccacatacgaaaataagcttattttcacatgcagactcttaaacgatctcacgcaggcgaagcctcttaaagctatgtctgcaagtctaatcacactcatctcttccctcccaacaacttcaaattttactaaggcctagttctatttctcaactacaatcttcaacttcctcattttccgttagcacgcttttcaaactactccatccgtcccaaaatataaacatttttagctatgaatctggacaactgtgtgtctagattcatagccaaaagtggctatattttgggacggaggtagtattaaataatgcatttttttaaaaaaaattatatatagaatatatttaaaaattcatataaattcattttaagtttataattattaatacttatggcatgtttagatcccaccccaaaattttacaccctattacatcgaacgtttaaccacctgcatgaagtattatatataggcttaaaaaaactaattgcacatattgcgactattttgcgagacgaatcttttaaacctaattgctccatgatttgacaatgtggtgctacattaagcatttgctaatgacggattaattaggcttaataaattcattctcgcggtatactgacggattctgtaattatttttttattagtgcccaaacatcccatgtgacaccctatataatatccgatgtgagacgccaaaactttacacccctgaatctaaacaccccttaattaatcacgtgctaatgggatttctcgttttgtgtgggtcaaaaatatctctcaaaacaaagagatcgaacgcagcctaagcctcaatccgtatctcctcaacttctctcccacctctcattcccctaatccctccccactcattttctctctccccacacattttctctccgtttcttctcctggccggcctctctaccaacctctcctcaacctcctcctcctcctctctctctctctctccccaacctcccctcggtggcatcggcagccccaagcggcagtgtgtcgatagcatgggtcgtagccatcccgtcgccacagctggatccggtggcgtgcggcagccgtcctgtcgccaccgctggatccggtggtggtggccctccccgcacagccccgtgcggatccggtggacaacataagcacccgtacatgaaaatcggattctcgcacgcaggtgagtcatccgcatgaaaaaatagtgatttttttagatattttcgaacagacgtgtggatcaaccgcacatataaataggttttacctgtttggaaacatacttttttaagtagtggatgttgataagctatgcgtatctacagagtcctgtattttatttattttttaaatatgggaagctaactatgagcaacttcattgaagaagtataagactgtttcacctactaataatagaaggaagctacagctggacgtttttcgtatactcttccaatatagcattgtgttctctctaaattgtaagaggttgagacgtggttttttcttatatttcgtgatggagatagtagtagattattacggatgacctcagttgtagtatggtgctaacaagaatacggtgggcttattatgattagattgagtcaaggactgctaaacaaggcccccgtctgcagtgccttactgccttgagccttcttaatttccaccatagaacctacgtatacgcacatcgaagcgtggcgatcgataccccaaggaagaacatatcgtcggacaaggcgaagtccatggcgccgccggatccccacccaagtttttacacgggcgccgccaatccgttcaggccatgccgtgcgttgatcgatcgatcatcgatgcacgcgccggcggtcgaagccaccacgcttcgtcgaccgtggccggcccgctgctttggacttggacgcagagttgagttgccttgcctgggcatggcgcgggccgtgtcgtgtcgcaagccggccgcgactttccacgctcgtgggcctgtgaaagtggggacggtgtgggctcaaccacgcaccgctccgcgcatcacgcaaagtcgcaaaacacagcttcccgtaaaactacttcgggcgacttttggttgacctgctacaaaaaaaaaaaaatcctgctccttccaccgatggcctggttacagatttcagcctttcaggtgtagaatcgcatagaaacggaagtgagatggaacgagatgctccgcgtagaacggacaagtcactcgacgatgagatggcacgcgacgcgagcgcccccgcggtctcacaggcagcaacgcaccaactctcggctctcgcacactctcctcctccgtaatccgtatctatgctgattgatgcagaaatagctaagctacaagttacaaccaccacatactgcaggttgcataatcgtcaaacagtacatatattcctacactgttgccgtaccatgattgggcgagtccgcattctgttggactgctgcgagcgcgagcacgcgacgagtatcacagtgacacgggaacgtcgaaacggccccgcccataacgctatcatttaagaacaaacgtacgcttccaatctccatgtctcctcattcccgcgtcctgtatatgaccatgtactactgtactattctcctctctgctcttcacacgctgtaattctaccggccatatgagacataagaggaggcgtaccactgatcaatcgaacactgcttccgtttggttatgataattaattagggtgagtttgaggaataggggattgagaagattaggaaaatatgaaaaatgaggtgagccattagcatgtgattaattgagtattaactattttaaattgtaaaaatggattaatatgattttttaaagcaattttcctatagaatttttttgcaaaaaacacaccgtttaatagtttaaaaagtgtgcgcgtggaaaacgatatgctatctcactcattgtctatggaactaacgcacccttagagcaagtataatagtgagctataagcttactgtaaacttatgtggaggagagaggtaacaaaaaatcaaaggggttggctctcatgcaagagctagcttaacacaatctccaagacaaatacattaaatgtataagtgagagataaagagaggagaagaaaattatagccaaccttatagctaatattattatatatgttggctttaagatgaggtgagctatactattatccttgctcggatgggggagatgggaacccaactcctgcgcacggaaaacagaatagtccattaacgcgtgattaattaagtattagctaatttattttaaaaaaaatggattaatttgatttttttaagcaactttcgtatacaaactttttttaaaaaatacaccgtttaatagtttgaaaagcgtgcgcgtggaaaaacgagagagaggggacgggaaaaaggtgcatgcgaacacagcattagttaacctgtcgccgatgatgatgtaacatgtgtgctacaggtagccgtgtgtcctctgcaaacgtactgtactaccctcgctaggctccggcttgtgcattacacgctgtgatgactgatgagtaacccgtctgcaacgatcgtcgctttaccagctgtatctaaccgttcatcccatacgtctgtttctaggattcttgcaaggaacattgttgggtagcccagcaattaatgatggtaccatgtacttggagtagttttgatttaaccccgtgtctcaaagcttcaaaaggaatagcaaggccaccatcttctaactcgagtacatgtgtaaatagcttcctcttttggtttgtcgagagcaggattttctcagcatgtcgacggtaaacccagcattttcaatcacgaaaacttatagctgtgtttaagaagggacgaagggagtactttgtagcagatgatcatataacagtatagtatgaaaggaagagacatacaagaccatgaaaatgtttcggaaacacatcaaacaatagcgtaattatggcaacactgaggtcgaggagtggaagatggagattggaaagggaggtataaggttgtgggcatgtgtcgacataacataactcgacaaatacccgctaaagtctatgagctctcacttcatggtatgtggagacccacagcctcatcttttcgcttatgcttatcaactaaaaattgaattttcaactttaaatataaagttgatttcggtgttttttatcgaagtttatttttcaacatttacgtttatatagttaagaacatatatataaaaattttattcataaattattttttgtttgtaaatatatcgtttggcttattccccgaataagcgtaacgagggatccctagccaaaaattgaaaaacgaaaacgacgaagatcatctctcatctagaacttggacatgaagtaataaagggagagtagttttaggtcttaaagaaggtattggatgtatcttaattttaggaggaaactccaaattagacatccgattttctgtaaaaaaaaaacggacggtcaaatatttcagttgaccacccgtgaaacattaaagagagaatccattatatgccactgactttgttacacctctacgatttaccactggctttgtcacgttctataatatgccatcgactcttgcttaacttctacgatttaccatcaccgtctggttagcctccgttagcattgtacaattttgtccaaataaccaaaatacccctaggacaaagacttccaaaaattggataaaattatcaaaatatcatattataaatataagattgtaaacatccaaaatttggccaaaaatttaaaatttgatattttagaatttgtatccgaattttgaaagtttttgtctcaggggtattttggtcattttgacaaatttgtacagtactaacggagactaaccggacggcgatagtaaatcgtagaagttaaataaaagtcgatggcatattgtagaacgtgacaaagtcagtggcatataatggattctctcaacattaaattatacacgatgaaaaaaatagtcatttaaacatttttatttttttaaaacacaacaaagatatacattgaaagatgtcgcaattatgtattcaacttcgagcgttaacggattgaaacatacggttttttttcatcaaaatataataatgcaacatctatttataaatatttaattacaacaaataaatagtgtgagtagatcgtagattgaataagtagtttataagaaaaaaatatttaaagaaaggagaagagaataagagaagaagaagagaaactagctagctgcacatgcgtgtaggggagtgttagggggttcgatttgtttctcaatcgggcgcccgagggtgagaaatctccaaatttttaatgtttacttatggtacattttgtcacttgacatactcccttcgtcctaataaaaatgaatctagtactggatgtgacacattctagtacaacaaatctggatagaggtatgtctagatttatagtactaggatatgtcatatcatctaaaagttactatattttaaaatggaggaagtattttaagagctgaggtagattataaaaggatctatggactctggcccattaccacccttaccccgggtcccttgcctcttgagtattgatacccaagtctctgcaaaggtagagctactgtttttaaagatcaagaatcgtagaaaatctttttgcatgacgtgcgtgtgtaactagtttatactcccaatgaatctaggcgctacatcaactttattagaatattatagtactctgtaaaattacttgtaagaatcttaatgtacggaaattgtatatgcttagaaaaaaattatttaggggacaaggggcgaatatataatggcgtgttagagcataaaacttgttaaggatcattaattctggtagctccccacaggcccacacagaacatactccagcagggaaggacaagaggttggcagattaaactaacggaaaacagagaagctacacaaattggcttgtcttattttgtggcctttactgtccagcacttaattatagcttctattctcgttgtaaactaaacacccagttgatcttgatggttctcaaataaggaaatgggcacaaaatcttgagatctcttggaaagatatgctgtggtatttcttcccttccaatcaaaaaataggcacctaattaaactacttatacatattatactttacgttgtaccacttgtcatgcataaactacattttctttataattgcataaactacatactccctgcattcctttttacttatcatcttttctcaaaacaaattataaatattgaaaaagatgatgtattatcgaagtaatttgcatgctaaatatgattattatactatttgtgttcaccaaaacatcataatttaaaagtttttactggtcaaagataaatttacactggtcaatagtgtcaaataaaaagaatggagggagtatacaaaataaatacttgcatatccacatattattcatatataggccttcaaagaccgaaacgtgattattatctggcttcagcctgtaatgcagggatatttgctgaatccagatcgaagaagaagtttgtccagaatttaaaccaaatcgtactagtaatatgcccgtgctaaacgctacggtgcaattcgatttatctttaataattgttaaaatttcatgttagcggaaatttttttctatgatatgtgcatttgaactttaattcaattcatgtcgtacattaaatatatttattttacgtaaaatataataatatgatactgcatgggcacaataaatctttacaagaattaagtatatataatcacttcagtatatagtacgctattatgttacaaaagtgagttattttattatttgttgcggaaacaaaataaagcattatttgcgatctggaggaggtgcgggagagaggctgcagtggttggcgatttgacggaggggaaaggaaaccgagtggtgaccgcgtgcgcgattatttgtgatccctaatacattgcaggggaaatctgttatgtgctgcctactcaaaggcagaattttctaagccaatctcattgtcatccaaagtactactgtcaatgaactgacaaaagaattgatgaaccaaagcagtgacatacttctagacaaacaacttgggcgaactgagagagctcccatggttataacatatggaaactgatcctacaataaagaaaataatttacactgtaatataagaaaacaacttttctgctacttgaggtttagaaactgaacttgaggtgatgtgtttagaaactgaacttgaaaccatggttctggtttgatccacctgaacatctcatggttatccataagtacaaggcaaatatgagtagatggctaattcgctatggagcaaaataatactgaaagactggaggtggaggttaccttctgttgtttttatgtaatgaaatatgtgacacagaagatctcaagaaaagtttctatgtacggataagggctatggcttataaacatgttcatgttttttttccggtttgcaaattggtattctaacctggaccagaaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggacagacggcggagatgagacgaacatgggtagatgcatggcaacctacggagcggcgacagttagggttgggagatgccgcagcgatgtggtggtggcggtgcgtgtggcagtgccggttggtagtggccacggaggagatcggcgtggtgtcactggtgttgtcctcgactgtcggtggcggcatggagatgtcgagggtgggctttggcggcgccggtgtggccccccgaggtggaggttgccggatgttgtatcaataatccctaatcctatacagcaaaataagaaaatcaggaggaagattacggtggtgcaatgtttcatgaagcttattgcactttgcttaaaaatgaaccatcttggtacataattagccaaaagcttactgaagtcataagttcatcttgaccaaatctgtcaagaatccagaaacagttggattgtcctaacatatgcatggtgatggtgatttcattaatcaaggaatgaatctctactatactgataattgacatagatggtgcatcatcttaaatattctgtcactgccagtgaaaatcgaattttaaggtttgatttctgaaatgtgtaaaatcttaaataaccagatactatatattgttctttggagatgtttagacatgtgcagacagttatgcgttgttcatagacatggatactttagttatcattatctaaaaacatgaattctttagataccaaaacgatgctttcggttttctttcttttgattgattctggattatattaagaaccgtatgatcaaatcagcggcgactgatggggagagaggaaatatatataatactggattgtggattaaaaaaaggagagaaggatgatttctgtaccttaatttcggcgaatcagatcgaggatggggcgacactgttctgaaagcagagatcggtggttgcacggagacggtcgacgagccggagattgggggcggcacgaaggagaccggcgacgcggagttcctggtggagatcgggggcggtgcggaggagaccggcgagaagggcgatgaacggcggagtggcgagtagaggagacaactggcggggtgggagggcgggtgcggtgtgcggcgcgcgacggcggagtgggcgatgccgtctggacggcgggtaggggcgcgagcgtcgggagacgacgggggcggcgacgtgcataggcgtgatgggcgagagaactggcggaggagatggatttcgcgatcggaaggaaagtgcgacgatttcgggggtgcaggggtgagggaaggcggatgctattctggacgtcaaatctcttagggataatctggaccgttgagtgacgaatgaaagaatgagtgaaagtatttgttgaactatagggtagatgaggaatgaattaggggagactcatttaattcggactttactcagtacagtaaacaatgtatggcgacaaggatcattaactagcgaagctattcgctgggttaccctttttgacgttgctctgaatctaccttgggtaacaaacgtgtgtgtgtttagttcacattaaaattaaaagtttggttgaaattgaaacaatgtgatggaaaagttgaaagtttgaagaaaaagtttggaactaaactcggcctgtattccattcacttatagcaacatggagagtacctactccctccgttccaaaatataacaattctagcattcaaaatttatctgaatatagcaactttttcacctacattctcttctcaaccaattataatcttccaccattcaaattctccaccaactttctctttctcaacccatcacaaattttttccatttaatattatctatttttttaatactcgtgtccaagcttaaaactttctatatcttgggacaaaggtagtagctactatctacagggttacaggtccccaacttgtcacacagttgcacttttaggagtgtaaaatatgctggcgatttggtctacacacgtctccaatcccctggccgcacagaaatagtaaattaagaattatgaaaaaccgtcaattagaacgtacttacatcagactaaccccatgcatgtgtttgtttattctcgcagtcaagttgaagcccaataattggcaaacaaatcgacttatgtgcgcatcaaatcaagcatgttaacccaataatatacccacatgcatgaaagcacagaaggtgccatttccatggcgtcccgcaagccagtacaaaacggcactctagatgccgcctaaacagtaaacaattaactcttaagtctctacagcgacaccgatgtactgatgtactcataataatatgcgtgaattcatggaaaaacttggattgtgcatgctgtcgtcctacgatcccgtatgctccaaactgtcgccaacacacttctggtccctaaagctaattaacctcccaagcacatgtcttttttaagactcacatgccgattctttaatcgacgtaatgaaatcgcgctagaaaccaatggaaaggccataggtaccaggaatattgacccgactcaactaacctcatcgcgagaaatttgtgtgccggccggcgtgtagatttttgtagtttaattaattaggtgatgaggcgggcgctaactattgcatgcatccacatgcatatgggttaccaaccatactaaaaacttttcagccactaactacaccttaccgtctccgatctttgtatgtcatgaccaatctcccggccgggatggtacaacttagtagtataaggctattcccaacctaataactaagatggtgtccatagcattaaataggctgccatctaggatgaaaaatgatgtggcaagtgaataaatgagaaaagagaagaaaaccatgtcttgcatgagacatagtttctacacaatatccaagacatcatgtgaaataagtagcattaaatttaagtatggatagtggtgtttgcattggaagagtagtgtctagtactaatttcttgatgatgtagagtttatgaaaattatgtatagtgttttgggttgggaatggtctaatactccgtattgatgtagggattgctcatgatggttcatataaggtcatacatgtggaaaggagccattgggcaaggaagaaactttaaaggtaaaacggctgaagacaagaagagacagaacggtagttagctcgttaattctagaatatttcttgtgcgttgcatgattgtgtccattgcttcgtttatttatttatttttggggacgtgtaacgtccatagccaaattggaataacaaacttgtgagtatagtgttctggcagtgtggggctcgctagctaagctagtttgtggagagcgagctggcttgattaattatcttaattaagaatagcacgttgttttatgaaattaaacaacacattgtcaaaacggggccaaatgatatgttacaacaaaaccttcaataatataagataattaaaaaacatttgataatatgtcatccttgaggtggtattttcagtttatgagataccaaacaaaatccaatctttcgatagtaaggatgtggtgggtatttcgaatcttccccggcgcaccccctatcaagagtaccacatcatacaacttgtcaccgctcttgtccgcctgcattaggatgccatcaccctttacattctccttagtttgcccgcatccgcaacactgttttggcgttggacggcaagggtgctacgtgctcagattcagtcggtgagcttgtggaaggacctttgcatgaggtggacatcgccaacaagctcaaatgtgcgagattggagggaagagcggagcaggaggtgaagattgtcggcaactccaggttgatctggctggctagcttggaggtacgagcttgtatctcgtaggcgagattgggaaagggtcaagcgggaggacataggttatcgacaaactcagactccagccgatccggtgccacctctccctctggcatggatgatcacgttgcctctccgccccccacgcgtgcgggtccactggccgaggcgatgtgaggggcggatcttgcacccttccctcttctacacagatcccgccacctctccacctcccagcccctccagtgcacaaggatccgtcaatggcggtgacaggaggggtggatcctgtgctcacttcccctttcacgcggatccgccagcctctctacccctaatcactccgccctccacatgcgcgggtccaccggctgcggcgatgtgagaggcggatcaggcacccttccacctcccgcgcggatcccacctcctctccacctcccaacccccttggtgtgcaaggatctgtcggtggtggtgacgggaggggtggatccagtgcccgttcccactctcaggcgaatccgccagcctctccgcccctactcgcgaggatccatgggcagcttcaagcgacttaagtacctgcatgcgaaaacacaatttccacatgcaattgctgtacccgcatacagaaatagtgattttcgcagatacctaggtgcaggtgagccatccatccgcctgcgaaaatcaattttgaccagattagaaattcgtttatgtagtagtatgccttactatggatgtcaatatttgagtgtgaagctatatggtgaactctagcagttgcatgacttattggagtttaagtgtaggccttgggtgggggatggggttgagcatgtggtgaccagtggggccaagaggcaaatagtttttaagagatgaaaggcaattaatggtgatgaatcttaccgttcaaaatagggagccataaattgctgatggtcaggaggttgcgagtcccatcagttagccatatacggaataagccgttttggtttattagggaataaaaattaatttattgataattttttatatacgtgtttttggtaatttaaaaaccaatactgaaaaagaactatatatgttgaatatattttaaagtcaatattaaaattaagcttgaaaattcaaattttagctttatctttagctaattagggcatcccaagggagtcctgcaaaacatgcacatagatggtggatataattgatggctgatgctagctgatgaagtgggttagggttgggtagtaattgattgaaactcttaaatggaaattaaaaagaaaatgtagccccaatttgtttggaagtaagaactttgacagaaaggaggatcaaccagagagatgatactcccttcatctacttttgatagtcatatttcatcttggcacacagtccaaggataggtaattctacttatcatccgtttaaacatgctactagtcattcctcgtaatcaaacaattcattaatatttacatttctcgatgcccatgtagccaatcttgtgtggaagaatggagagtcacgtattaaattcgagaaagtcattaagacgataggttgttggattgaaatatgcttatcaaaaataattttttttagatttagaaatatgactatcaaaagtagattgagggagtatatgatagacactgggtcatcggctaccgggccaaaaattgattggctattaggctgtgtggagaaaatgtaaggccgggcatatatagacaattccaactcaattattccctccatctatttttgatagtcatatttcatcttgatacacagaccaaggataattaattctacttatcatccatttaaacatgctactagtcattcctcgtaaacaaacgattcattaatatttacattttctcgatgctcatgtagccaatcttgtgtggaagaatggagagtcatgcattaaatccgagaaagtcattaagagaatatgttgttgaattgaaatatatctatcaaaaataaattaagaggataggttgttgaattgaaatatgcctatcaaaaatatgtctatcaaaagtagatggagggagtataatatttagtaaaacaatatatatgaattttattgacatgtgacaaaaatcaacatattggtccaatctttaactaatgatgctatcatcgcctcatcggagtggaagagactaagccaagtggtcagtaacactctcaagttgacctagatattgacagaaagcatctaaaataaacatagtccgtgcatgctttgacaaaaatggaaatattgtccatgcatgcatgcattcaccgtgccggcgttgtggtcagtgttcccagagcaccagtggctcaccaaagaagaaatcgtcagcatcgtcatcccacggcgaaccgcaataatacggcggcggcggcggcggcaacgtgaacccgaactctagaagagcatctggcatggtgaaatacgtgtagtctagtccagtgccgccgtcctgctgcagtgtcccgttctcaacgatgcaaaccggcgccgtcgcctgctcaggctccgccggctcgggctcgtcatcggcagcggcgtcgacgtcgtggcatggcgtg

SEQ ID NO: 74776 - DNA, 6823 bp, Oryza sativa
actctctctttttttggccttgttttgctgtatttttctctgaattttctggcttgcggattggcagtgtccttgccatgtcctggttactattactgtttctccccgtactattcgacgaagatgctgcttgttcggaatgatatcctgtaactgttacgtaccttgttacggtcattgagtttgcatatgcattcatgttgactttgtagcctagagtcattgaagtttgttgagagagattgtgcgtcctggttgtgagatattcgataaattgtgatatttgtgctgctaatttcgacctcaagttgctgcgcaaattgcagttaactgattaactcattgcctaagctttattatagaacagttttttctgttggactactgatttggcctttgttacagatttgttcaaaagtggtgagaattgacctgttaatttccactgccgattattctacatggaagtttgctgattgtgactgcattgttctattacaatactccagttggactagcatgtgaacccctcatattgtccaactgaccacatgtggatgtcgacctgagttgattttgtccctgttatggcttgttggccgttgcctaagaacttacagtttcagagaatgctagctttgttctgaagaatttgtcagctttctttgtatcctagtggtccatcctttcccctctgttctgagaatatcatacctgtgctggccagattgagcatttttaattgtggagtttagtaatagatattcaatttaatatggtatatgattagttgaagtaggtagccatgttgggccaggaagcttagccattattgagtcatgtaactagcaagagtatataatattatgttattggcactaatgaagttacaactaatcatggaggaacaaatatggacataacaaaactagaggaacattagtgatgttgtaacttataagtaccatgcaagaataacagtggcattattagtggaaccaatgaggtgattaatggggtaataatacatgcatctttcagaaaaaaaatgatatttgaattcagtttgtcatttgataacttaagttactggtagaattggcatgcaattattgttactagatatattttccgtcagctgaaatacatgctctttttgtcttgtgtggtcttgattcttctagtatttatgcatcttcaactgtttctttaggaaagatgatggtgtgaaggtggtctctgtggagaatttgaagaatccttatgaaaaacaagggaacttcaacatgcgattcaagttgactcttaacaagctgtatgcatggagcctagtttcctatgaccgagttgttatgctagactctgacaacattttcctccagaacactgatgaattatttcagtgtggccagttctgtgctgtcttcattaacccttgtatcttccatacagggctctttgtgcttcaggtaggattacttgctatatgggtttctcctttcttctgcaaaatttcttttaactttctccatgtaaggaaagatattagctcttaatctcttcattactaggaatgactatgaatcgacctcctttagtccattgcatctacaaaggcattctgttttgtttagcacttcatattaggggtgatctaactgccatttgataagtaatccttcattattgtttaattaaaagatctatgcagttttgttgccaactggtttactgcaaatcttttacctgaaattaataagcttggttttagaagctgcaagcttatattgaatctgttttcttcctggatattagtctttagctttctgttggcctttctcaaagcacagatgtatttttcaggggcgcgaaacacagaatctacaatacttcttaaatctaaacctatctaatgcacgggccaattgctgttttttttggcacaatattctgcagtaggcaaattcaaaatggttatgacaactcctactttgtgcactcattttttttgtcatactaaccagttgttacttattaatcaacctgattttctctagtccagaaccatctaaagttcatcaaatgaacctgaatattgaaatttatgtcgtcatgaatttttttttctttctattttgttttcagccctcaatggacgtttttaagaacatgctacatgagctagctgttgggcgtgataacccagatggtgcagatcagggcttccttgctagctatttcccagacttgcttgaccgaccaatgttccatccaccagttaatggtaccaaacttgaaggaacatatcgtcttccgttaggctatcaaatggacgcatcttactattgtgagtatcaatagacatatacgaattcgtatgctcatgcattttccccctagactaatgggatatttgttcagatttgaaactccgctggagcattccatgtgggccgaacagcgtgattacatttcctagcgctccatggtttaagccatggtattggtggtcttggccagttttacctctgggactttcttggcatgaacaacgccgtgaaaacttggggtgagtaattttctcagatattttgtcttgcattttatttgcatgattgaattctgatgttaatagaatcttccactaatgcattgcttcatgtacaaaatttgttagcatggatcatggatggtaatatcatccataacagtgtatcatgtgcactcgtgtgattggttaaatgccctttgtgaattgctttctatcttctttagaataaagatgtgtaacaggtcattatcgagccttttacattttagaataaagttgcacaaggcaaggaattattgtgcttctttttttttgtcaggataaagttccataaagtagtggattgcaaagtcttcaaccttctgtcatgttttttaggataatgaagcatataacagtattcatttgtgcatcttaattctgaccagagggttgcctttcctgactatatgtaaacttgatgcaaagcaagtattcatcggagctaccggttgtattaatccaggccctattttacattggagtcattgcagtcacccgacttgcgcggcctagtttgtcaaagatgtgctacaacagaagaatggagaaaagtactatagttttgctcacaacactcagagtagtggcagcatggtccatacttgcagcttacaccatacccttcttcctgatcccacggacggtgcatccgctactaggttggccactatatttgcttggtgctttctccttttcttcaatcgtgatcaatgtattcctcctccacccccttgcggtcctcacaacatggttggggatcatcggtgctctcttcgtgatggcattcccatggtatttaaacggtgttgtaagggccttggcagtgttcgcctatgcattttgctgcgctcccttgatctggggatctttggttaagacaatgagctccttgcagatcctgattgaaagggatgcattcagacttggtgaacctaaccagacagccgagttcacgaagctttattgaggtgtgtattgcagatacatgtcattgcatttcatcagctaattccgattcgcattggctattctgatggccaattcagttgtacaagtaaaaccgcagatgaaactacagttgcacctttaacaccacctgaaacctttggagcccgtgatattcttcgtaattgcgtaggtgacatacagggcaaagggagagaacatagtttgatgtttgtgtgtggggggtgttggttgtggaagtggaactgcagaggaacattatagagtaatttttttgttacttcatttactgctcctctaaaagagccaacacattcttggctttcttgtaattgatatcatcagttccacacgtccactatcatgagattcaggtgttctttgcaaaatgctgattggaaaaagaaaactatgtactaccactggatatgcatttgcctttccctataggggggtgagtggtgacgttgcaaacaccaaagtaataagctttgcaaatatatggcggcacaaaatccaatcgtccacttcagaatgttgtcttgtctcgtcttgacaacgacgttggatacgacaaaggtgtttctcatgggcacggcccagtgatagaggtaactgaggttataggttcaacccggaagaaaccctcctctcaatgtcgatgtttcagtgtattacaagtgtttttaaatctttcccgctctcttcttttaaaaaaaaacacgtcacaaacgcaaacgctcacaacgtttgtgcactcatctctataaacgcaaacacgcacgccccacttttatgaacacctatgaaaaactaggtcggcatatcttgcgcgtgcacacttatccctatcaacgtacatacactatacccttatgagcacctccagaagattgggccgtatatcttgcgcgcatagattcacccctataaacgcacacaggtacatcctacctccataagcacctttgaaagactaagccgacatatcttgagattaacgaaatcaccacagatgcctcgctgtcaacgggtacatcgcttaccattgaaagaataattagccataaatatgaacatccgagtcagctttaaaacttgaacttaggtggctggctccaccacaagggactaggggtgtcaatttctccatcggggcgaccctaaggggccgggggcaaggtggaattctcacccgtgggtagggggcgcaaacagagttcactccctcgccgtccgccgcctcgttgtgccccctcgttggccacctcgtcgtcgcaccccctcctcgtccacctcatcactgagccccctcgccgttgccacgtcatcgcctgcaacctcgccgtccacctcatcgacgactttcttggttaggttgcggggcctcggggcgggtactgattttcgccctgttcatccctcgggggccggggacagggatacccgcaagagcgaggggacgggagcgttccagcctaacccggccccgtcccggcccattgccagtttgcaacccttacaagtaatctaacaagttgagctacgctctattcttttgctatgggttggttacaagggcaaaaccatcattttgctaagcctagcactcgactaatataattttgtaaaatcttcattttttatattttttcaaatgaattttggcctctttgatttgtagagaaaacaacaaatattggaggattttaatcctaaaaagaaaatactaagaagtcttttgaaacaaatgatttaattatattcttcctctaaaattcttatgtaagggataattctatagagatttcagaggaaaattagcaagagctttaaccccttgaaaatatccttgaagtctctcactctcatttgattcttgtgttggtctaatcaaatgactatttctacattcttttgtgttttacaatttgttttgcacttgtatttcttatatttttgttaactagaaaaatacccgtgtgttgcaagttgcaacagccaacaggtgaaggctattttaatttttattattgttatatggtttagttaaggtgaaattcattgggggagttcgtttggatatatatatatatatatatatatatatatatatatatatatatatatatatatatatatatatatatatatatatatatatatatatatatatatatagagagagagagagagagagagaaaatcctgtagtaggagtctggtcgtctcaaattagcatgcgagtttttttttagagaaattttttatatgactccttctgtattttcaaaagtgaacgaacttaaaacccgacccatacacggatgacgtaccaaaggaccgtaaaaaatatctttaatttttataatagtagatatatttatatgtttttattcatctttttttttctgtcaaagggacgacggaaacatgcgcagggctccacccctgattagttaggtaatactaacttgctgtattttttcttcttgttatacatgtttggaatttatagtccatcgagtaaaggaatggtactgtcctagtttagaagtggaacggtacatataagattttcttactaaaagttttatgaacaattaaggacatgttcttttctttaactctaaacttcaacttactcatttatgttagcacgattttcaaactattaaataatatttttttgcaaaaaaatatatgtagaagttgtttaaaacaaattaaataaatctattttttcaagtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttgga

SEQ ID NO: 74777 - DNA, 1006 bp, Oryza sativa
ccagtcacagaacctaagccaccctctagggtagagtcgttagtcgcgtgtttctttgcttgtgtgtgtagcgcgtggtttgcatcagtggggtgtgatgtaaccatgctaggttgtttgcttaatcaacctgcagaaataagcaaaacaaacaacacatcaacaaaaagagttagttcctttaaggtcttgtccctagttctggtctattctttccttgtatgcttcccctctcaacctctaccttgtgacagatggataatactggtaacaaaggctatgggaacgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcaagaagaagctagggttgattcagtgcaccgaccaggagcggggtggcttcgcaactcatcagctggttggaccggcttcagagtggtgggatagctacgaagcatcacggccagaaggacataccatcacctggaacgagttttcatctgtattcaggagatcacatgttcccgcaggaatgatcacactaagaaaacgagagtttcgctacctgaagcaaggagatttgaccgtcacagagtacctgcacgagttctatcgtttggctcactatgcaccagaagatgtggaaacagatgaagacaaacaagagaagtttctccaggggttaaaagatgagcttgcagtgcaactactcgctagaggattatgaaaattttgagaaacttgtggacaaagccatgcaacattgaaagtgagcataatccgatgacgaactgc

SEQ ID NO: 74778 - DNA, 1988 bp, Oryza sativa
cttggtatctagcagaatcagatccgaggaaaaaggaatcccctgaatttctataggaacggcagggctataatactttgctgtcataacccctccaggggtggtgatgagcagagggtttctaagcctttctacccccaactgacttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcgaggcgcggagcgagattgctgctgctgttgttgctgctgtgaggaggatccccctggatagggattggtgtagcggaccctttgattagcaccctgctgattgcggaagttcgccaagcggcgcttgtgcgactccagctccttgtgcttggcctccaagcggatgctcttgtccaccagacgttggaagtccgggtagtccccagagactagacgaacagacagctcagggtccattcctgccagaaacttctcttgcttctcctcatcttcccgcacatcctccggggcgtaacgggccagattgttgaactcatgcaaatactccatcacggagcggttgccttgcttcaactcccggaactccctcttcttaagagccacaactccggcgggcacatgggttctccggaaagcggcggtgaagtgggcccaagtgataggttgcccctctggctgcgtagcctggaagtggtcccaccagagagatgcgggcccctgcagctggtgggcggcaaagatgactttctcttcatcactgcactgcacagtgtccagcttcttccccacggcatgcaaccaatccaacgcatccacggggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtgaaggtggattgccttgggggttggggttgctgccttcgggttggttgccttcaccggtgctaacatttctcctggtcgtcaccatctgaaaaccccacacagaaccagcaaacagagagagctaacgattaaaactaaccacccacgactaccataaatcttgaatttattactgatattaaattggttcattaaggttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctgccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgtt

SEQ ID NO: 74779 - DNA, 3460 bp, Oryza sativa
cggtgttcagagtgtcgtcctgcagctccctcaaattggccatcatcctgagggcggcctcctcacaagcatgctctaatgtgcccttgcaagctgtcacctccatgttgggcatgtaggaggggatgccgtgaacctacaagcgaacctggtgcgggaactcgccactgagagggtggatgctagtgtattgtggctcccttggaaaaccgatcacgaacgccatgtgggacaactctgcaatgaagcctcccatagtctgaccttagtgcgttaggggacagccggtcatctatagaagacaaaggatggagaatcaaggcatgctcaaatccaattatagaataaacggaaaaggactcaaataaaataagcgaataagagcggaattttgtgcatagatcatttttgcatgagaacgaataaataagactgatatacatagcaataagataatgagaaattagatacatagtagtaataatagtagtagtagtaagaaattgatataggaccaggtgatagaccaaggccaacatttatcagtaagaatttatctccagagttcagaactaaattgatagagcttttgaaagaatatagaaattgcttcgcttgggagtattatgagatgccaggactcagccggaatgccaccacgacataccggaaagaggccgtgataggacccttcacataaacctctctaaccaaacacaccacacctcaggttttacccccactcctcgcaaggcagccggcaatcccctctcatacctaggtgaatccgaaaaccgcataggccgtcgcagggcccatcagaactccatcacgctcacccttgcctggatgcgtcagctagaggagagctacactacaagcccagccttgcccacgctggcttgtggcaagtacgaggaattcttccagggtttcccgcgaaccggtccttaattgccatgggtgcggccatcaaaaccattatcacatcctgatttttgtttcaggatttataaattatttaataaattaataatagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcttaaataatacaaagaacagttcagtaattatttgatcattaattatatttgttaagagcttttcttgtttaaaaacccttaaattataaattgttgtttaaaaggaattattagaaatgattttaaaagcttaaaagagaagatctagttttaatttgctaaatctcaacataaaattgggctagataaaattttgttaaatactttgcttaattctataattcttagatttttctgggatttatttgagctaaggaagtatttttaataaatggaattgcatttaagaaataatttaaattgaaaaaggttttaaaagtcttcttttggctttgggccgaaagccggcccaaaacccttctctctctttccctcggcccagccggcccagtccgccgagccgccgctctcctctctctctcagtcgctgacaggtgggccccgcttgtcagcttcgtcgtcctccttcggccgccgccgcccgcaaaccctagcgccgccgccgccttcttcttccaaatccggccgcgcctttccttctccggccaaattgatagaggggaaacaatctccgggatctcctcttccttttctcctttggaaacgtcggccaaatcggtttggaatgagtttgattcgagttcgaatcggatcggctttcctctctccaagccgagcttttcttcgccggtgccgccgccgtgggcctccgtcgctgctcgctagcccctttaaaaggatccccgagctcccctctacccgtcgcctccctcgccttcgctcgccggcgtctgtagcgccctagcgccgtgctgcttcgcgccgccgtcgtcgccgtcgctccagccgtgtcgcgccgccgttgcagtcgccgtcgtcggtcgccgtcgccaccatcgggttcgcaaggtcgtcgtcgtcctcgtccgccccttcgtcaccgctgaagaccgccggagcgccgttgccgccgtcgacccgaagagcttcgccgcttccttctcgtcgccctcgccgtccgttgcccttccgccgttcctttggtcaccggtgagttcgccgcgtcgtcctcttcgtcttggtgccctccgtttgtgccgaagtgccgccgttcgccggcgagcatgcgagcccgagccgccgagccgccgccgccggggtgacgtcatcgctgacgccatcggagccgttcgccgtgagccggtcgtggaccgatcgatctcggccgtccgttttggatagggttgatctcggccgtccgttcccgtgaaccgccaccgtgcgcccggtccaccgaaaccctagcccgctgacgcaataatccttcttttccttttcaaaaataattcattattgcgtcataattcaattaaaatcaatataaaggttttaatccgatttaatctttaaaaattcataactaattcatttgaactcagtttaatgtgcttcaagttgcaaaagttgtgtaaaataaagatctacatcttaaaattgtccttaaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtatggtttatttggtttttattagtcttttccttcgttttgcgtgttagcttgtcgtttccgtcgttgcgaaggttcgcgagtgcgccggaagtattcaagaagattaattgaagaccgaatattgtaaggcaagtcacacagatcttaaacacaatcctttgagcatgttgatcctatatttaaattctctatttatttcaactgtgcatttattttcgaatgtcactgggtggtgtgaatctattcctttgttatggcctgtttgctatatatattggttcagctagatattagatatgattgcttagccatgcttagaaacattagcacacaactgggataacttattattcactattatttaaggatggtctaatgatagttcacgatggtcaatcgtgattggttaattaattaattgccaactaaaacttgataatgatgggttgttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgatatgtcctaaaagcctagaatgtgtaa

SEQ ID NO: 74780 - DNA, 2006 bp, Oryza sativa
ttgattactttattccttgataccttgggtaattataattggactagttgagctttatatatattggttcaactagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattatccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctgataagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactattttacttctcttaaatgttttgctaaatgctgcttttgcaaatgagcctatattatgccatcctttggtatctttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttgttttccgctgcagttttcttcatgatgaggactaagtgcctcataagtaagtacttatcgttttagttaatttgattaatctgtatattaaattgtcagtttgtgtacctcggctgattcctggacgaggattttatgcacaaataagttcggaaattactagtgaatttccgggcgtgacagtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagttaaagccttttcttttccgttggtcgtgtagacgctgcagcttcggaagatccgctcttcgtggaagttgaagccgacgtttgggaaagcgagcaaggcaagacacatcatcttgatcatattgaatcccagtttataaaattattttgatttaaattaatgcattaccgctttatttaaattcccgcgtgatcactgttttatttagccatgcctatttacctttgttatgaccttaatactattgttattgatattaataccttgttcaccctagattaaacaaaaccccaactagtgggtactctattcatggttccactagtatgaatgtaggtagatgcttcgctgattaattaggcaacattaggtggttttataactttagactttgggaattctcatatcatctagacactatggaattgttggtttatggtggaatttgacataca

SEQ ID NO: 74781 - DNA, 4938 bp, Oryza sativa
ggacccagggtcaggttgccagttcggtctgaatcatcataggccttgggttaaggcaggttcgtgtgggttcacggccttgattaataacattgtataactctaggatcgcgtttacaaaatagctttgagcaactaaacgtctttaaatgctgtttactgcaacgctaaccctttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacatcataactatgggcacggctattcgaatagattatactttgatcagaggtgtacaattttacccacaagacacgttttcctcacgtgaaaccacgtgccacataccaccatggcatacggacggaagacgtgacataccatcctagccataaacaagagtaccgacccaaccctgtctacggccggaatcccgggacaggtaaccaaggttgagcccctagcagcagaacaccggccctgtgccatgacatctcgactactgggccgcagctcgtgtagccttcattctccctagagatgtccatcgagccccgacttcgtccatctctatccgtgtacttttgcccatgaccagactgagccacaaactacgccttacccactagacatgtggaagtacggtagtgctttgcaacagaggcccgagcttaatccttatattggtcggggtgctacttcccacaactggcatgcaccaaaaccccaccgaaaaacaggttttaggggttttgaaagaggaagagatgtgtatgtccaattccaccacaagccaaccattccatagtgtccaagtgatatgagaattcccaaagtctaaagttataaaaccacctaatgttgcctaattaaccagcgaagcatctacctaagttcatactagtggaaccgtgaatagagtacccacaagttaaggtttcgtttatcctagggtgaacaaggtaataataacaatagcaataataataaggtcataacaaaggtaaataggcatggctaaataaaatagtgataacgcggggatataaacaaagcgataatgcattaatttaaatcaaaataattttataaactgggattcaatatgctcaaggatgatgtgacttgccttgctcagagagaacaaccttctgtaccttcggcgacgaccacgaaccacgcttcgggaacctctggaacgacaaaagctaccgaagcacacaagcaaagctacaagcctaaaaaagaagcaataacaatacataaaaagaaagcacagggttctttaggttattacaaacattaggagacttgaacaggtcgattcagagttcgtatgaccaaggcatggtcatccgaagtttaatgctgttatatggagatttatggattattataattatgttttgcaattataaaacatgtgtaagagctaacctggaaaagacaggaaggctgcgctgttgacatgcggaccccacatgtcaacctaagggacacgacagaccgggtacacagagacggtccacgggtcgacggaagcgggccccgtgtgtcaacagaggcgagtggccgacaaacagactccactagacaccacgcgggccgcacacgtggaaaccacgtggctaccgagcgggcacacaaacacggtcaccacacgcacacacgaacgactaccgacaccggtacacaggtaccgggttcgacaccgcacaacgggcacggggcgacaccgaaaggacgaggacggggcagcgagaggagagagatccttaccaccacgcgacgaggcgtgggaacgactacggcgaacaggcggcagagatgaacgggaatgacggagacgacggcgaggggacgacttcggcggcgatcgttggatgaaggcgagacgaggctggcacaaggcttgacgacgcggagccgaggatgaagacgacgacggggctgcggcatacttgacgaaacgcgggcgacgaacggacgcggcttgacgaagggagggccgacgacgagcgcaaccaggaacgaggaggaggcgacaatggcagccagcagcagctgcacagagacgagaacggtgtggaacacgccactacgatgccgatgatagtggcggcgcagcgagacgatgggccggcgaggatggacggccgactggagaagtcgtcgatgaggacgaacggtgacgacgatgaagaccggtagggttcggatggaggggaggcgaggccgaggacgaccttgtcgctgtgatgccgaaggtcgtggtggtgtggtgcggccgatagtcgcacgggcgaggaggaagggacggtcgaagggacaccggcaaggatggcgtggaggcgacgtgcggtggcttcccgaccaaggagaggcttggccaagggagaggacgacgctgcgacgccgaaggaggagacggcgatgtcggtcggtgtcacatcccaaaaatcttaaaaatataaattgttgtttaattggaatttttagaaattaaattaaaagcctacaagttaaaccctaattttctaggaaaattttcaatataaaaatgagctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccgcccgcgctcgcgcccctctctcccggaggctgacaggtggggcccacctgtcagggccgtcttcaacctccggacggccgccgccgagccgaaccctagccgtcgtttcccgctccaaatccggccaaatccgactccgttttctccgattgattgaggggttttgttcctctcggtctcctctttctttttccccaagaatcaaagaaatccgttgaggattcgatccgaatcgaactcattttgatttatctctaaaaaccgagttcgtgttcttcccgatccgattcctctcgtttgcggcttggtctcttcgattcgagctcatataaaccttccccgtgatctcctctttcatttgcccttttcccgagtcctcccgtgcctcctagcgccgccgcgacgcgtcgcacgtccgccgccgccgctggccatcttcggcatcgccgccgtgccgtctccgccgtcgcctttggtcgccgccaccgccgttaggtgcgccgtgaggagaggaagctcgtccgcccctccgtttgcgtcgccgatcatcggagctccctcgacgccgtcgacccgagccgccgcgccgcctcttctcgtcgccggccgccgtcgtgcatcgtttcttgtcgtggtgagtaccaatgagttcgtctcgtcgcccgctacgcgttggtgccctccaatcccgccgccgaagtccctagcgccggcgagctctccttcccgagccggccgccgtcgctgacgtcatgccgacgtcaaccctagggctgacgtcatcagggccagggctgacgtcatccttctctctttttcctttttctcgattttcaaatagattaaaactttggaaaatcataactaaataaccgtagatccgttttaggtggttcaagtttctaaatttttctaaaatcaagatctacatgataaaaatatccacatgtactgtttatgcttgtttttgtactgttttgttgattttatttatttgctttagtttccgacgttccggaggagagcgtttccgttgaggaaggttccgaagcgtttgtggaagcccaaggcaagtcacacagatcccaaacaaccctttgagcatgttgatcccgtttaaagctattattttatttcaactatgcattgttttcgaatgtcatcgggtggtgagcctttcccagttaattattggccgaagttgactttattttcctatgggttataatttgaatagcatgaaccttatatattggattggttcagctaaatgctatatttaggtttgcttagccatgcctagaaacattagctaattaaaaggggttaagtataaattatattacataattattatgtattaattagggttataatcaatggtagctcacgatggtaaatcgtgcgatgttaattaattgataattaaaatctggataaggtgggttgtgagcatatggttttgatggttgtgctcatgacaattaaggaccggttcacgagctactgttgtgaaacatttatcgtgccaaccacaagccagcgtgggcaacggctttatcttttgtatagcatgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatg

SEQ ID NO: 74782 - DNA, 7184 bp, Oryza sativa
ccgggagagagagggggggaaatggagctgggccgagaggggaggaggcccaagaggagggagagaaggagagggagagaaagagagggaggagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacaaatccaccccccttacaagaatctcgtccccgagattcgaggaggctagcaagaagataggttgggcggtcttctcttcttgtccgacttcttccgctctgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgaccttggtcactaagtactcttcactccgagagttgtggatgcttctggtggcgatgaggtcctttggtctgctacctttcagtgaaaccttgaagtgtttcgccaaaagctacactgactgtcattgcctttgatccggaaaaaacacatctgaaactcttagtccaaacatatgtctctttggttaatcacttgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacgtggagttggaattggcggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggtcactaatggggccagaaccatggttgttggtggtatcatcagcattagtattgctattgtggttgtctgcgttgcgttcatctccttggggcaggaactcttgatacacaacagaagatccggtgatctgaagtggctcagtgcgctgtctttggttgccacctggaaatactgggttgttaaccatccttctcttgcagttcgtcatccgactatgctcactttcgagttgcatggctttgtccacaagtttctcaaaatcttcataatcctctaaaagtagttgcactgcgagctcatcttttaacccctggaggaacttctcttgtttgtcttcatccgtttccacatcttctggtgcatagtgagccgaacgatagaactcatgcaggtactctgtgacggtcaaatctccttgcttcaggtagcgaaactctcgttttcttagtgtgatcattccggcgggaacatgtgatctccggaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgtcggttgcccctgctgggttgttccgattctgtaatagttgaaaggctgttgccaacatgttggtttggttaaccacaacttggattagctctggtgaggtttcgttgatgcttttctcattcccattggcttgggttcttgagtcatcggatccatcattcccatagcctttgttaccagtactatccatctgtcacaaggtagaggttgagagggaaagcatacaagggaagaatagaccagaactagggacaagaccttaaaggaactaactcttcttattgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttccctccttcacagctggcttcactacttcctccatttcgctagcggatcctgcagtcttccggagcttcggcaaacaactgacgatgtcttcttcttcactgacctgaccatctagtactagttgaaaatccgaagaaggaagaacggagtaaaccttttgcaaatagcattaggggaaggagaaaaaggaactttcgcaaataatttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttatagcaaacattaggagactttgaacgggtcgattcagagttcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggaggggcgaacgccacgacgaccgggaacgacgagaggacgacgacgacgacgacgaccgggaccggcgagggggcgacgagggcagccggcagtggctgcacagagacggggacgacgcggaacacgccgcagcgatgacgatgacggaggcggcgccgcgagacgacgagccgagcgaggatgaacgggacgtcgacgacgagaacgatcggagacgacgatgatggaccgcggaggggtttggatggaggggaaacgatgccgaggacgaccttgccgctgcgatgccgaagatggtggtggaggtggccgaccgatgcacggcgaggagggacgggcggccgaacaactccggtgaggcggacggagaggttcgcggcgacgttccggcgaaaccgagggcaggccggggtggagggcgatgcggcgacgccgagggaggagacggcgacgtcggccgacgctctggcgcggcgaccggggcagccggaggagatgccgccgaggaggaaggagaaaccggcgcgggcgacggtgttccggcgaagttcgggcgaggcggaggtgatgccggggatgagagcggcgtcgtggagccgaggaaggtggtggcgacgtcggccggcgctccggggacgtggcagaggcggccggaggcggagaagtggtggcgacgccactggacgccggcgagggcgcgtctccggtgatttccccgcgaaacggagggctgaccgagggagagggggcagctgcgaggccgagggagaagacggcgcggccgggcggcgttcgggcgaggagaggaaggcggctggaggtggccggcgcgagggaaaggggagggcgacggcgggaacgtagttccgggggtctcctcgcgaaacggagggcaggccggcgtggaggaggtggcggcgatgctgtaggaggcgacgacgcgaccggacggcgctcgggcgaggcgggagaggcggctggaggcggccggcggcacgggagagagaggaggacggcggggagaggtgctgcggccgtgggggagctcgggaaggggctaaaacgagagaacgcacggagggggttgcattttatatgatgggggagggagccggccacgggaggagcgggaacggcggcgggaaccacggccggcggcaatggttggtggccggacttggcgcgtccgttcccgaggattgaaagcaccattcaaggggaaaaacgggggaaatcgaagaggaatcaatggggattaattgcccccaatcaatttggtaagagccggcttgaatagagcggatttagaggaggaatggcgctagggctcgctcgggagggagagaggaggacggccggcgcgggaggaggaagacgacgctggcgcgtgggccccacgcggtcgggcggcggcgtcagcgcgcgcacgcgcgcgcacgtgcgcggcacggggcgggggcgcggctagggttgggccgggcgaccggcccaggaggagaggaggggaagcggcttgggccgagggaggccgggaggaaggaggggggggggaaaaaaaa

SEQ ID NO: 74783 - DNA, 6183 bp, Oryza sativa
ccaactcatactaaagatgtctccaaggttagattaaaaagatgtgtgcaataggtgggatggtaacacgtacatgtgagtgctgagatgagagatcgtgagttcaaatcccacattctgcataagtttgttaaaatagaccaggtttgaattatgtgaaacatcacctaaaaacaacggtcgggttgtgccgtgcctggtccgggacaaaaccccatgacatgggtcgggccattaggccacttgccttttggccatctataaatagaggcaatgccaaattccttgatatcaaaacaggactaaaacacaaatattcaataatatgtaagggtatgcatatcattttttttacaaacttaacaccattaatatgaattggcagaataggggtaaactgaaacttcacttcgaaaaagtatggacaaaataaaaaaccctaataagtgggaataaaatcataattacaacttaaaagtataagtagagataagaacacaaatacccctaaattaaacggcgattaggataaactgaccctacatactgttatatacgttactgttggcctgttgcagatgcatcaacgagttagggtgtgtttagttcacaccaaaattaaaagtttggattaaattggaacaatgtggtggaaaagttcaaaatttatgtgtgtaggaaagttctgatgtgatggaaaagttgaaagtttgaaaaaaaactttgaaactaaggctgtgtttagatccaaacatcagtcattttccatcacattaacctgtcatacacacacaacttttcagtcacatcatctccaatttcaaccaaaatccaaactttgccatcaactaaacacagcctaaaccaggccttaggcgaaagttgctgatccacacatcagtttggcaggcatcagaatttttgtccggtcattctcctacagtacacaagtgcatataattgctctcgcatggacccggaccagcagagattgaggtagcgtgcaggcggtgcagctcttcgtctctcaaaatctcccaattaccgtacagaggtacagagttatgtgattgttttggaagatacacgtgcttagtcctatataaagcagctatagctagttaaattaaagcaaccatatcacacagaagatgcaaagctagctagttttcacagatatcctatcttataatattagattaatagtacgtatacacaaagcttctagctacttaatttctcggtcgctgaaagggcactatgtctgcaagctccatccctctccctctcttgtgtaatggtcctcctgtgcatattagggttagccatccgccggctgggcttcttgctcgttcggatggtgtccgagcaaaaggttacttccggcaaagcaatgttctgcgacatgcaagtggacatgggattcgatccgggaatgagctagcgtctagctttgagccctctgcgtggggggatttctttatcaactacgagcccaagcccctccaggcatatatatacatattttatttttcgtgcggtatatgtttgattctaataactctgataattaaactatacacctttgatatcccagataattttgatacctaagtgttctcattatatattcatcaagattggtgcaattttcaaatgtaaaatctcataattaatgcttatgttttttatttgtctttttttaaagtgacatatatagttctcatgtcccaagtacggatcaattgtgtttcattaattttgttttttattctagttatctttgttctgctttttgcaaaacatttgtcatgccacgaattgcacaaattaattatattaattggaaatcatttaattgaccttattaactgttcatttcagtgtattttttctttcactcaatcataacaaatcaaattcatgctgccaaataagcagagatcagagggatggatgatggagatggccgaaaagctaaaaagagatgtccgcatactgtttgggacctgcaatgatatattggagaagatgaatttaatagatgcagtccatcgtcttggaatagatcaccttttccaagaagaaataggaagtgcaataagtgacatcaaaggaagtgaattcactagctctagccttcatgaggttgctttatggtttcgcttacttagggagcatggcatttgggtatctccaggtattgttctacatgctaaaacctaaatgatactagcgaagcatgtgttaactgatataaggaaatctgaatattattggtttccttaaaaaccaaaacattttttgagaactaaaaagaactataactaattattacaaataagtatggcttccaaaattctatgaaatcaacaaaaagttaattccagcacatagtgataggcgtttttggaagagttgattgccaaacttttgaatgttctctttggattagaattatttaatttccttatcattttgtaggcgattcagaattgcatttatttgcattaattctgtggaacaacttctctgtatctgtccgaactaaccacactacaacctctgtttcaaattgctcaaattgcttgtcaatctagctttttgttaagtcaaacatttctatctttggtcatcaattttagaaattttgggtaatttagaaacatatgtattatgtatttcggaagtatttttcatgatgggtgtacaaacataaatattaagacttaaactatacggtggcgctaatacgcgcgctccacgcggaatattactttgagcgccacacaacgctccctccttccgattttccttttttaccaccccacctttcttccgtctgcttttttcgttttttaccaccccaccttccgtgtttcttttttctcttttccacctcattcgttttcatcaaagagcccggtaaaatattaaccatccatatttttccctttttcgttcgttctctccagtttttctgttttcacattttagtaaaatatttactgtctagtttttctttctaagtttttttatttttctagagtctccccacgtttcaaaaagtaacgaatttactctatagagctttccatttactcccggcttcccatatctgcacattcaaaagaaacaaatttactcgcataaatgcccccttcaaaagtaacaaatttacttgcacgaatgcccctacatcgtacgacaccattcctagatggtcgtaaaagaattactaccagcttacaacgctagtagttcatttaccagtgttataaatattgttcagacttcatggtctgtgagtaaaacaaccaccaccttcctcttgatatagcccgtgatctcgtagcctgcaatttatttactgatgtgttcaatacatagtataagaataaaaactgatactaaaagtattgttaatttgtatcacgaaatggtcgtacgaatgaaaaaaattaatggctcaatcacacacgagtgataaaatcacttacaggtgaattaaactagaaaagaaaaaaatgacagtttctacctggttacaagctctgtaatatttatgggactgttgtacttgtatattttatacattttataactttcttttttgttttaatgtattaaaagtaatgggggatgcctcgttgtaattttactaaaaaataaatccattgtgaatctgggatccttgaggctttcctggatcttgctataaggatggagaggctgacctatgtcttgtgactggtagcggagagggtaaccaggtggcgtcactactacaaaattaatttttcatggcaccaccttttttttttctctagcagttatacgtgtaaaccgtcagcaaaaatattacaaggggtaggggggctacggaccgccagcgaaaacagatcttcgctacggctgggttaagagggccgccagcaaaagtataactattttcgttggcggcccacttaaggaaccaccaacgaaaattggatttttggtagtggtcctctttaccagctgcctgtgaaaatctctattttcgttggtggttggtaaagaggaccgccaggaacaattcgatgttcgccaacgaaaattcaatgttccctggcggctactaaagtgcactgctagcggaaatcataccgcacattacaaaggcagccccaccgccacccactcctcctctagatacactgcctcccactcctcctctctttgtcctcgtctctcctccgcacccttctcctccccctccaccggcgactccaccggtgttctccaccgcgcggcttgcatagtcggacgggccgctgggcctcatggaggacaccgtagggccgaaggaggatggatccaccaccaccaggacgcggggaggacagatccgccaccgccgagccgtggggaggatggatctgccgccgccagtccattgggagcacggatctgccgccgccgagccgcggaggcacggatccaccgccgccgggctcctccaaccgcctccccactcccaggtctggaggctgcggatcagggcatggacttcagcgggcgatgtcacgtgccgcggatccaggcgatggaggggcgtgggcggcgggcgacaatgaccaagaaccatgctccagcaagttccaggaggagacggcgttccggagctggccttcctctcgctgttccaccacaagcacctcatcggcttcctcggctactgtgaggagaacgacaagcagctgctcatctaggaagtgtgattgtggttggggatttgggacaacgatttgggattgtgattggggattgggacaatgatttggaatttctcaaaactattttggacctagattttctatggttgtgattactgtgattgtgattattgtggttgtgatgattgtgattgtgattgtggttattgtggatttgggggatttaggacagtgattgtgggtcggagaattatggattttggatagtaattggggatcttgatttttatttttttatcctaaaatcattttcattggcggctctcactagccaccattagtgaaaatcaccttttctctagcagctgtcctaactttgctgcctgtggaagtcaattttcgctagcagttggtggaccactagtgaaaatttattttttcactggccttaggtttctggcagtgttgccggccggcagcggaaaaagcctttttgtgctagtgcgtgcggtagtagatgatggaatgatggaaggatgtagctgcgtggtatagagacgatctcgatgttgcgcagtagcagttattcgtcatctagaaagcacgaaaaaaatgcaaaaaacattctcgttcatgtcatacaaatgacgagtaaaagaaaaataggaaacaacctccatcaccggcggacttcaccctatcctctgcggcaaaccacatggagcatgatgtccaaatgtaggacatgtgcagcccatcaatttagatcaggtaatattggagattgcatgttaatttgatttgcaaaatgaatttggggcttcacgcatgaaggtgaaggagagtatgcagatgcaaattggagtgtcatttcgttactttcttattctgccaatgtcgccgacatggagcagtcgccggttattgctcttggcctaggtgaacacctccttgctagttaaggtgctgctcggcttccagcagcgaaccccgaagcaacgtccattgtcgcgtcccaaatcgactctaaaatctatcctcgaaattgtgcaaaagaataattaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctggtatcttcctactcccgccaggtacgccgccgcgcccgtgccctatcgccgccg

SEQ ID NO: 74784 - DNA, 9079 bp, Oryza sativa
tccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaacctggtgaccttgtttctggttctcctttcgctggtgtcaagtatgcgaaccggcttctccacataggtcaggtcctcctggatatcgatgtgttccgaatcagcctgttcctcaggtacccttaagcacttctttagttgggaaacgtggaacacgtcatggatgccgatcatgttggatggaagttctagctgataagcaacttctccccttcgttccaaaattttgtatggtcccacgaagcgtggtgccagcttgcctttcgtctgaaaacggtgtactcctcggagcggagtgacacgaaggtacacataatcccctgcttcgaaagtaagctctcttcggcggttatcagcataactcttctgccgagactgggcaattcttagcctttctctgatggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggcagacttttatcccatgctccaccaaaatcgagcgcacacgctcgcagcatatcttccaagatctgattgaccctttcggtctgaccatcagtttgcggatgataagccgtgctgaaattcaaacgagtccccaattcttcttgcagtttctgccaaaattttgaagtgaactgactcccccgatcagatactatcttcttaggtaccccatgcagacacatgatccttgctaagtacagctctgccaaccttttccccgtataggtagtgtgtactggaatgaaatgagcaactttggtgagtcgatccacgaccacccagattgaatcgtgccccgacgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgttagtatgagatccttcagttctttgtcgtcaggcacacacaatctctctcccaaccagattgtgccatgctcatcctcatggaaatctcgagcttttccaaccctcatattctttttcagctcagctatttcaggatcatttacttgagctgctctgacttgatccacgagtgtaggccgtgcctctagggcagctacgaacccgtgttccacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcatgtggacgcaactgtcgcgaagcatatgcgaccactctgccttcttgcatcaacacacatcccaatccttggcgagatgcatcacagtatacctggaagtcttttgtctgatctggcagaattagaactggtgcagagactaacttcttcttgagttcttcaaaactttggttgcactcagccgaccacttgaatttttcatctttctttagcaactgtgtcatgggcctggcaatcttggagaaattttcgatgaaccgacggtaatagcccgcaagtccaagaaaactccggatttgagaaactgtctttggtggggtccacttggtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgttgctcatgttgtttttcagacttggaatagataagtatgtcgtcaatgaacaccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactggtgatagcctgatcgcaggtctatcttggagaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacactggagaacggaaggtgatcttctcccctttgtcgttggttagggtgatggtgcggcttgcgcagtcaatcactcccttgtttctggtcaaccaatccattccgagaatgacatctaggtctttagattcgagaaggatgaggttggatagaaacggggatcttttgatctctatagtcaccgaggggcagtagtgtgctgtcctcatatcatttccaggggtatgaacctgcatcggtattttaagttccactaccgataatccatgcatcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttaccagcaaagtggccgtgcttgccacagttgaagcagggtcctggctttcctacagcccccttcttgggttgttctgactgaactgacacagctggcggatctgactgagctggtgccattagtgggggtggagtcgagttgtggttgtgctgcttactgttgttgtgactgccaccgttgtagtcgttgttgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgcacgtcctcaggagcgtagcgcgcgaggcggttgaactcgtgcaggtactctgtaaccgttctggttccttgttgcaatgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctctcggtcgttgcattgcaataggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcatcatctggacgaggataggtagaaataagagaaaggaagaaaacagatggcttggaagctaatctttcttataaaattaagtgccattatcttaatcttgattaaaacactgaaaaaagaggcacgcaactcctaataaaagcagccataccactgacacatgatatcgaccgccgactaacccacaagcaacaaacctaagcacagaaactagcaagcaaacaaaactaagaagacgataaagctatgggtggcgactctgaagcttggagcggcgcttgcgatcgaacaacaggtctgacatctaaggtaggcaagggataggaatcaacgcatgctcaaaaccaaattaaatgaagccacaaatgactcaaacaactagccaagcatgatgatttttatgcatagaacattttttttttatgaacccggataaagatacccatgcaacaaactaatcaatgaatcaatgcacaaaatagatgcatagctataatgatacgcataaaatctccccatcgtacctagacacgacttagcgcatatcacctaataaattcccgactcactatcaaataaattccggataaaatttttctaaaaccctagaccgagcaaattttaaggatccgacccgaatgaacgaccaagatttttcccacaaaccaaagaggcaaaaccccaaatttttcccgaaacaaatccaagtgcaaaaagcatatgcagatgaaaaggtttaagagagctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaagcagcagttgaaagcagtaaaacagttgtagtaattaagcaatattaaccaatctctgtccaacgttacaccacgttgcaacaggcccaaaccaccacctgaactcaccagttcattaagcttaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtaatgtactttaattaaccaacaccattacggtggcactaaatcaaagctattgccaataatcaaagtctatgctttaatgtgatccccttttgtgcactagttgaactaagcatggctaagcatctcctaaaccaacatctagtcattttaatacccaagttatcaatggcgtaagggaaacaacataaagctgagtaataggacccgtcccacatgatattgtaaaacaatgcaatatttaatagaaatgcgggacatttgtaaattgggtacaatatgatcaattgcaatgtatgacttgccttgctctcgcactgatgaggccacagcaacgtcttcgagaaactacggatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactattaaagaaaaagccttaatcgatttattgcgcaatattgccccagggctgacgtcagcaaggggtggggcggcgccgacatgcgggacccacgggtcagtgactcaaagagagagagaggcggctggcaagcggggcccaccgggcagtgacacaagggggagaaggatggggcggcggcgccacgtggcggccggatcgacggccccgatctacccaagggtagatcggacggcggcggcggcggcagcccccgggctcggatcggcatcaaagccgatcggccgacccgggctagcggcggcggcgcgtgcgcgtcacgtcgccggcgacggcatccggcggcggaggcgacgcgaaagcggcggcagcggacggcggcaacgacccaaagcgacggcgagcgcgggcggcggcgacgcacggggaagcggggaaggaggggagaggaggtgcctcaccgagggtggccggcgcggaggaagatgatggcgaacggcgacggcaagccacgggaggcgacggcgaccggcggacgagctccggcgtgccctaaggaaggagaagagaggggttagagagagggagatagaccacggcgaccggaatccatggccgaaggcggcggtagaggttaaacccaccggagcgcgaggagacgggtgttccggcggcgaacctcgacggggaaggggcggccgaggtagatcttgaccccgcgaacccgacggcgacgacggcgcggcgcggcggcgaccctagcggcggctagcggcggccgaagtagcaaaaacggcggcggcgggtggttgcacggcgcgggagcgatggggagcacgggagagtgcggcgaaatggggaaaaagcgagagaggacgacggcgatgcttaaaaagggggagagagagccggacgtggccgggaacggcgggattcgccggccgacgcgggggagtggggaggagagagaggcgggattcgaatttcgaatcccggccatctcgggcgcgggcgcaagtgggagagagaggggaaagggcgcgggagacacggcgcacgcacgggcgtggacgacgtgggccgaggaaggcggagacgtgggcgtggcgtcagttgcggtggcggctgctcgagcgggatctgcgggaggagggagactggaccgacacgtgggccccacctttctgcgacccctggatgagggaggcgggcggccggctgtctggctgggcctcgggcttgcgcccgcccatcaaggaggagggggaggaaacataggggaaatgggccgacggcccattttaaccaaaatgaggaaaaagagggaaaaagaaaaagaaaaaggaaaaaggattttccctggaataaaaattgcacttgctcaattttaattggttaaaattatttctagagctctgaaaattccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaggaccagccagggtacacaaacgataattgttgacatacagatccacgtcttacaaaaatataaaagattacaaatgcagcggaaaagataaaacgaactaaacttggattcttgacttctgcagcgggcgactccactccacaggcaatccttgacggcatcgacgaaaccaacttcaacagaacagctcccactaggaagatcttcagctctggtgtgggggaaaagaaagcaagactgagtactacccactgtactcagcaagtcataccggatgagaatgtatgatgcaggatataaccaaaggaggctatgggttcatttgcacaaagctagcatttaaaagcagcagttgaaagcagta

SEQ ID NO: 74785 - DNA, 1350 bp, Oryza sativa
ggtgggttgtgagcatatgttttgatggttgtgctcatgacattaaggaccggttcgggagctactgttgggaaacatttatcgtgccaaccacaagccagcgtgggcaacggctttatcttttgtatagcatggttcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatgggtgagttgagcaatgtttttcgtgattagtctcacacttctcattaatggtaataatgtggtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacagtcggcgctttggcgcggcgaccggggcggctggaggcggtgcagtggcggcaattgtcgcgaccgagaaaatttgcattttcccgaacgctagtgtattaatccctgtcccaggaaaagccggggtacaccacacaaacatgatacaaacggcacatctttattatatcgataatatttacatgattacaaaggcacttcaagcctgacaatcaaaaataaacagcagcggactagcgggcctacggctccatcttcacaggcgctcaactggggtata

SEQ ID NO: 74786 - DNA, 922 bp, Oryza sativa
cggccaacctccagccacgccgctccgccacgtccgccgtcgccgccgcttgccgccgtcgccaagaggtgcgccaaggggtggagaagcccggccgcctgtccttcctcgccgccggcgacctgagagtcgccgccgccgttcaaccgagccgccgccgtcgcccttctcgtcgccggccgtcgtcgttcgtcgtttgtcgttgtggtgagtaccgttgggttcgtctcgtcgtcctctacgtgttcatgtcccccaaattcgcagccgatcatccaatctccggcgaggtcgccaacccgggccggccattgatgaggtcatcgctgacgtcatcatcggtttttctttttcccgtttttctaatagattaaatcttcagaaaatcataactagataaccgtagatccgtttcaggtggttcaagttgctaaatttttctaaaataaagatctacatattaaaattgtccataaattgaattaaatttatttaattctttttaaatggactttaattagatttaatcttgtaaaattcatcataaattcatttgaagtcagaataaggccgttcaagtctcataattcatctaaaattatgatctacatgtttgtttactttatatgtactgtttatttggtttttattagtctttttcttcgttttgcgtgttagcttgtcgtttccgtcgttgcgaagtttcgtgagtgcgtcgaaagtgatcaagaagattaattgaagaccgattattgcaaggcaagtcacacagattctaaacacaaatcctttgagcatgttgatcctatatttaaattctctatttatttcaactgtgcatttattttcgaatgtcaccgagtggtgtgaacctattcctttgttatggccaatttgcattgaatgccctattccttgatac

SEQ ID NO: 74787 - DNA, 811 bp, Oryza sativa
taaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaatatccagaccattccaaggtgtccaggtgatatgaatatttcccaaagtctatagttgaaaaaccacctaatgttacctaattaaattgcgaagcatctacctaagataaaactagtggtgccatgagtagggtgtccactagttgaggttttgtttattctagggtgaacaaggtaataataacaataacaataataaggtcataacaaaggtaaataggcatggctaaataaaacagtggtaacgcgggaatttaaataaagcgataatgcaataatttaaatcaacataattttacaaactgggattcaatatgttcaaagatgatgtgacttgccttgctcgctttcccaaacgtcggcttcaacttccacgaagagcgggtcttccgaagctgcagcgtctacacgaccaacggaaaagaaaaggcttttactctaataaactccatataacagcagaaacaaagcacaaaaatgggttcttgacttcttaagaaaaaattagagacttgaacggtccaattccgagttcaaatggccaagttatggccatttgaagtttatatgctctttagatggatatttgcgaatttcttcatttaaattttaattaaaa

SEQ ID NO: 74788 - DNA, 14885 bp, Oryza sativa
gtaagaagggaggaatccacagagtgtggcctgctgggagtagagagttgttatttgagatacgacttcgtgacaagagtggtgtcggcattgggactactgacgtcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtgccatgtgcgatttcactcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgtttcaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatagccttgtaattttcattttgaactgcactgcacttttaatatcgtcatgtatttgtattggaattgtaatttaaatttcgaactgcactgcacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtatgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggccagtagttggcccaacaatggtgaatgctggatgggcggatgaccttctggccagttttggtggtgtgctgcctgttgcactggaggatctcacagatgggcatgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcagtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcaacgatcgtcccactatggaatccttgtggacacaccgtgaggtattttttgttaaattcgtttatgttatcattatgaatactagttcacaaactttccttatatgagtaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgttacctcgtggtggacgtgcacgtcgagccacacaatgtccacagggttctcaaacagttgggcatgtatcaggacttccctccgagagatggtcgtcctttggctgatagtcttcataggttagttcacatcacagttgtctaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagcatttataaatgatgtgcaactggttcattatttctaacaaatgtgcatcttgttaaatactcttaataaatgtgcaactggttaaataattttaattaccttgattatttgtggaacaggcggaatttgttgagcacgttcacgtggagtccgacaccatgctgcaaagactagaggcgagacctccggtcgtcaggcctgacgacgtggcgagcatccttcgcaacttccgtgcacgtgctgccgcactactacgtcgtgtctcctgtcggagcgcagcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacattagggggtcagccggatcaggggtacccacgtcgagcacggcaccaccacgtccacaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggggaagtagggatggattactggcacgcagcacctcaggtcacacagccgacgcaggagacggaggtcggtcaggggccagacgtgacaccacagcaggcagctagagataggcaccccccctgataatttgacatatcccactgagcagattaggcgtaggaagaagggaggacctagcaagcgtgcgaagggcactaatcgtccttgacttatctatttgtattaaacttttagtcatttctattctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaataacttattacaaataaatggagaacgcgaccctgtcgaacgcgccagttcgacggatatcctgtcgaacaggggcagttcgacagccccctgtcgaacaggggcagttcgacagccctgcctggggctgttcgacaggtcctatcgaacggcagccttccgatctcctcaccagtcgcgctctggccgttcgataggcgccctatcgaactgcacccgttcgacagggacctactttcgcgattttccccggttgaccactacttttgcgattttccataaaaataatattaattctcaaaaaaattcgctttcttttgttttcttctcttttatttgcggggcattagagatcgcggtcacgcttccgcttcgcggatcagctgcataatatcgagtggaccgatgctttaataacggatgaaaaaattaaccgaagtcttacttaatttttaccgatgctttaataacggatgaaaaaagtcttacttaatttttagttagatatagaaaaaaaagtgccatgcgttgcaacgaaaaataaagaaatatttattcacatctgtggcttagaaatcaacacattaattgaaacaaaaatatacaccgttgatcatagtggatctaaaaaaattttatgaatgtttagatataatgatgtagatttatcaaatataagctatatttttataattagatttaatccaaatcatgatcttataccggccagcaaaccgaactattttctttctgccatacagctgggccccggaaacatgaacgcaaaataaatgaaagatcatttcagcaattatttaattagaaaaatgaatcaaaatccgcgctttcaggtttgggccaaatatgaaaaaatccagattccctccttttgttttgtctcttctctgtttctggcatgtttcctttcttcggtaaatcttgcttgcgtcctcctcaattgggtctagtaaaataagtcctaacagaagtctaatttatgtccctattgctacagtagtttcttcaagttccagtcgagcccggcctacgggggctcctggttagaacagacgcgctagataattttgtagcgcgcacttccataacttcctcctgtttcatcgttttgtatatttttcctgttccgcaccgcgtccggggaggttaagcgcgtgggtccactacggccacgcgtcattagcgctaataacagcgctagccatatggattaatctagttatagtttttattatcaaaataatacataaatagttaagttgaaagtttcgaaaatatgatgaaaaatttcaaaatctgagttgaaagtttcaaaaaaaaatcttgagagtttcaatttcgagttgacagtttttaaatttgagttggaagctttcaaactcgagttggaagttttcaaacttaggttgaaagttttcaaatttgggttgaaagtttttaaatttgacttgaaacttttcaaattttgagtcgaaagtcttcaaattcgggtcgaaagttttcaaaactcgagatgaaagttttcaaaattgatttaaaagtttaaattttgagttgaaagtttttaaattttaaattgaaagtttaaattttgagttgtgacttttaatttttcatctatagaaagtttcaaatttcacgtatagatttttaaatctttagttaaaaaaataggacctcatgaaaaaaaggaaagattaattaaagaaacataattatcggaaactaattccgtcaactaatctaatcttgattattttctccgaatctggcgcacttgcgcacgcttcccagcgatccctcgcgcaaaaaaacagaaacaaaagtggaccggaagagaaatcacgtacgaggacatgggcctaaaacgcgcgctagatggctagttagcgcgtctgcgctaattaggaaattcgccggcctacacctgacgccaccctaatcccgcgtccgattcaaccaaacccgtggagttaatctcaaattagtcgagggcttttgatctatcttttctctcaggaaattgaagtcaatcccatgaaaattgcttccgtatcgagctcagactcgagtttatctctccagtgaaccctagtttttatctctccggcgaagtcaagtctgattcaaccaaattagcacgttgacggacaaaaatgcagaaaaaaaagtgacgaacggaaggttacagatttttcttttctaattagttaagataaaatatgatatagatagtccggcgacgactacctcctcttctgatattctcacatacacccgtcgccgccatgcacacacactctcgagctgcgtgtacatttatagttgtacgtataagtgtactgatacacgtataatatacgcagtgacgtgatggaggagttccacaaggagatccgacggtgccgacgagctgctggagttgttcctcagggcgggcactgggtctcaccggagtcgaggtggaagaagatgacggcgacgatgcactggtacccgaggtgcccggacctgcggcgagcgctgggactcagtgcacacagcgactccggcttctgctctagagcatcgtgccagggctgcagctgttccggcggggaccagaccggtgggtggcagtgccggcggtcgttcctggcgccttcgtcctcaacgtcggcgacctcatccatatgcatgctcaccaacggccgcttccacagcgtctaccaccgcgccgttgtcaaccgcaaccgcgataggatatcgctcggatacttcctcggcctaccagccgaacgtcaaggttgccggaggccgtgtgccgcccggctggagcgccgcctaccgcgccgtcacgtggccggagtacaaggccgtccgcaagaaggccttcaccacaggcggctccaccctcgagatggtctccacccccaccgccactgacgaacacaacgacgtaaccgacgtcgtccgggatgtcatataatatttacccctaatctgtcttactactttactattgtaccctcaagaataaatggttcagattagttctactggtagtataatactttcggtagaaagcacaatacttgcgtcttgctctgtgttttttcttccgtgcacggtgattatggcagaggcctccagctgttcataaacgcatgacgttttgacctcttcacagttcacgtgctgacaaaactaggataaaattaaagcagctctgatcacagctcgtctcaaagcagaaagaaatagaaaagagatgttgttattgttcaggtgaacaagataggttagagataatcctgctcacacatatgctcttccaaagatattccggtccctgctgacgaaaaaactaatcagcaaaaagtcatcaaaagtgttgcataatcttcataatactacttaggcttgatttaaaacatcattgaacggattgttgatgcgggttatctactttattatattgataaattaaatattatgagaaataaagttaacatgtatcttaagtaggtaagcagtacgggtagaggatttttacataaaatttattcttcaggcaagtatcctgtttgaacgatttggtaaataatttggaaaagtaaacctaaaaatacagtgggacgacgtcacactaaaatacagtactatatctgatgattggtgttcaaattttcatgggccatgtgttacaatttcaaatacaagttacacagctcaaattagttttgaaatgtaattaaactacagcttgtggtggtaatttatcaccatcgtcgttattcgagctatcacaaacgattctgtccttattgcttggccaatgtccttgttagttgttacggagctggccgccatcatgggcgtggctcccggctctttgccgatcgtgcactgtgggcttgtggctaggcgtggctcatagggccagaggccagtctggcagggcaggggccaggatgggaacagagttggatgggctcagcctgcaccgaactgttggcatgttaccaatggtaggaataagttcactttagatgcctcaatatgttaccgagtctaaaattcttccctgactacaataccacgtatagcttgtcccgaactcgcaaaaccgtttcaactttcgtcctaaggcagtatggctcccagtttcatccaacgtggcattttcactccggtcagctatgttgaatcagcatagtagctacacggggccctacatgttagcagccaactcctctccttctccccttctctctccatctgccctctcaacagtggcgctatgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttatagcaaacattaggagactttgaacgggtcgattcagagttcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggaggggcgaacgccacgacgaccgggaacgacgagaggacgacgacgacgacgacgaccgggaccggcgagggggcgacgagggcagccggcagtggctgcacagagacggggacgacgcggaacacgccgcagcgatgacgatgacggaggcggcgccgcgagacgacgagccgagcgaggatgaacgggacgtcgacgacgagaacgatcggagacgacgatgatggaccgcggaggggtttggatggaggggaaacgatgccgaggacgaccttgccgctgcgatgccgaagatggtggtggaggtggccgaccgatgcacggcgaggagggacgggcggccgaacaactccggtgaggcggacggagaggttcgcggcgacgttccggcgaaaccgagggcaggccggggtggagggcgatgcggcgacgccgagggaggagacggcgacgtcggccgacgctctggcgcggcgaccggggcagccggaggagatgccgccgaggaggaaggagaaaccggcgcgggcgacggtgttccggcgaagttcgggcgaggcggaggtgatgccggggatgagagcggcgtcgtggagccgaggaaggtggtggcgacgtcggccggcgctccggggacgtggcagaggcggccggaggcggagaagtggtggcgacgccactggacgccggcgagggcgcgtctccggtgatttccccgcgaaacggagggctgaccgagggagagggggcagctgcgaggccgagggagaagacggcgcggccgggcggcgttcgggcgaggagaggaaggcggctggaggtggccggcgcgagggaaaggggagggcgacggcgggaacgtagttccgggggtctcctcgcgaaacggagggcaggccggcgtggaggaggtggcggcgatgctgtaggaggcgacgacgcgaccggacggcgctcgggcgaggcgggagaggcggctggaggcggccggcggcacgggagagagaggaggacggcggggagaggtgctgcggccgtgggggagctcgggaaggggctaaaacgagagaacgcacggagggggttgcattttatatgatgggggagggagccggccacgggaggagcgggaacggcggcgggaaccacggccggcggcaatggttggtggccggacttggcgcgtccgttcccgaggattgaaagcaccattcaaggggaaaaacgggggaaatcgaagaggaatcaatggggattaattgcccccaatcaatttggtaagagccggcttgaatagagcggatttagaggaggaatggcgctagggctcgctcgggagggagagaggaggacggccggcgcgggaggaggaagacgacgctggcgcgtgggccccacgcggtcgggcggcggcgtcagcgcgcgcacgcgcgcgcacgtgcgcggcacggggcgggggcgcggctagggttgggccgggcgaccggcccatgaggagaggaggggaagcggcttgggccgagggaggccgggaggaaggagggggggggggaaaaaaagcccgggagagagagggggggaaatggagctgggccgagaggggaggaggcccaagaggagggagagaaggagagggagagaaagagagggaggagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacacgctagcagctagcccacgagccacgtgtgccaagccatcctcattcggtgggcaacgaggacaggatcatcgacgcagacgaggtgactggcgtagctgttggcggcaaggagatggcgcgcggtgaggaagagggagctgagtcggagtaggccggagccgaggaaggtgaggcaagagggtggtgggctatggaaaccttgagttaccctcagcattggccaccgcccaccgaatgccggcgacctgccgcttttgtccccgtcgccagccggatgcctcaagcgctcaagctcacctcatggaaggcttcttgtcacgccctgaagtttcccctttttcttgccttcaaaaaaaatggttaaataaattgcccgaagaaatagtttaattaacctagagttgaatccctaattaataaatgcaattaataatcggaaatagtgtggtggaatttttcttgagttccccatgccctaatgcattaacaggatttttagtggaattttcagagccctataaataattttaaccaattaaaattcattaaccgcaatatttaatcccaggaaatccttttcctttttcttctttctttcccttcctttttctcttgacgacctatctctctcccgcgccctccctcttgctgggccagcccaagccgccttctctcctctctgggatgctgataggtggggcccacctatcaggtcgtcccctacctccagccgcccatgccccggcgccaaccgccgctccccacgccgcccaccttccccgcctcccgcgtctctcccgtgccttgagcccacgtcgccgcccacctcctccacctctcccgctctcgcgcgcgcccgtttagaggccgggattcgaatttgaatccccctcctctctctctctctccacccccacgttgctggccaaatagggggccaccccagccgtttccgcccctcccgagcccataaaatcacttccccgagctctctctctcgtttcccccattcgccgtcctctcccgcgccccctaccacgcccgcgccgtcacaccgacctccgccgcccgctgccgaccttcggccgcacgccgtcgctgctaggctcgccgccgcgccgcgcaaccgccgccgcagctagagctacctcggccgccgctcgcttgccgccaaacgtcgccgaagcgccgtttccatcgcacgccggtgagctctccatttccgcccaactccggccggccgctctagtcgccgtggtcatcctcccctcctcctaacctggtcatcgcctttcccaggttgtgcccgaccccgtccgccgttgttggaagcgccgccgccgctcgtctcttcccgcgccggtcgtcgtcatcgcctcggtgaggaaacccctctcctccttcctttcctctctctcgcgagcgccgccgccctccgcgcgtgcgccgtcgtcttcggccgcagccgccgccttcgcgccggtcgccgctgtctccccgcgccgccggtcaccgccggtgactgcgcatgcgcgcgccgccgcccgcgccatccgatcggcctcccggccgatccggacagttggtcccgtggaccagcggtggaccacccgcgtggtcccggtccacagtggaccggtgcctctcccctccccttgagccactgcccgtgggtcccacatgtcggcgctgcaaccccccccttgggtgacgtccgccctggggatttattgcgcaataaatcgaataaggacttttctttattagtaaaaacacagtttatcttctaaaattcataagtaattcatccgagctccgtttaagtccattcaagtctcagtaaattcatacaaatccctagaatccattaaaaatggttttgtttcatgtttcagtagtcttatagcatgttttgcttgtgtgctttgtttgtcgcgtagatttcggtcgtttcgtcgacccgcggtttctcgaagac

SEQ ID NO: 74789 - DNA, 16585 bp, Oryza sativa
tgggacccagggtcgggttgccagttcggtctgaatcatcataggccttgggttaaggcaggttcgtgtgggttcacggccttgattaataatattgtatagttctagcttcgtgtttacagaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgctgcttttctctttgtttttgtttgtagatggccggcagcgttacccgtcgtggtttgagcatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgctagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaacctgcagctcaagaaggacctcgacgcgttggaggcgcagccgcaccagctcaaggtcgcccagggagagatcagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggctcgcgtgtgtttttcctcgtttgtctttttgagttgtgtggggcatggttacgccggtgtgtggtgtaactatgtcggagcctgtcttattttatttgcctaagcaacttgaaccttaatgaaccaatttaatagcagtgataaatttaagaataatagtagtcgtgggtggttagttttaatcgtcagctctctctctctgtttgctggttctgtgtggggttttcagatggtgtcgaccaggagaaatgttaacaccggtgaaggcaaccaacccgagggcagcaaccccaacccccaaggcaatccacctccaccaccaccaccagacaccaacgccattctcacccagatcctcgcccagcaagccaacatgatgaatgctttcctccaccacctccaaaatccaccacaacagaatgctccaccacctcctccccaacactccaaactcgccgaattcctccgcatccgcccacccaccttctctagctccaacaatcctgtagatgcgttggattggttgcatgccgtggggaagaagctagacacggtgcagtgcagcgacgaagagaaagtcatcttcgccgcccatcagctgcaaggacccgcatctctctggtgggaccatttccaggctgcgcagccagaagggcaaccgatcacttggactcgcttcaccgccgctttccggagaacccatgtgcccgctggagtcgtggctcttaagaaaaaggaattccgggagttgaagcaaggcaaccgctccgtgatggagtacttgcatgagttcaacaatctggcccgttacgcccctgaggatgtgcgggaagatgaggagaagcaagagaagttcctggcaggaatggaccccgagctgtccgttcgtctagtctctggggactacccggacttccaacgactggtggacaagagcatccgcttggaagccaagcacaaggagctggagtcgcacaagcgccgcttggcgaacatccgcaatcaacagggtgctaaccagagggtccgctacaccaatccctacccagggggatcctcctcgcagcagcagcagcagcagcagcagcaacctcgctccgcgcctcgacctcaattcgtggtgcgcgtcccacagcagcaaccgcagcagaatcagcaagggactcgtgcaccccgtcctcctacgccagctgggcagcccgttcaaggccgcagggacgcttcaggtccgcagcggctgtgcttcaactgcttcgagcccgggcactttgcggataaatgcccaaagccaaggcgtcagcaaggccaagcgcctccccgccccaacaacggtggcaaggatgtcatccgtggtcgcgtgaaccacgtgacggccgaggacgtgctgacaactccggacgtcatcgttggtacgttcctcgtccattccatccccgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccccgccgttcctatagaaattcagggaattccttttccctcggatctgattctgttagacacaaagaacttggatgtgattcttgggatgaattggttggctcaattccaaggagtagtggattgcgcgagacgcactgtcactctgtaccgaggaccggaacagccggttgttttctttgcacctccaacctctgtccgaagttcagaactgcatcagataggtctgtcagaaatccccatcgtcagagagttcggagatatttccggaagaactacctggtatgccgcctaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagttaccatcaaaaacaagtaccctcttcctcgaatcgatgatctgttcgaccagcttaaaggtgccactgtattctccaagattgatcttcgttccggatatcaccaattacgtattcgtgaagaagatattccgaagaccgcattcaccacgcgatatgggctgtatgaattcacggtgatgtcgttcggtttgaccaatgctcctgccttcttcatgaacttgatgaacaaagtgttcatggaatacttggataagttcgttgtggttttcatcgacgacattctgatatactcacaaacagaagaagaccatcagcaccatctccgtctggtattgggaaagctgcgggaacatcaattgtatgccaagcttagcaagtgtgagttctggttgtccgaagtcaaattcttggggcacgtgatatctgctaaaggagttgctgtggatcccgaaacagtgaccgccgtcaccgaatggaagcaacccaagacagtcactcaaattcgcagtttcttgggtttggcaggatactaccggagattcatcgagaacttctccaagatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgtcctcatgaaggcaactaccctacgcatgacttggagctagcagcggtggttcatgctctaaaaatttggcggcactatctcattgggaaccgctgtgaaatatatactgaccataagagtttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaactctatggaacggaaagcgggtgtgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggacttccaaaaacccaaggaggatatgattccatatgggtagttgtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcgtatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagtcggagaaagccaagtgttcgggactgatatcctgagagaagctgaagctaaagtcagaatcattcgggataatctaaaggtggcacaatctcggcagaaaagttatgcagataaccgtcgtcgtgacttggaattcgcagtggatgattttgtgtaccttcgggtcacgccattgcgaggcgtgcacaggtttcagacgaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtctccgagtgccatccgagcaggccaactcagagcaaattgaagtccgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcctgatctcttcgccagttcttccgaatctcggggtcgagattccgtttaaggggggtaggtttgtcgcgtcccaaatcgactctaaaatctatcctcgaaattgtgcaaaagaataattaaaattcaatgtgaaagcctccaacaattaaaatgtgcaaagatgaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctgtcatcttcctcctcccgccgcttccgccgccgcgcccgtgccctagcgccgccgccgccgcgaatcccgccgctcccgtccgccccgcgtgcaatcaagaggggggatttactccccgcgtttccctcccccgtttccccctctttcccctctctctctccctcggattcgttcgaatcaagcccgtaatcgtcgccggcgcaatcaatggcggccgagatccccgcgcccgtttcctctctctccggccgctctttccttcctccggcgctatttaaaccctccccgagctccgcccttccgtttccgccgctcaccgctcgctctcgccgtcggaatcgtgctcgcgccgcttttccttctctccgccgtcgccgacgagttccgttccgccgccgccgccgctccggttctcctcccggctcggcgacccctccttcggcatcgccgcatcgccgccgaccccgtccgccgctccgcttcgtccgccgaccgccggagcaccgtcgtcatcgtcttcccgagccgcgccgccgtcttcctccgctccgtccgccgtttccgccgccttcgctgtctcggggtgagccgtggaccgtccccttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggaatttttaattgaaaattaaatgaagaaattcgcaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgttgaagtcgaagccgtcgattgggaaaacgagcaaggcaagacacatcatcttgatcatattgaatcccagtttacaaaattatgttgatttaaattattgcattatcgctttatttaaattcccgcgttatcactgttttatttagccatgcctatttacctttgttatgaccatattattattgttattgttattattactaccttgttcaccctagacaaacaaaacctcaactagtggacactctactcatagtaccactagtataattctaggtagatgcttcgcaagttaattaggcaacattaggtggttttacaactctagacttgggaaattctcatatcacttggacactctggaattgttggattattgtggaattggcttcacaccgccccctctattcaaaattccctaaaatggttttaggctgggctcggggtgcatggtttggatggtagcaccttggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcggaattgggtcggtactcttgtctaaggctaggatgggttggaaactatgtcacgtcttccgtctgtataccgtggtggtatgtggcacgtggtaacacgtgaggaagccgtgtcttgtgggtaaagatgtacacctctgatcagagtataatctattcgaatagccgagccctcggatatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattgtatagttctagcttcgtgtttacaaaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacatccatggtgcgtcatagatctatgggctgggatggtggatcgattcagatcaggaaaaaaaaaggaaaaaatgaagtgggggtgagagtggttggttgggtacaggaaaaatataatatataccagaagcaaagaagttgtttttatcgaagtaaatcatttactccattagtggtgggagcgggatgacaggacgtgtggtgggatcggaagcagggaagttgtttttatcgaagtaaatcatttactctgataatggtgggagcaggatgatgggacgtgaggtgaggtaggccttggctgatatatgtttggcgctcggaatactagaagctcctagtagtatctctataataagatgttttaaaaaatcaatggtcaacaatacaaatatttaatttaggacaaaattaaattgaaactgagggaatacatagaacgaaattaatgtgatttggagaagtggtttcctttatatgaagaggattatgtcttgcagatgcattcaggagattcaaaggagaggatggcaggttcatcaatactggaatagctgatgaaccgagggggttattaagtttatataatgcagcacatctcctcatccatgatgagccggaacttgaagaagcaatctctcttgcaagacaccatcttgaattaatgaggggtggaggtgggctcaaaccccctctagctgatcaaatcaaccgtgccctagatttaccattaccaagagcctacaagagaatagaaacattgcattatatgctggagtatgggcaggaagaagggcacaatgtggatcttctggatcttgcaaagctagaatttaacctgctgcagcatgtccacttgaaggagctcagaaatttttctcagtaagcatgtgtttatttgttgtacggggtatatatatatatatatatatatatatatcatctaagtaaatggatatgataaaagtaattaactctgcgctttcaaaaagtagctaatcatgataataatatcaaatgatatgcatgtctcaatgatgttctactttggtattaccagaaaaaccttgttttggcaattcatctaaacaatcagccgttataaagtctactggccctgcatagagctggtatacaaatattttttatggaatatttgtatacgatcgatggacagtttgttcaaatggtctctattggtagtagaatcgatatctagactgcccatcgatcgtttatgttccaacagtttgtatctatttatactgccatctcaactactaagtagttctataatatgttttatactggtattaaaactgacaaattaacggttgctatcactccactagtgataatactagtatagtagtagagaccaccgtaaaggtattctcagtgaaatggatcttcacattggtagtattttaggtctgcttgataggtatacacgtccacattattactatcataactaaacacaatgctactctatcttaaatacagtattaaacatgcacctgaatcacttaattttcaggtggtggaaaaatatctatggatatgtgcaactaagttacgccagggatcgtgcggtggaaagttacctttggtcctatgtcgtgttctacgagaaagatttagtgctttcacggatgatctttgcgaagatatttgcactgcttgtaactatggatgacacgtatgatgactatgccaccatcgaggaaagcaggaagctgaatgaagcgatacaaaggttggattaatatgaaaaaaaaacagggcaaatatccttgagatgaaaccacctgtgcggtagtattgcgaaaaccactccacaaccgcaaactatacttacaagtttccaaaagttcccaaacaaattctctcaaaaaacctgagttacgaatacttttttgtcaagttggtgagacaatattttttaaaaaatatgtaaatttcaagatcttgaccaatttggttcaaaaaattacaaaatttggaggtttgaaaagctttggaaaacaaaaataaatcaacatccaactgttttatacacctcttcattcttctatttgtcaatcgataaaactgaatcaattacaattcttgtattttacattattgtttgatatgcaaagtaaattttttgaaggttttatgtatattgtatctttcgtgatgtgccaaaaactgacagggaaataggaaaaacctttatgttcttgtcggtttttaccatctggctcatcacgatttgcatcatagcacttctaattctatacctgattttttctgaagtaccacatgcaaggatcaggaagaacaacctatgcatacacactagtatcatggctcatgaaatcgaaaaggcaaacattaagtaagagatgtgcaactatgtgatacaggcacccttgagggttagggtttgaaccatgaaatttgtccattgtttcgccactaaaaaataaaaagaggcaacattgatgccaccatcattatccttgttaccgtcttttctcaagtaatagatgaaccaacaatttgcaagatgttgacacaccgtttagagctataatttagaaatcatttgtccaagagtttatatttttatagtacaagccattataagggtgtatttggttcccagtaaagattagatatgatatggccattcatattttcaaagatatagttcatgattcaattttttatctagttggatggatgggatgatccactttctttcttagatggacgaggatggattgaatgaaaacaatgatctattattaacaataaaatatgttaattcattagtattaacataatttttactaattaagaaaaaaaagaataattatatataatcaactctaaccttgataagttaattatcactaatcagttagtaatttttatcaagattagcaagggacattatcctcaatccgtcaattttgcaggatgagatcattcaacatattcgtcgaatgttccgtctcacagcctccgtgttcactactgcccactcactataaacgtgcacaaaatttgccacccttccatttaaatataatttaatgtgttcccttttttgcttagtggccgttacaacctgatacctccctaccaaaccaatgtgcttatgcttgccaattgccaaagtaatttcatgcaaattgccaatttgcttattggacagctgggatgaaagtgctatatctttactaccagagtacatgacaaagttctacaatacattgctgaacaacttcaaggagtttgaggctcaagtagatgtcagtggtcagtacagggttctgcgcataaaaaaagaggtatacctattatatgtactttgttggtccacaattatttcaagtgttttgatttgtccaagaaattacacattgaccatgaatagttcataaaaaatatatttttgatagcttcaaaacaatcatcatatcaataatatttgtcgcatgaatcaattggtataatgttttcacatcagtttatatatatatatatatatatatatatatatatatatatatatatatataaaagtaaataatggccgaaatttgtgatgtttgatttttttaatgtagatgcacactgtacataagtgggtggttggatggagtactagttcattataattcttagcacacatttatataacagatagttaaagtactgaagtacctacgttttgacttgtagtttccatcaaactaattttttttttgattgtataagtattttgactatggcttgtccaaatcgacaattagcatgcctggatcatgtacctttgtgttgagtactttcgtagtgcagccgaacaacaatattgcaaaatttgtatgactaattaattttattcacatgcgtgtagttccaaaagttatctgcatattatctccaagaagctgaatggtctcatcaaaattacaagccaagctttaaggagcaggtggctttgtctactttatcatcatcaatgccactactttgtgcaattactacagttggccaggatgatgtagtaacgcgggaagcatttgagttggcaacacaacataatagtgcagtattagcttgtggaaagatattacgcttcatgaacgacatcgctgcattcaaggtacaaatgagtaactcaactgggcttaatttgagtacatgccttgtacttccctgatttctcttgcggctgaatttttccatatccatcatatacacactagcaaaatgcagcctacctagtaaaggatattgatatcatactacttaattatctcttcaccaatattaatttaatggtggatagtttaatttgtcacataatgctagctacctgcagaacattgaaacaaggaattccaagaaaacctagatatgtataatgtaactgaatcatatttctctttcacaaacatgcagtctggaagaaagaacaagggagatgccacaagcaccgtggagtgctacatgaatgagcacaaggtaacaggcgaggaagccatagccagaatcgattcaataatagaagatgaatggaaaaccctaaatgaagttcggtgtgagcatcctcagctactccctgcggtgcaacgagttatgaatttagctatttctgtgcccttcttttacaacaagaggagcgatgcatacacatcctctaaatatcttcataagattgttgaatgtctctttgttactcccattcccatatagaccatagtttatcagctaccagcaatgtggccatatgtctatgtacttttatgatgtcggtggctatgtaccacctgtaataattcttatgcgtgtatactgcacgtacattggtaaacaattaaaagtaaataaaaataccatgctcaaaagtgtataaccatttctgatgtggctaaagaattcgtgcaagatggtttacatgggtcattggagattcctcgggttaacataagtgttaggaaaagctttaatagtaagagtgagcgaggtacaactcattcgaatttgtcagaaattgaggtatataacattgttattggtatttgttacgatcacagataagttcacaagcgcccagttatcattgtagcaattcacctcagagtattccaaagatattgaatcttagggaacttgtgtgtataatctaagaagccggattcaaccaagaacaacaactaatggcaggcttaggttagagaggattcctatggattaattaactataccaaattaaggtaaaactctattgattgcttcgggcgccggatctcccttgatctgccgagttaaaccgacctgccgatcgaatttcgctcccatctaccgtagtaattggcgtttaaccaaagcagaagataacatcagagagtatcaaagctataaattagtcatttgcctaaatcatgccaccgccattgaatcgaataaccgatggcaacatcgcaacaaggacgctgcaccaaccggtaacctccaatgcgacaccgttaagaacatttcaacatttgggatgtcaccatcgataatttggatacccagaacagggatttaacttggaatgtccacccgtggaacaagtgaggaagtgggtgttgggacatcacatccagtaaggtgtgtggggcccatgtttatcaccattgtatgtccttgagaagcccacgatgatgatgctggagtggcccatgatgatgatggcgtctactgaccaagagcggcaacacagaagctcggctgccagaaaggttaatggaagatgggctagagggttattagccctcctgcggcattttaaccattgccacacatatttctcccgccgtcagttctcgttgcaaccacgttcatcacaatcattgtcacgccctacagaccaggcccaaccagatccagatttagacaatgtggccctcctatcctgccgcttcatcatccatagttgcagggtaccccatcgcagccatcattcaggagttgaggtgagccaatataccacaatgccgcagccggatctattctcggagacccagatatttggactccccacgcacctatccctacctacaagtgcccaccaccgctccgcagcatggcaccactcccacaaagccgctgccacctcaaatcacggccgtgcttgaatgccttgtgctaccatggagattgccttgctgccggcgggcctctgatggctcgtacaggcggcggcgaggcaaggagggagaggggaggttggttggtggctagggtttgaagtaggtgtatatatctctaacgtccaacacaacatcccgtatgttatagttaggtcgtcaacattttatccataaattgtagttctctcaactatttggaagatcgtttgatcctacagtatcgtcgatgaacaacgtgcctagacagctttaatttttaatccacatagctccacatggaacccaaccacaacctacatctactctttgatctggaaactggaattctagcgagtaccttctcttctccttgtctaactccaagttgatagtctgcgtcaccctccgcctgcggagagtgtcgggcatggctgatatttctggttcttccttgctagtggagccacagtctgtcacgtccctacatgtatatatgtggaaacgagctcatctagctacatcgttgtcaaaatcgagaaaattgcactattgggactgcaaacatgggggcttcgctattttgacactctaagtaaatgacaaatgggctcatctgtgtctatgaaatgtgggtccagtgtccttatagcaaaggttaatgtttgcaatgtcataattgcaaatccaccgtcaaaatgaagtgtacaaaatacagactagtctttttgtaggcctcaacacagggatgtcctcatctgaaggtcagtgtatgaatgtggtcaaaagtgtcaaaagtgttaatcaaaagtagtacttcctccgtttctggttataagactttctagcattgcccacattcttatagatgctaataaatctagacagatagcatctatatgtagatgatgtagtcgtcaagactaagcagaaggatgatttaatctcaactcaaattg

SEQ ID NO: 74790 - DNA, 34917 bp, Oryza sativa
gtattcttcataacccagttatacacttcagcaagatttgttgtcatcacaccatacctcgatccgtctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatcttttactcctgaattgtctataaaaattagccccaaaatgtcgcatgcaccatctgctatgtaaatctggccatggcacggactgtgtgacatcttcttgaagcttctgtatcgctgatagcaaacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaaacccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatacgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcatgtaagtgacctttgtcatgaaacatctgtccaactttcacctgcttactatcataacaccaatgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctttccttgtgtattaccctctactacttcttcccctcgatcttgctcagtccgccaaacattttcagcttgtccaccttccaacggagtttcttccaccacgacatgacttgactcccccgatcgatcgacacatgttgtcttctgcaccactattgccaggctatagcctttctcccttactttactaacaaacttcctccaactcccagttgacgcaacctccactactctccactgccatccatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatctaccccgctatcacatatttgtataggagcatcgccataatacagacgaatgggcatatcacctgacatcctaataaaacatgacaaatagtctgacgtttaatcatttaatcattcgataattaccctattacaacttatactatattgccgtgtactaatttacaactattagtaacaaacaactagttttgataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaagtcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccatccggcgctcacggcgatgatctggcgactctcggcggcagctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgatagggacctagtttcgcgattttccccggttggccactacttttgcgattttccataaaaataatattaattctcaaaaaatttcaaagaaagctagcaagcggcccaaacaaagcagcagcaggctggcccaacagccagcccatagagttgagaagcaacggcccagcacagtaccgcgtaacactgtatcggtactccctctatccaaaaaaactcaacctaataagggatgtatgtgacccttcctaggactataaatctgaactactcttttgtccaaattcgttatcgtaggaggagtcacgtcttctcttagattgagttaacctagtttttttggacggaggaagtaggaatgcctaagactgataacacgaaataaggtttgtgtttacccgaaacgcgaagcagggatagaaaagaagatgcaattttattatgtaaaaaaataaaaaagaatcgtatatttatagtcctaggactataaatctgaactactcttttgtccagattcgttgtcgtaggaggagtcacgtctcctcctagattgagttaacctagttttttttttacggaggaagtaggaatgcctaagactgataacacgaaataaggtttgtgcttacgcgaaacgcgaagcagggatagaaaagaatatgcaattttattatgtaaaaaaataaaaaacaatcacatgtctttcttttttttcataaaacaagtaatcacaaaaaaatgaattattcttgttgaaaaaaaatcacataccttttttaaaaaaaacatgtaatcagtaacaaaatgaattattttagaaaaaaataaaaaagaatcgcatacttttttttaaaaaaaacacgtaatcaccaacaaaatgaattgtgtttacatcaagaattttttcctcatcacatcacttttttctcattcatggtacgatttccttatgatttttcttagagtgaaagtattctttttttttttcattcattgcatgatttccttccgactgttttttagttaaagccattctgcgattggagtgtagtgagtgtgatcagatagctagccaaaatcatttcttctactgtgagtactctttacagtatgacaaactagtgtttatcaatatcaagtaaaaaaaatcatgcattgcaaccgactcataatttctttctaaggtttcgaagtttagtctgtaatacataatttcattttaaagtgggaataatagttttcttataatcatccgcgctagtggatttagagcaattaataattatgtcatgttagcgtttttgttgcaccggtggctttataataacttcaattaatctggtggcttcatgctctcacactcactactacttattttggcttcacccagtgcaacgcatgaacattttactagttgtttttataattttttgaaattgaaaactctggatacggaaatggtatcgaatttcatcgaatacggatatgaaacaaatacggtaacttaccagaatataaaaccctgagtaaattgcacgttaggtcatctgttttaaccaaatgttttaatttagactacatagggataagacaacaccttcacttagaataaatttcacgaaaacaatccgtaaccgattctttcctggagtctgcctgtctaaccgtcatgcaatcgaatactgtcgcgtacaaagacggagcaaatacaaaatggaatgaatatggtaacaaatatttatcggaatataaaaactcaaactgagatacctgaatcaacaaaaagatatgacttgttatttttctaaaataaaaggtcaatatttctaaattttatatcatcaatttccctaggcggttacatgactttttgtgaattgatttccatagtccatcccttgaaaaatctgcatgtgaaaatgagttttcacttcctggtgccttaatgggatccaagatatcttcctccactccacgtgtagcttactaattaataatctcatatatcaaggtctcgctgtgtagattgatgatgctattcattttattttacctctccgaagcatgtaatgttttatgcactcctaatatttttagataaaatggtcatagactagaaagtagtaaatcccatcgagctatacaactttggtatagagcatgtccccatcagagattgtttgaatcatagatttatgattttacaatgaatattttgtctcctaaatgatctcaaatgataaaggtgtcagcaataaagttgtagatctcatcaatctctacaattctgatataaagtttatcttcatccgactttatatgataaagttacgtacacatacgtgttttgtttttttgaaaagttgatcctccatctgaccgtttccgatatccatcatatactagtcccaccgttttcgtttccatttctgaaaataaaactatccatattcgtttaccatctaaaaattatctatccaagactattcgtttacgaaaatgcgtctgaaaatcgaaactatccgaacagatttcattcctagtctgggcaacacaatgatttgtgctgcaatcctgcgagatccaaaagcaacgaatgtatgaaaaccaaacaaaacctacatagcacaaaacctatatgttcctcttatttaataatatttaaaaattggaatgtcagttcttcaattcttctgatgcatgcaacttcaccaagttgctagtatatactgtacacctcttcttatttaattatttgaaaattaattggagtgccaattcttcattcttctcatccaacttcaccaagttgctagttctgtaacctcttgtggagagtctaagatgtccctctcgatggtcatcatctcatttcaggctattccttgcgctgagtcgtctacgatgtccctgtcctccctcttgctgataaaaaactggggtatgatagcatccgcgtccctacgtttctagtattatgtagctttctagtttctaaattcaagcaatatttatgtacaaatgagttcaccttgtcattgtcaaaaatcaagtgtagatttgaattagctgctagtctttctgtagagataaacatatatcaaggaacagtacgtcgaggaatctcaaatcaggtaatgcgaaaattaaataatatattggtccagcaaattaaataataatatctggactattatttaattttcctcgacgtatatgccttgatataatggactaatcaaattggtttgcccattatagactcaattatgtataggtccagcaaacaaatgaccaatgccatgtaccatgcatcgatcgaagcctcatgtgccccaacataattattcagtaaattccacttgtaaaaaaatacacttttgtaggtgcttgataacccatttaccactataaaaaataaatttcgcatatgaatcccatatcactgtgcaaacgggtcaaatttttagctacacatgatagcacaagtgacagcctaaagtcctgggtgggggtgcgatgggcgtcctcctacgaaccgcttaattaaggtccgtcccgctccgcctgtgtatacatatgtgttttttttaaaactaattgcctgcagaaatcaaggatttgcgcagggaaatagagcctcaaatcaaggattcatgaaaatgaatgtccagaacaaaagcgttttacgatcttcatgcaactgacaacctacagaaatcatggatttatgcacatggatttcacaaccgcacctgaaaattattttatttttctcaaaaatagatttcttcttttttattttttaggcacaaccaccaccctccccctctccccccaaaaataaaaattttagtagttatctatatagggtagcaggtagtgtaaagtcaaaaatcacacgattttacactcgtgtgtggtatatatataggattcaaacctagcacctcttactccacactccacgcgtaacggttttacaatctcactctagtttgtgagcatggtatgaatgcccactttacctctctagaatttgtactctctagcttgttttcaattgtaagacgtttagtgtctttatcccttatctatattcactagcatttccctcatctatattcactaacattcatataaatttagacacatatacgaacttattttacatgaatctattcaaaacatatcaagtaacatatagatcatgttgaggtctacaactttgatatacaacatatctctatctgaggttataattttcttcatggctcttaaaatcatgatttgaagatgcagttttcttaaaaaagatatccttgaaaatgaacctattttacataggtagttttcttaagacccaaatgtaaaaaatggatttttaacagacagtttatgacattgaagtggcatgaaccatcctctcagccggttttcttttgaggccatctataaaaacgaaagcctagagtctgcgcaaataattttttgtagtgttcaaatcaaccttttcccccttaaatttttcttgtttattgtggatattttcttttttattcttttcattttttgattttaacttttatttcctttgttattattatcatatgccagatatcaatgtacattactaggtaaatagaatttaggaaaccaaatgctaaattgaaagcaagatatacagggactaataaggctgcgttcattcggacgagaatgaagaaatctctcgttttccacgcacacgctatccaaacagttaaacaatgtattttttaaaatattatataggaaaatttctttgtaaaatcataataattcatttttattttttttaaaaaataatactcaattaatcatatgctaaagtctcaccttattattttaaaaatcttatcgttcttctcttttaccctcctatagaacggagcctaaaacagaaaattaattaaaaatcagttgaactggactgccaagttgaatatggagtgcaaataatagaataagacgtaagtagagatggaacacattgtggatagtcttgccacgtatgcagctttcctcggagagtctgttatccgccctatcgggaaaacaactaaggaaaatgagaggtcggtagaaaattcaggcagaggatgctgtcatgcatgactatggataaaaacaataaactcccttcacgtgggccattcggacacttggataaaatgtttgttttgaacatgtcatggtcagcttatactccctgaaatttgtttttgggtcaatcattttagcaagccaaatggaccaactaggcttgcaaatggtttcacacacccaaaccggtgaaagaaaaatcattgcagatagctagaatgttctatactttctgcaatttgtaaaaggaaaaagtctaaattactactttgaactatatagcgattgtacgaattacccctgaatcacgaaaccaaacattttaaaccccaaactctttataccgaataaattacactctatctcgaaccaaattagttatagtcttgattgagaattaggggtaccactactagaaaaagcatttttacatgaggacaaaactaattttccgaggcgggagggaggtccgcctgcaccacagcgactgcgaaaatcatcggggcaacgtggcccgtctgcgaaaatggaatgaacaaacaaaaaaaaaaatcaccggcccgctccgtcatcgccgccgccaccgctccacgctgttgtcgctgccgccggcctcccccctccctcctccggccagatctgtaagggaggggggaggggagccgccgccgccctcctccctcctacctccggccagatctgggagtgaggggggaggggagccgccgccgttgtcaccgccgctccacgctgtcgccgcccccgccggcctcccccctccctcctctggccagatctgggagtgagggggggggagccgccgccgccgtcctcaccgccgtggccggaagccgcgccaccttgcctcctcgccgatgtcgccctccgccgccaccgcctgccgccgccgctgcgctccccgcagccccctccggccagatctgggagggacgggctgggagccgccggccgccgcgctccccccgcccccctccggccagatctgggagggaggggccgggccgcgctgccctcctccgtcgccctcctcggctgcgccgcctcgcctcgccgctgcagccctccgccatcaccgcccgccgccaccgccgcctccggccggcggccgggtagagtagaggtgaggggaggggagaggccggtgaagagaggtaaggggaggggagaggaggagaggtgtggaggggaggagaggtgtgagacttagaaaaaaattagcatccgcaagtctatttatattcaagtctattttcgtaggtggaccacttaagcggcgcctgcaaaaatgagcccccccacgtcgggaaaaatgctttttctagtagtataattcatctagttttaagagtttaaggtttaaaatgtgtagttttgttgtttaagatatttgtgaactatcgctatagataggggagtaatttggatttttttttcttcgtaaaccatcatgttaccaatctatagcattgacatacgtatggtagcacgactcaactaccgcagcagagatcgatcgttgttccttccgcaatttggtcgacggcaggtttttccttcgcacggctgtcaaaacaacagtgcggttgcagctagcgacgatgacaactctaggttgacaatgagggccacttgaaactattaagactatatatatgtatatatatgattggagtataaaacaaaaaatgaagtacaagatgattatgagagggaagaaaatcgaaggatatgtatataaaaaagatgattaaaacgacacaatatttgtaattaagaaaacaaatttttacactttgttttatattttaagacaatttaattttttcaagtcaaacttatttaagtttgaccatatggtaacatgtacaacaccaaactagtttcattaaatatagcataaaatgtattttaataatgtttttgttttgggttgaaaatgctaatatgattcatataatgtattaaaaagtcataagcaaacatctacatactcctccgttaaataatatatctcacgctatagtaccgtgtttttttctttttttttttgcctgcgatgttgacacgttcgtccggtgcatatattctagtgctgtaccttttttttctaattatatttttgctgacagatctactaatgtttattttgacaaacgaaatcttattatattttatgcatgtacttactcccatttttttctattgtttgaagcgacatctatgatctatctctatatttattaacaagccaagcaactacccaacgtcgttgtttccacagtgcgtatgagcgagcgagcgagcgatgagagagatgcggcgttggtgcagcaggatgagcggtctcgtgtgggtggtgcttgtgtgctcatggacatggaggatcgcagctgctcaggctccgcaaccaccaaaaactgatccactcgagggtaagttgtactactacatcgatcttaccagattttttgatgtatcattttttttttgttttgtaataaagactctgtaagtttgtttggctcaatttctacatatataccaaaggctgagtcaatatggatctgatttgtccgaaagatcatctcataccatgtgcaaatcgtcgtcttgatcttggttttcctccatcgattgcaggcctctagcttgcctcagaaaaagaactagagggaacttgattcattttatagttctgcatggacatatatacatgaacactaattaaacagtaacgctgagtttaaccatgccagcggcggccctgaacacgatactgggaagatggggcaagaaggcgtcgtcggagtggaacataagcggcgagccctgcagcggtctcgcctctgacaaaagcgactgggataactaccccaacatcaatccattcatcaagtgcgactgcactttcagcaacaacaccctctgccacattaccagactgtaagtatacgcttccacgtcttctctctttggtcaggtgtgctgtgcactatgagttcaatgaagtgccctttgtaaagagttcgtttaaatatttgatctatatatttgatggttcaaatatatgtggtcaagtgtcagactgttagtgactgcttgttttttgatctagtgtcatctagttcagctaattaactctacatgtgttgcttgcaactgcttcctaccataaaatatggtccattccaaccactgcttttgatccaatttgtttatattgtactactgtgtttcctctatttcttttttctttaaacaaccccgcacaagatagcacgacgtttctattgatacagcagaaaaaaaaaatcacaagtccatagtcctgcgagacaatagttaggaaaaagaaaaagacaaccacaccacatatctacatctcctaatgctaaaatcgaaacaagcacacaacaaccctaaggaatgtgtcttctaaatgacgcctccaaggagaaaacgacgctaagagcgccgccaccgcccattctaaagaatcaggacttagttttcaccaaaataacccattgggagagaagaggaaacatagcaatgccccaagggaaaagcggggtccgtaggcgtcgccgttgccggcccgaaggctaggccttcgcccatagttcctactctcccgcactaaagagtgcatatcagattcagcagaaccaccaaccaatccccttcgacacatagcaactacgccggcacctcgctgctggccggtcatcaaagagagtctcaaactccggcgcacttcaactgcatccacgtggttgggttggaggagagaatgagagtgaagaatggatcatctcttccccgtactagcttgtccagcatggccatcttatggcagcaagccaccgcagcaaaagcacaaacgcctggaaagatgcttgccgcaggcttcaacgttcttctcatagcactaccattgtcaccacctccaccaagctaccattgttttcgcaatgggccgctaggtatcatcatcattgcttccatcctctcaccacggcagccacaccgccactgcacaccagccatgccatgctcgcaccatgacgccgtttgcaccgaccttccatagcccttggtggcctttcactgcctctgctctcgccacgttagactcccacagccccacctcatcgggtgcatctcctagcgccaccatgcctactaactgccaccaccggacgctcccagtagggttctcctatccccgccgccatctccgccttcctcccaccgacggtgttgcacgggtgagcccaccatcgatggtgcagcatcgcgcctttccgcctccaaatgtctgccccaccacctccgatgtccaccacctccacactgccgcgccccaccgcctccccgccgccactagctcgaggatcggctccctgcgcctgggaggctggatccgggctgaggggctggatctagtagcctccttgccgcctccacgtccacgctgccaccgacatctacactgctgcctccacgcagccgtgccttggcgcctcgccgccaccaccgccggatctagacaggaggatgccagatctggccagcggcatcgtgcctcgccgtcgtcacattgccctggatctggtcggggtcgtgggcttcgatgccgcgacctcggggggaagggatggccccgccgccgccatcctggcggccacgtagtttctggtagcctgctcgaggggcggtgaggtcgaggagggagataggcagggatggtggcgcaccggctgggggcgcctcccgtgtcgcccctgccctaggagtgacgtgggggcttgcctctatttcaaattacttgtgcttcaaatgcactaagaatcctctcttcacgactgtcgatacctaaacttgtcgtccgtgtcattttccgatctctcaaaatatattttcaggacttcaaacttgtcaaagtgtgccgttgcggtcccacattatcaatagacgctcatgtgaaatgccacatgggagttgactcattttctttatcttttttctcccctttttctttttcttctgttcttccttccttttggtgtggaaaaaaggagaagggaaacacaaagggaaggaaatagaagaagaaaaaattttgggaccggaatattaatgtgttatgtcacattagtgtccatgtgacatgccacataagcgccatgtaggatctcggagggtcgtggtaatttgagaccataatgacacattttaataagttcgaggacctaaaaatgaattttgacagtttagggacctagatgacatagacgaacaagtttaaggacgggcaatacactttactctaaaagttatatctgacattgattagtggacattatagtcggagtgaagtatgccgacagtccctaaattagtgcgggtgtatcatctaggtctataaactatcaaaatgcattctcggatccctgaacgtgtcgtgggtgtcatataggtccaagcgggctccaagtcgctccgtgcgttgacgtggaatgccacggtgacatatacgtgttagtgtgacccacatattagtcacatagaaaagtatattttctcctccctttctccttctggatcttacatgaaattagaggaagataggggggagagagaagaaaaatatgtttttttaattttaatatcttctatgtgaatgacatgtgggtcctgttgacatgtaggtgccaccttggcatgtcacatccacgcatgaagtggattggagcccatttagaccttgataacacccattagaagttcgagacccaaaaataaattttggatgttcagggacctagatggcgcacttacactagtttagagatcacctgtgtacttcactcaattttaaatcgcaaaaattgttttttttttgttggaccgagggagtagtactttctatgtatatacaacagtgaaatgatcatctctccatagtaatggccgcagtatcgttttttcgcatcactgtcctctctcatctaaaccctagccacttgctaccccccgcctccacctcgctgctgcctgagcaggccaccggagggcgagcgatagctaggatggctgcggtgaggtcttcctcgcctcttttggcggtctgagccagagatgagggacagtgagcaacaccagagttttttttttttgactgaaagtgagcaacaccagagttgagggacaatgagcatggcttgagcggcatgaagggtgatgagctgatgatgctgtcgtggccacacgcaggagtgctaaaggaacccatgtgttggatgtagtgcaacggtcggctcataatagggatagtgaatcccatgggctagatttggccgaatggcaatgatggatggcaaccacataatgcctatcagtggccaaggtggcacatgggcattgggagccgtgcagtggtgccgttggcaggtgcggcctaggtgggcattggtattctcgagcctacaagccacgcctaagtttcagttgtgccggtgtcgcgagtggtggtgtcagcggtggtttaaagcaaggacatattttttaagatttgaagcttagtattctagctttcttttcagtcctctagcatttttcttgttttttctatactagaaaaggtacctgtgcgttgcaacgggtagagccaatttaatttgtacatatgtgtcagatagagaggggaagacatataggtcccactattattttgaaaagttttttctgccgacttagcataaaccattgtctaaaccactaatggagctaatttgcaccggttttttaagttgagggaagcattatacccggttctgggttgagagatgccatttgatcataggcaaaacaggagataggtaaaatagacttattccttcccctcaagtttacagcccatatatgttagttcagccagctttctacaacccaattaaatttgagaggatccattatatgccactgactttgtcacatgtttacgatttgtctctgactttgtcatgttctataatatgccatcgatttttgcttaacttctacaatttaccatcaccgtctggttagcctctgttagcactgtacattttttttccaaatgaccaaaatacccctaggacaaaaacttccaaaatttggataaaattatcaaaatatcatattataaacataagattgtaaacatccaaattttggccaaaaacataaaatatgatatttcagaatttttatccaaattttgaaagttttgccacagggatattttggtcattttgacaaatttgtacagtactaatagagactaaccggacgacgatggtaaatcgtagaagttaagaaaaagtcgatggcatattgtagaacgtgataaagtcagtggcaaatcatagatgtgcgacaaaatcaatggcatataatggattctctcattaaatttgcactaataaagcatgaaaataatccttttctttacagctcgattcaatcttcattgtcagtccgagcgagtgaacttcggctgaattgtgccgaactgagctgatacgacaatggaaacaaatcggacaacgcacaaaattttcaggcaaaaacaccttaaacttttataattgtagagatagagatagagatagagattgtgaggcgtggggtttaaatactcccgattgtaactttggctgcatacatccaactatggacaagcccatccaaatttcacttcttttgttttcctctgaaaccacaccagtccgtcccaaatttggtatgccggatgaaaaccgggtattctatttttttttgggtgaatcggcctgattttgtacgttctttgggcaaaccaaatgatttgggagttagggtaaaaagtgaatagttctcaacaatccaagggaaaaaatagaattatttcatttacttatcaacattgattactttcttgtttttgtaggagggtaacaaatttgagcgttgttggcgaaatacctttggagctgcagaatttcacctatatgctggacctgtatggtatctatgccttatcatcttaatcctgataatcaatgttaattttgcaggaaatataaattcaactccttgttttgaatactcaactgtcgacatcctggtgaaaaccagcaaatagtagtcgggaatgcaagatttttgtgttagctaactgacatgatgtttcttggtgttgttgcaggaacctgggctataattacttgactggtgccgtgccatcattctttggaaagtttactttcatgaaatatttgtaggagctatacgtcaatttctcaaattcatgtagcatctatagattggtgttttgtgttaactatttttcatcatttaaagggcttttcctttcaatgcactgtctggaccgcttccaaaggaacttggaaacctcaccaatctcctctcgctgtaaggacttgtttttcatggcagatcaatcttcaaatataattttgcgactgcctgaactaaaataattatactagaaacgattaatcacattttttctcgacaataaatttactgtaaattcagaagtctatatgttagtcctgtcggcatatcttagcctgtaagtttcaagttgtacttcacatgttcaaggaaaattgacctgaggaaggcttgaaaatttattatgtaggtcagatggctcatcaggttaaactgagcccctttccagctattagaggaatatagctaatttattgtcatgaaatattcgttttgattcaggggcattagctttaacaattttagcggtcaacttcctaaagaactgggcaatatgaccaatcttcagcagatgtaagatgcaccatttctaatatccaattgctatttatgaataactaaattttgttatgggcagatatattgttgtacaggataacacttcaatctttcaataacaggtacatcgatagttgtggattcagtggtccgttcccttcaacattctcaaaacttcagaacctgaagatcttgtacggtcaataccatagccttagacattatatatgttcgtcatgttttcatgctaaatgtctaacatttggatgcggatgcaggaggtcatcagataacgattttacagggaaaatacctgattatttggggatcatgcctaagttggaagatatgtaagattaattatataaacttgttgacataccactcagtgtatcttattcagagacaaatggaattgttcaacataaagtttctgcatgtgtttttccatctgaactcaaacaatagaatttttcaccttccagtctgcatggaattagagtaatctgcatgccatgttgatacaaacaactttgacttaaaaatgctcatacatggagcttacttttctctattagaatgagcttcgcatgtctgtacttttctgaaagtgtgagcttgtagggctttccaaggaaattcttttgaaggaccgatcccaccaagtttagctaatctaaccaagttaaccaacttgtaagtacattgttttgggtatcattgattcgatgatggctgagagcctgacaaggtcaagctagataactgatttgtaaaatatacaaatgagcagacggattggtgatattgtaaatgggagctcttcattggcctttatcagtaacctcacatctttgagcaacctgtatgtgatgcttttacacatagagcttatagtattcacaaagtttcaagttactgaaatttgatctttttgtcacagaatattaaggaactgcaagatatctggcaatcttgcaccagtagatttttcgaagtttggagttttaaccctgctgtgagttttcactcttagcattgctacatgatttattgtgcttttaatcatttcttcagattgtgaagcatctcttgatgtaaaaaatctgtcatgaatcacagggacttgagttttaacaatatcacaggccaaattcctcaaaccattctgaatatgacaaatcttgaatttctgtaagaatgttttcattgccttaattaagtttacacaaataaaagctgagctcatcattatgttccatcatcttgtaccatatcaggtttcttgggaacaacagctttacaggaagtcttccagatgctataagcccatccttgaaagcgatgtatgtcaaaaagaccaaaatagcaccataggtcaaattattttcataatacaatgtactaatttcatatgtactgaccgtggactgtttgtagcgatttttcctacaaccaactcaccggaggcttgccttcttgggctacccagaacaacttccaattgtgagtatgaaattctgaagtttggattgaagaatagtagaattagatattctaatcttttattttgtactagaaatttggtggcaaacaactttgaacttggtaccataggccacaggtacttatgacatttagttataattctgcaagaggttaaccatcaaaagaatgttactcacaacttttatttttttaattaaaattgtccacagcactttaccttcaggactaaactgcctccagcaagacaccccttgtttccgtggatctgcagaatgtatatttctttctcttcatctacagtagtagttaccatgagcatggaaatttgaatgattgattttacaaatcttaattccagactattcctttgcggttgactgcggcaataatagaacgactagaggcttagatggaactatttacgaaccagatgctgcaaaccttggggctgcatcatattatgttactagtgacacaagatggggtgtaagcaatgtcgggaactactttctggctacagatggagtgaacataataaatagtccacagaaaattcagaatgtccttgattcaagattatttgaaactgcaaggatgtcggcgtcgtcggtgaggtattatggccttggactcgagaatggaaattacactgttctgcttcaatttgccgagtttgcttatccagactcgcagacgtggctaagcttaggaaggagagtttttgacatatatgtccaggtaaaaattgactggcttgtttactgaatttttttattctttatctgaaccagttgcaatttgcctagggtgatctaaaagaaaagaattttgatataaggaagatggcgggtggaaaatcttttactgcagtcaacagaagttatactgcaagagtgtccaaaaatttccttgagattcatctcttttgggctggtaagggaacttgttgtgtacctactcaaggttactatgggccgatgatctcagcattaagtgtcacaccaagtaagcgcaaccattatgttatcttcaacaaggattatatggaatctaataagatcatttttttatacagattttactccaacagttcgaaatggtgtaccaaaaaggagaagtaaagcaggtgcaattgctggaataacaattggtgcattagtgttaggagtagtatccttatttggaatatttttgttggtaaagaagagaagaacaatagcagaacagcaagaaggtattaattatttttatagtaattcagtctaaaactatttagatgatttactctttctcatctgaccatgaaaaacaagcagaactgtacaaccttgctggacaacccgatgtcttcagtaacactgaactcaagctagctaccgacaatttcagttatcaaaacatcattggggaaggcggatatgggccagtgtataaggttttctattatctgttactaataatgtgcaaaaagagacgagtatttatttcattttctattaagaccagaattttggtaatctttatgtgcatgttcaaaatatacatgtaataggtttcttcatttggcagggtaaactacctgatggaagagttatagcagtgaaacaactttctgaaacatctcatcaaggcaaaagccaatttgtgacagaggtagcaacaatctctgctgtgcaacaccggaatcttgttaaattgcatgggtgctgcattgatagtaaaacacccttgttagtttatgagtaccttgaaaatggaagcctggatcgagcaatatttggtgagttcaatgatgcaaatttccagcatatgacattatgcttggttgatttcactaatacaattttgcttcactaagacaagacaatttgtttttttttgtattttgccaacaactgagttatttctgcttgcacaggacatagtatcttaaaactagattgggcaatgcgatttgatatcattttaggcatagcaagaggcctaacatatcttcatgaggagtcaagtgtccgcattgtgcatagggacatcaaagccagcaatgtcctacttgacactgacctcaccccaaagatctctgactttggacttgccaaactatatgatgagaagaaaactcatgtgagcacaagaattgcgggcacaatgtaagaacatttaaccatttctcttcttaaaaccgcaatatcaatatgattgctactattaatttatcttatctttgtcaaggggctacctagctcctgagtatgcaatgagaggtcatttgtcagagaaggccgatgtttttgcatttggagtacttatgttggagactgttgctggtcgatcgaatacaaacaactcccttgaggaaagcaagatatatctcttggagtgggtaagctgatcaatgatctttccatcccagaaaacattagttcgttcgtgtttattgtcttctgctcactgaacctatgtttgtatataggcctggggtttgtatgaaatggggcaagctctgcgcgtagtcgatccatgtcttaaggaatttgatgagaaggaagctttcagagtcatctgtattgctctcctttgtacgcagggctcaccgcaccagcggccgccaatgtcaagggttgtggcaatgctcatcggagatgttgatgtggctgaggtggtcacgaagccgagctatatcaccgagtggcagctcagggatggtgggagcagtagctacaccactagtagctatgcaggatctagtaaccctgagtttagtaggcagagggagaccaaccctctcgcacggtcatcaccaacgatcaccaaagctagtctggtgggaaggtgagaattgaaagttgaattgctgcaggtgattgacccttggtttgcagtgacaatattatacgttggtgtgaattggagaaaataacataattacttactctggtttcttgtctgaaaataaaagctttcctcctataatttttgaaaggtgaattaatgtggcgtattattagtattctgagtgaataagtgtcagcaacagttgttgggtacagaattacatcatgcttgtcaaatgaatgtttgatgaggtgtacaatgaaaggccatatggacatcaatccaacaatgagaaaatggtttatggcagaaagaaatactacttcgatccaaaaatataagaagcttttgggttgaacacaggtattaaaaagtaactaaaattaattggaggaatattgtgattggttgataagagaaagtagatggagaaattaagaggtcgacgcatgcgattgcttgagaagagaataagttacatttgggacaaattttcaattctagaagttattttatttcgggatgaaggaggtaagagatttccagtattcagaaacttcgatacgaataagttcgattcttcatggcccagcaacaatggacaggatacacaactagaacctaattcatgtaaaagaacagactcgtcatagtaacacaaacactagatcaaaacaatgacaaacgtgcaactcaaactaaaatcaagaccggaacttgacacaacaattcaacttaaaattctgctcagtagactaatggaacgatgcaacaactcaagttggcttggtaatggatataatctttttatggctattttctggttaggtagataaattactactctctctgtttaaaaatagagggaaactattttatgccattgcgaacaggctctagctgagttggttaggtggctctagtaacactcgtcaggtcctaggtttgactctcagtgggagtgaattttaggctggggttaaaaaaaatcccctgtcccatgccaaagcacaggtctaaggcccagtacatgtcgttggtcattctcacacaagttacggtgtcactgtatgggtggggttggggttcggggattttttcgacttgcatgaaaaggtcttcttctatacaaaatgcttgtgggtgttggcaactatttgtgacaagttgacaatgacgatcgcagcaccttaagccttgcggtgatcctagagtcgccaaccataactaaaccggctagcggagccgatttctagataattacccgtctcgtgggtaaaacgttaggttttcaggacaaacctacaaagagatgtcgcactcttgcagcggcggcgaacggtttacggcacaaaccgacaaagatggacaaactaagagaaaactaaaagcaatatgaaaaacgattcgattgattgattgtagattggtttttttcaatgaaccagccatgtcccttatataggggttggtcttgccctctacaggccctcctccacgtccaactcggggtagaaactaaaggaaacccgaaacatgccttcccgagcaaggaaacctcgagacccgacgaaacacagtcgggctcggacctgccggtcagaccggccctcaactggcggtctgaccgcccaacacacggcggtcagaccagcccactcggaggaaaccggtagatttccaaattctggcaatttttcctattttaattcttggtgccaaattttggtgtaaacacatgcccccctgccttttcgatgaacaacgtgaatctaaaagcatagaacatgttttggtcttaggacgataatccaattactggccatagtatctcctaagcgtcttgccaaacgctcgggaagtaattcttcaagtatttcccgttgattgctcgctgaaaacgctccccttgaagtgtctccaaaaaatatgcgtttcctcgaacaatgccgcatactcgataaggaccctcccaactaagagaccacttaccgaactccttggatcgagtacccaaaggcaaaattgtctgtcaaaccaaatctccaacttgaaacaactttgctttcacccttatattgtacgccttggccacccttttcttctcattctctatctctttcaatgccttcaagcgcttgtcaatgacttcatcaaggttatctcccataaacgtcttgtaatcttcacttgacaaatcatcttgcttgatataatgaagagaaccaagatttacctccaccggtaaaatgacttctcgaccataaaccaactcaaaaggagtcactttagtggcaccatgtttagatatcctatgcgcccataatgcttcggaaagcacctcatgccacctctttgggtgttcctcaatcttctttttcactaacttcaacaatgtcttattactcgactcggcttgtccattagcctgagcgtagtaaggagaagaactcaacaatttaataccataagattcggtaaaactcttcacttccttagacataaaagaagcaccttggtccatagttaatgtttgcgaaataccgaatctatgaataatatgcttcaaaataaagtcaattacctccgtatgagtcatgttcttcaaaggcacagcttcggcccacttggtgaagtattccgtagcaactagcacggacctatgcccctttgatgacgaaggacaaatttgaccaatgaaatccaaagccctacatcggaacggccatggtttcattataggattcaacacggcggcgggcgccaattgaacattgccgaaccgttgacaagcttcgcatcccctataatatttgaagcaatcatcaatcatcctcggccaatagaaccccactctcctaagcaaccaattcatcttgtgggccgattgatgagttccacaaattccttcatgtacctctcccatagccactttagattgatcttcatctaagcactttaacaagacacaatctatatttcagcgatataactctccaccaaacaaagtgtatttgaacgtgtaacatcctcaaattttaaactaaaatttgactgcatcatgctggcttttgattaaatttgtttggttcaaaaatctatttgatgtttatttaaaaattggttcaagtattattagaacccttccaatttactctaacttattccctttattttaaaccctagtgaatttgagcaaaatctctcaaattcaaaccatagattatttctttagcctatcctattattagtggagttttgctatactctaaaccctagtgaaacccttccaaactcctagtttgaattcaaatcttttctagggaaatattcaaaaattctggaaattcactgttcattgcacccaaggtgctcgacagaatgcctagcccaattagagcaacccaacttcttccaatcttgcacaaagtttagatttggtcctaggggaccacaacccactcaaaaccgtggctttctttgcctcttcctccccttcgcgccgcccgggcatccgacttagccgcgcgccatgtcgccgcgcgtcggcctcggagccgcctgcgcatgcccgaccgccttggcgcgccatcacccgtccgatgccctcagctcaccgctgctgcaccaatcttgacgacgacaaagccgggatgaccgccgctgcacgaaatcgtcgctcgacgccgtgcgctcccatccaagccgccgccgagtgcgatttcgcttctacccggggtgaatcgcgccaattcttgccgcacggttggattggagatagacggtggtatcccctctcacaattcaaaccattcaccccaagtcggccgttttcaccctcgccgccgccgcgcgtcgtgctcggattggcgtcaacacgtcgccagccgattccaaccgcggtcaagtcaatccttcgccggtaagtattcgaacgtggcctcccgccactcaaatcgatcttgcccgccctctctcagcttctgccacctttgcctcatccaaaacccgagttcatccatggcgatgacggtgcccgagctcatccggtcctcctagccctataaataggaccccaatcccttccctgtccatcatcgatcatcaacaaccatagccccacaaccccaaagctctgcttcaccaatccatctaatcaaccaccctcgctcgtcggtcgaacaccttgtgcgcgatcgactcaacccctctccatccatcctccgccctaaataacccttagaacacctatatcctaccatgttctagcataataagccctaaccaaagctctacgtcgagttttacctcgccacaccaagccgagcattgccgcccccacgctgctctgttcttcgccgccgcgaagtttttccggccgcaatccgtcgtttcaaccaacctcggtgagttcttccgtttcaaccatctacatactacctagattccattttagcaatccttttgcacaaacatgccgccctctgagctgccgacgtgagcacggccgccgcctatggaggcgctcgtcggcaactatgtttcgcaccttgccaaaggttggcaagctgccccggaatccctctaaatacctcatagatgctctggaacccctcccctagccatgtctaactcttatcaccttgatcgccatctcggcctaaccgtgccaccgccgccctagccgctaagccgtccatgcatcaaattaactcctccgccgccgctcgccgtcgccggagatccctagctccctcccctcctcggccgcaaccactttctccctctattgccgccgcaatcctaaaccctagtgccgccagcctgacttggggaatggccgaaggtagaagaagagaagagagagagagagactaacaggtgggacccgcacacagtgccatttcacatttatttgattttcaaactttagaagcccatatcttttaaaatatagatccaatttcaatgaaacttggaccaatattcttctaaaatcattctctatcttttggaccctttttgctatttttacattttattttattttctctatttttcttatttttagattttatttaaaactcctttttgaatttggattttatttgtctaaccctaggtcttgaggattcctctgacactctagataatatcaatcaatctcaggacatcgagcaaggcaagtaaccatatacctgttgatcatttaagcctatattttacaaattatttatttatagccttctattcaatattctattttctatgcataaattaatcatagaaacccagataatttagtattgcttattttgcttacaatctggttaaaataccctatacttaggttggaacaatacgtaagatttggatgatttccgggtggctagtattgtctcaatcgatataagttttacaaggtacttatgtcgaacgaacgggtacgaccgcagtttctataatggggacagacctagttattaggttaattggcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacggtcagttccccttaaatatctcgggaacgccacaactcctcttgctgctgttaacattacgttcagagcatatgaggatataagttcatggaacaggtgccataattgttaatgacttaatactgggccatgactaaagtcgatgattatcagcaagtcgtggactgcaggtaaagcgtacatctgctgcagtagaatatctttgaaactattcgaatagccgtactcatggagttgagtaccgggactcatatggtaccctggttagaaacctaaagtttatatgttttataaactcttgctatgatttttccagattgtccaatactgctttttgcaaagaaccctattatatgtcaatgcacaacatatttccgtgataacttactgagtattgtgaatactcatccttgctcttataacccctttttcagatctaggtcaagaggaggacccttatgactattactacgaagaccccgataacttagaaaatccctaaaggttatacctcactagtcagaatgtatagaaacttccgctgtgtattaattagataggtgagtacctattattgtaaaacccatagtattgtaagactttaacgtatgcaacgaagaaccagttatattgtatgtatcattttttactgatccagggattgatacattaatcttagtcggatccaagttgttagttttgggtcccgatagaacgcttgccgccaaattttccaatcaaccttaagtgtaggatctttcaaatatcaaatcaaaggaattctccaatcttctttctcttcctgggtacaaatgtccaaatttacaattaattcaacctctaaattgattgaaacgtgccccccagcgctctgcccagaaccggtcagaccggccacacagggccggtcagaccgctcggggatgccggtcagaccggcggcatgtagccggtcagaccgcccctggtcaccagtcaaaccggccacgcaatgccggttagaccacccctggtccccagttttgccaatttcgcacaaaggtttaaaatcaagctccgactcttccaatactagaaatattctcttcttcacattatagccagatgcttgttgtgccaagtcatttgctctagaattatcacgcctagcaatatgtctaatagcaaaattatcaaaattggcaataatatccaaacatgaatcgaggtacctatttagtgatccgtccaagcatttataaactccagcgacttgttgcaccaccaattccgaatcaccaaaagcctccacgtacttagctccaaccatctccataacttgttagccgaataataaagcattatattcggcatgattatttgtacaataatactccaaacgaaccaatgcttcataacacatgccattaggtaaaaacaaaactacccctataccttgaccttctttgcaagaagaaccatcaaaataaatcttccaaggtataacttcaactaagaaaacctctccctcataagcgatatctacatgatgatccaccataaaatcacatacaatttggcctttcatagatttcaatggttcataagccaaatcataatctatcaaaacatatgcccacttgccaattctcccacttagaattggcctttgcaacatgtgtttaataacatcggcttgacaagcaattatgcatgtactagataacaaataatgcctcaatttggtacaagcataatataagcatagacaaagtctctctataaaaacatacatcgtttcggcatctaaaagacggcggctcaaatatgtaatgatatattccttgccatcttcctcttgcgttaaaacggcaccaatgactttgtcttcggaggcaatatataaccgaagaggcttttcggctttaggcactcacacaacgggtggagtagacaaatatctcttcaactcttcaaacgccccttgttgttttgcccccccaagtaaaatcggcttattttttcaagcgaagtataggaacaaaagcatcgattttacccgctaggttagaaataaaccttctcaaataattcaccttacttagcaacttttggacctccttcttgcatgtcggcgctttgaaatcacgaatcttttctatcttattaggatcaatctcaactcctctctcatgcaccatgaatcctaagaactttcctgccgacacatcaaaagcacatttaagtgggttcatctttaaaccataccggcgcatcctctcaaaagctaacctcaaatcagctatgtgtccttccataccatccgatttgacaacaatatcatcaatgtagatctctaagataatacctagcaaatcatgaaagatcaaattcattgccctttgatatgttgcaccggcgttcttcaacccaaaagtcatgacaacccactcaaacaaaccaacaaatcccgggcacctaaaagccgttttgtacatatcctcttccgccataaagatttgattgtagccggcattaccatctagaaagctaatcaccttatgacccgaggcatcattaatcatcatgtcggctataggcataggatactcatcttttggggtggctttatttaaatctctaaaatctatgcaaactctaatcttaccactccccttcttctccaccgggactatgctagagacccactccgcataaccaccgggatcaatcttctctttgactcggtcatatagcaaaggattaaaatgacgaggtggttgcttataaggcctagaacccggtttaattggaagccgatgctcaatgagctcacggctaagacccggcatctcatgatattcccatgcaaagcaatcaacatattctttaagtagctcgattatcttaaccttataatcggctctcatatttttgtttacaaaagtcggccttggtttcattccatcacctatgtctacttcttccaaaggattggccgatgtaaaccatttccctagcttctctacttcatcaaaatcttcaacggtttcaccaatatcgttctttgtagaccgatattcttgcaccctcttttgtaaccactctaaattagcctcgttactcattatacaaatttatatggcttagccgtgctacactagccggctttacagagataggtacaaatttgccatcggagatactaataaaatcataactagaaagatccctccccgataagcattgaatattcccatgacgccactcaaaagtagcatcggccattgcaacctcggccgatgtatccgcttgaacaatttcaacatcatcaccgtcccattgaattaaacattgatgcaaggtagaaggcacacaacaattggcatggatccaacaacgacccaaaataacattgtagttaccttgcacatcgacgatgaagaaagcggttggtagcgtcttgtttcccacggtgagctccgccgaaaagataccctttgcctccgttggttcgccattgaagccattgagaatcatgttagtcttcttcaactcatcatcctcacgccccaacttcttgaataatgaatacggcatcaagttcattgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgttggcttcaacttccacgaagagcggatcttccgaagctgcagcgtctacacgaccaacggaaaagaaacggcttttactctactaaactccatataacaagcagaaacaaagcacaacaatgggttcttgacttcttaaggagaaatcagagacttgaacggtccaattccgagttcaaatggtcaagttatggccatttgaaggttatatgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccccgggtcgacggcgacgacggaaatggcgaccggagcggaggaaggcggcggcgcggctcgggtcgacgaggacggcggcgttccggtgatcggcgggcgaagccgaaggaggcgatgccgaagcgggaggaggtccggggcgacggcggcggcgaaccggagctcggcggcgacggcggagaaagagggcgacggcgcgagctcgattccgacggggagaaagagcggcgagtggcggaaacggaggagggaggcacggggaacgtttaaatagtgttgggagggggagagagcggccggatgagggggaatcggccgcggaagatccggccgccattgatgcgccggcgaagttcgcgggggagtttccaaacgaatccgagggagagagagagggaaaagtgggggggaagagggagggaatcaaggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaaggccgatgggccgcgggggagaggagagagagggagggagctgggccgagccggcccaagagggggaagggggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggaagcgacaaacctaccccccttaaacggaatctcgaccccgagattcggaaggactggcgaagagatcgggatgggctgccttcagctcgtcttcacgctcccaagtagcttcttcttcggcgtggttgctccattggaccttgcaaaaacggattacccggttcctggtcctgcgctccatggtgtccaggatttttactggcctttccacgtaggtcaagtcttcgcgaacttcaatttgctctgagtcggcctgctcggatggcactcggagacatttcttgagttgcgacacatggaacacatcatgcacgttgcccaaggaggcgggcagctccagctggtaagcgacttctccgtgccgagcaatgatacggaaaggacccacgaaccgaggtgcgagcttcccttttgtctgaaacctgtgtacacctcgcaatggcgtgacccgaagatacacaaaatcacccactgcgaattccaggtcacggcgacggttatctgcataacttttctgccgggactgtgccacctttagattatcccgaatggttctgaccttcgcttcagcttctctcaggatatcagtcccgaacacttggctttccccaacttggtcccacaatagcggtgtccggcacttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtataagctgcttaagttctctgttatctggaacgcatacccgttttccgttccatagggttccgtgctcatcctctgtgaaaccagcggctttaccctgtttcatattcttgaggagtccatgca

SEQ ID NO: 74791 - DNA, 20962 bp, Oryza sativa
agtccatgcatgtccggatcattcttctgagcctcgcggatttgatcgagcaaggtaggcttggcttccaacgcagccaagaatccacgactaactatgcttaggttccgggctgccatctgttgattaagttcgggtggaatgccacagatgttaagagtgttgcaatggctctttcgacttagagcgtcagcgaccacgttggccttaccaggatgatagtgaattcccacatcataatccttgatgagttctaaccatctcctctgccgaagattcaggtccgactgagtgaagatgtatttcaaactcttatgatcagtatatatttcacagcgattcccaatgaggtagtgccgccagatttttagagcatgaaccaccgcggctaactccaagtcatgggtagggtagttgccttcatggggccgtagctggcgtgaggcataggccaccacatgaccgtcctgcatgagcacgcaccccaatccttggcgcgaagcgtcacaatacaccatgaaatccttgcgagtatccggcaagattaacactggcgaggcaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcgaacttgagtgactgttttggattgcttccaatcagtgacagcggtcactgtttcggggtccacagcaacacctttagcagatatcacgtgccctaagaatttgacttcggacaaccagaactcacacttgctaagtttggcatacaattgatgttcccgcaactttcccaacaccaggcggagatggtgctgatggtcttcctccgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagtccgtatcgcgtggtgaatgcggtcttcggaatatcttcttcacgaatacgtaattggtgatatccggaacgaagatcgatcttagagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtgctcggacgtatataccccttttctgtcaactcttccaactgtttcttaacttcggccagttcatttgctgccatacggtagggtcgcttgtacagaggaatggttcctggagcaagatctattcggaactcaatctctcgcttgggcggcataccaggtagttcttccggaaacacatctccgaactccctgacgatggggatttctgacagtcctatctgatgcagttctgaactcctgacagaggttgggggtgcaaagaaaacaaccggttgttccggacctcggtacagagtgacagtgcgtctcgcgcaatccactactccttggaattgagccaaccaattcatcccaaggatcacatccaagttcttggtgtctagcagaatcaaatccgagggaaaaggaatcccctgaatttctatagggacggcaggactataatactttgctgtcataacccctccaggggtggtgatgagcagagggttcctaagcctttctacccccaactgatttcttcccacgaatggcacagatataaacgagtgggaagctccagagtcgaacaaaatggtagcagggatggaatgaatgaggaacgtaccaacgatgacatctggagttgtcagcacgtcctcggccgtcacgtggttcacacgaccccgaatgacatccttaccaccgttgttggagcggggaggcacttggccttgctgacgccgcggttttgggcatttgtccgcaaagtgcccgggctcgaagcagttgaagcacagacgctgcggaccttgaacgtccctgcggccttgaccaggctgcacagttggcgtaggaggacggggcgcacgagtcccttgctgactctgctgttgctgcggctgtgggacgcgcaccatgaattgagggcggggcgcggagcgaggttgctgctgctgttgttgctgctgcgaggaggatccccctggatagggattggtgtagcggaccctttggttagcaccctgttgattacggaaattcgccaagcggcgcttgtgcgactccagttccttgtgcttggcttccaagcggatgctcttgtccaccagacattggaaatccggatagtccacggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgtccctctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtgggggtggagcattatgttgtggcggattttggaggtggtggaggaaagcagtcatcatgttggcctgctgggcgaggatttgggtgagaatggcgttggtatctggtggtggtggtggtggtggaggcggaggaggaggtggaggtgggctgccatggttgttgtggttgctgccttcgggttggttgccatcactggtggcagcatttctcctggtcgtcaccatctgaaaaccccacacagaaccagcaaacagagagagctgacaattaaagctaaccacccacgactaccataattcttgaatttattactgctattaaatgggttcattaaagttcaagttgcttaagcaaataaaataaagacaggctccgacacagttacaccacacaccggcataaccgtgccccacacaacccaacaagaagacaaacgagaaagaacacacgcgcaagcctactaactgctcgtctaccgctgcgacgggccagggcggaaggtgagcaacagcgcatcctccgtgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcggcgcttggggcggcagacctctccctgggcgatcttgagctgatgcagctgcgcctccaccgcgtctaggtccttcttgagctgcaggttctcctgacgcagctcctggatcttcatgttgttctcgaccatcccacggcgcaccatctgatggaagtcgatacgagccgcgtcgtacgcctccaccatgcgcgccaggtgcatgatggtagcgtcatccttcgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggcaagcggcggggaaggaatccccacccgcggtgactgccagcgaagtccgctcgggagagccagagaggatcactgcagtaacctcccaaccagcgtggggctctgcgtcatcaccctcctgctccggaagcggcctggcctggtagtccactccatgtggataccctaggaccacgcacatgccccgcagctccaagacgaaaccagtcatgtccaaaccacgacgggtgacgctgccggccttctacaaacaaaaacaaaaagaaaagcaacattttaaaggtcagattttggcgataaatgaagcagcaagacagagagagactagacagttttcacaaataacaaaaggatttttatttttgaaaatattgctaaggcttgggatctacggctcgtcctagggtcaagggggctctgataccaacttgtcacgaccggaaataacccaacgggcgttccttacgtgcgtgcattaatccttgtcccaggaggtaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcatgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcctagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatctgtcacatcctgattttcgtttcaggatttataaattatttaataaattattaatagaatttatattaaatgatctttaattttcaagtgaagtaaaatgtgggaaataaaattttctaaatctaaagcatggatggatttaatttttgttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccatataaaatttcattaaatactttgcttaattctataattcctagatttttctgggatttatttgagctaaggaagtatttttaataaatggaattgcatttaagaaataatttaattgaaaaaggttttaaaaaagtcttcttttggctttgggccgaaagccggcccaaaacccttctctctctttccctcggcccagccggcccagtccgccgagccgccgctcttctctctctcggtgtcgctgacaggtgggtcccacctgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgacgtcggtcgccgtcgccaccatcgggttcgccaagtcgtcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcttaataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgcgaaggttcacgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttctcgattactttattccttgataccttgggtgattataattggactagttgagctttatatatattggttcaactagatgttagatataattgcttagccatgcttagaaacattagcacactattgggataacttatgactcactattatttaatgatggcttaatgatagttcacgatggtcaatcgtgattgattaattaattacttgccaactaaaacttgataatggtgggttgtgagcacatggttttgagagtcgtgctcatggcaattaaggaccggttcgcgagctactattgtggaacattaaccgtgccaaccacaagccagcgtgggcaacggctttaccttttgtatagcatggttcattgcggggcaccagactgagaagtggcggagataagcccacgggggtcgctggggagtccatgccttgttttataagggggtgattatgatccaggaatggtgcactgtggtgagttgtgttatgcagagggtattgtcatagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcatcattgtaaaagatgcttaaactggtaataatttgattagctcctggtttggagttagatctgttcagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgcaagtgtgtaacgttattattatgatggatttgtatattaaattgtcagtttgtgtacctcggctgattcctggacgaggattttatgcacaaatgagttcggaaattactagtgaatttccgggcgtgacacaatcccacctacggccggaacccccgggacaggcaggtaggactgagcccctagcagcaggactccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgttggcttcaacttccacgaagagcggatcttccgaagctgcagcgtctacacgaccaacggaaaagaaacggcttttactctactaaactccatataacaagcagaaacaaagcacaaaaatgggttcttgacttcttaaggagaaatcagagacttgaacggtccaattccgagttcaaatggtcaagttatggccatttgaaggttatatgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccccgggtcgacggcgacgacggaaatggcgaccggagcggaggaaggcggcggcgcggctcgggtcgacgaggacggcggcgttccggtgatcggcgggcgaagccgaaggaggcgatgccgaagcgggaggaggtccggggcgacggcggcggcgaaccggagctcggcggcgacggcggagaaagagggcgacggcgcgagctcgattccgacggggagaaagagcggcgagtggcggaaacggaggagggaggcacggggaacgtttaaatagtgttgggagggggagagagcggccggatgagggggaatcggccgcggaagatccggccgccattgatgcgccggcgaagttcgcgggggagtttccaaacgaatccgagggagagagagagggaaaagtgggggggggaagagggagggaatcacggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaaggccgatgggccgcgggggagaggagagagagggagggagctgggccgagccggcccaagagggggaagggggggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggacgcgacattcatggcggcacctccatccactagcatcctagaaaccggcttcccatcaacatggccatgttgatatccacgtcttcttttggagacgattcacctttatcaaccgattgttcctccttctcctctacaacaaccggtttttccttttctatggatttatgcctccacaccggtggtggtcgcaactctatgaaccttttatctccttgctcttcagcctttttctctcttagttcttgagcccgaagacgttgcaaccttctcttctgagtagccgtcaaatccttaggcatccacttaggaatcagctctgttccaggaggtaaataatgtcctctattggtcttgttcgaagacgatgaagccctcacatcgccctttgcaaacctcatatcaaaccggcgctggagcccggtcagaccgatcagatgcgccggtcagaccgacatgtggtccgcggtcagaccggccggaagcgtcggtcgaaccgccgtcgggtcggcagtcagaccggccgcatggctgcggtcagaccggccagaaggcctggtctgaccggccgactacgatgagttggtaccgacttcggattttttgtttgaggactccccaacttcatctccagaaggtattggcacgccatgagaccccactttgatagtgattacttccgaagtccttgcctccaccttgatgtgctttccttcccttttttcttcgttagcctgattcttaccataaaaccggccgttgtttggtgaagacaaacgcgcatgaattggcctcctcggtcctccccacccttggttgagttgtattggaggcatatgactgaacattggataagaaccacatgacatgtcttgtggatgatgatatggaggtgaatgcgaccgtcttggtgaatgaccaaatcgctccctaggaggtgatcttggtcttttacctttgttgcgaattttctcaccaccttgcttctcatatttctccaaaagcatatcaaaagtcaccttggtcttcctaggggctttagaagtcaaagctctactcttattctccttccaaacgccaacctccggcttctttggcactatcatctttggccttggttcgccaataaccaccccttttctcttactagattcagcttgctccggccgaatcaacaccttcttataattgaaattaattgtattcaccggaaaaggatcatgatcaagtccttcatctatggccgattgaacctgtcgtcgaaacacattgcaatcattagtataatgagaatgagaatcatgccatttacaataagctcgacgtttcaattcttcttgagatggtatgacatggcctttaggtaatctaatttgtttctcttgtaaaagataatcaaaaatcttatcacacttggccacatcaaaactatatttaacctcactttgccgatctttgcgaggagtcggcattaggttagagctaacaaaaggcttatttttgttagtccatgaccattcagcaacatatatatcatgatcaccttcctcctcactatcactagcctcagggtaatcaatcacattaacattaggctttttgttatattcaagctataacatcggtttctaacatccctaaatctcttaatataatcaatgacaggctcattatatttttgcttaaccgatgttaaatcacataacctaagctcagtttctccagtatagaaataatcatgaaatttttcttctaattgagcccaagtatgaatagaatttgcccgtaaagaccatgtaaaagtagtaccggagaaagataaagaaaacaagcgcaatttaaaagtatcactattagcctcaccacattatactaaaaattgaccaacatgctcccatgtggtcctaccatctttagcactaaacttggtaaattcgggaactctataattacgaggaaacgtcacattatcataatagtcaggatatggctttttgtaaaccctagcacgattcctagtttcaatcccgaatttatccctaataatctcactaaatatatcctccatattatcaggcctatgctgatttggcggtggatttggtggccaaataggttgtgtttgtggcgcaatatgattatattggccttgtctagtatcgggaggataccccctagcaacatcattataagcattaggaacatgcgggggaacttggggactatttgcagcagtagatacaggaggatcaaatgttctaagatgatacaaataactagcattagtcgttggatctatcccctgtaccggtataatcgcgccggtctgaccggcccagggcccagtctgatcggcatgcagaggagcagtcggaccggcttgagtcccggtcggaccgacggtgaagtcgcggtctgaccggccatcaggtctggtcggaccggccgtgtgcgccgctccatcggttccgctacccgtttggtctataggaggttggttagcagtggtagaggctttatcttttgacatgtaatcggccataagagggccgaatttaaatcttaaaaactcatcaaatttaccctcaaaagttgcatctaacttatctttaaaaacagtcatagatgaatctattgtagatgctacttgttgttggatagattgtgttacctcttcaatgcttaccaaatcgggagcgagcttaggacgtggcccgggcttgatgatcacgccttgacgagtcctagtgcatgccctcatcagcgcctcctgtgtgatctccttgaggtactcctccatagacttgcggtcttccccttcaaaatcatccaatgtgataggtatcacattagatggctccacctccgtcttggatggcggcttcgtcttggcgaagtcgaagttgagttgacgctaaacggatctcctccccagcggagtcgccaaaaatcgtgttagcaactttttgtgacaagttgacaacgacgatcgcagcaccttaagccttgcagtgatccttgagtcgccaaccacctcgatctagcaaagagctaaacctagatgggttttgataactaaaccggctagcggagccgatttctagataactacccgtctcgtgggcaaaacggaaggttttcaggacaaacctacaaagagatgtcgcactctcgcagtggcggcggacggtttacggcgcaaaccgacaaagatggacaaactaagagaaaactaaaagcaatatgaaaaacgattcgattgattgattgtagattagttttttacaatgaacatgccatgtcccttatataggggttggtcttgccctctataggccctcctccacgtccaactcggggtagaaactaaaggaaacctgaaacatgccttcccgagcaaggaaacctcgagacccgacgaaacacagtcagactcggacctgccggtcagaccggccacacaccgccggtctgaccggccctcaatcagcggtctgaccacccaacacacggcggtcagaccgacccactcggaggaaaccggtagacttccaaattctggcaatttttcctattttaatcctaggtgccaaatttgggtgtaaacagtgggctgtcgagttttcttttatgccatcgagtttgtcctagttcaacaatttgccactaacattctctccatatataatatatcaatgacttcatcaattgttctacaatacccaaatggttgggcctttattttcaaaaatacacaaaatacccttatggacatacaacattaacaattgatttatcttattagaactttcaaaaaaatatgattttttatttggcctccttacactacacggaagtttgtatataagtttcaagatttgcatttctacttttaaaaaatataactaattcgttatatgttatgtaaaatacttttttatattgttgattttaatgtagatcatctttcgtatgctacataagattttctttttgtattattatcttttgtgtaagcaatttctctcctacagtacacggaagtatttgttttgacaaataaaaatactaaaaaacttgaaacttatatagtagtgtaaggaagtcacataaaaaaaatcatttttctttaaacttgtattgagataaacctattgttgaccttatatgtcactaaggtactttgagtattttttttaaaaagccctactgaaatgacatattatagaacaattgacaaaatcattggtatattatagaaaaagacaatgtcagtagcaaattgttgaacggagataaattcaatgcatagagtagattatctcttaaaaatatataaagtgtttcttttatacaaaagacctccttgtgattatgttttttatcagataaataatatattagtaaagcatttttagtcaaagcctggtcataacatacaaaatacaccttataataaaaaaaatggagggagcagcaaagtaaaggatacatgtatacttatcaggcatcctgtgctctaataccacttaatgtgaatcggtgctcaatattccgataaattttatttgcaggcatgaagacattaatgtttggaggtttctgatcagcctatcgtcaccttgtaactgctgcacctgcatgactcattataatcgttcatgttctcacacaattaatctaaagaacaaggaagtgtgatgcctgaattacatataaatgtttaacacattaagttagtttcgacgaactgatctagcacaaactacaaagtagaagaataatctagaaaaacctaaaccctaaagacgatgacatgtacctaattatgagtgaggtgtggtgtaaagtcatgcataacatagactagatggccaaacaaaactccatctcaacgcccaaggccctatatttggaccggaagaggtatgcgacttgatatcatgcagccatgagttggatcggtagacttcataaacattccaagaaggcccccaagcaatctcttggatcggtagctaggtttgtttgaagttgatcccgtcaggtgggccaaatctaaatccaaaacatgcagaactttattttcttcccttttaagacgacaaaagtgacatggggaaatggcaggaggcttagggaaaacctaaagctggtcccaatcatctgtgcatttcttacccatgcttcccatttcttcaaccatgcatgcctgcgttcacacggttgctatattgtgtgaacaggcttgtaactgctatgcacatactcatactcatgtatacccattaaatgataatggtatagaagaggggattaaaacccataattccaatccttaaaattagtataatccatcatactagtcatccatctcatgttgcctgctggtaaatttctccgttttcaacatacatgatgtcttcatctcggtcatgatgttggctcaaacagattgtagactaccctcaatatcgtcaagtccatcagtaagacgaccctcacgatcctcaattctgtcgggcagcggacaaccgtttatccatgcgctcaatggagttcctgatgtccattttcgcatgtatgtctttcagccttttaatcacttggtctattgcaccctacatctgagcatgactaacacactcgttgaaattcttcgggctgctatctccgctttacttttttaacgaaaactacgaacagaaaacaaaaactcaagagattattcctatcagctgctagaacaaggattgcagtggagactagctaatggaagtgtcttattaaactcttacaagtgtcttaccaacaattctaaggatagtacaaccggtggacgtgataccttgagggtgcgatctagcgactgtaacggccgaagctatgctaatcagaagtatgtatgtggagtttgggagaacaaatttgtttttggtagaatacaattcagtaacacatagtaatgttgagtaaatatctcaaagtatgtgtatgcaatcactagttgagacacgttcccaagcctaatcagtgagaataaaaaacaaaccacttaggacagttctctcacaaagtctctcaaagcagctcgaggaaaaacaatattacacctcctttatcacctttttattcacttcttttatttattttcattttcttctcaaccacaggcatgaaagtagaagcacaatatgaagaagcaactcaagctgacgaaagatgcaactgtagaattttgggagcgtcctttaaaatttgtgctagaacttcgaagctcgataactcaatcttccatgccaaatttagtaaaatttttttggcaaaccagatgaagtgcagataatcctatatactttttctatagatgtgcgtagattaattttttacccaattccatgtccatatgtaaaagttatatctgttttaagataggtgacacaagttagtgtttggaggcatacccttgtttctctggctagggtaaaattgcaaataatcctcaagaatgcatataacctactgtttaactacaatattgctgtgggtggcaaaaggtagtaggatccttgtagtcgatagagagacgatagtgaagtggagcccatatgtggtggcaaggagttgctcttgtgggggtcggtcgactacgaatcacatgtacaatttagtaacacctagtctgtccacgggtggccaagtgcgaagccgccaattgatctcgtcattccgtaaatctgatgcctgaaaaatctgagccgctttaagttgatgttttttattgggttatgttttttaaggtttgttttgtaacaatgaagaaatcaagttaacagaaccgagaaaacaataaaaaccaaacacccatccctattgtgattgattaggtcattaggataagagagtacgtggagaagtcctcatattttaaagaaaaaaaaagtatgttttacaccctcaaactatttcattatccacttaaacctctattgtaatatttttgactgattttaccaactaaagtcttgtttgttctctttacatgacccgtattttctgctagaattttgtagatccattggtaatatcattattaatgttcaactttttttgcaaaaattttcatgtgtatctttttttaaagaaaaacaataggggaggtcccccactattaaataaacatttattaatgaaagaaataaaggaaaaataaaaaaagaaattacaacaactgatccatctcatgactacattttgtctctctcatttaacctaaaaagcaaaaggagaagatcacccttaaagagctgtatccaagaagacaaagaaggagacttattatcaaaaataaaatcatttatttgctttcaaatattccatgccccaaacaagaatttttcaataaaacaatggccttgatatcgatgtctagcatccactatcttgttctccagatgcaaagaaatgtcccaagaaatacctatagcattccagcaactcctcatgaaggggcaatgaaaaaaagaagtgaaacaaattttcaaagattggattgtgcatagcacacaattcaggtcacagtttggacggccaccatgcttattatccaacatatactttgtgtttaatctgtccatcagccaatgaaacattttaacttttgaagttgctttactctttcataacaataagaaatgctgtggtagctgtggcccgggctaggtggatgcgggcgaggcctcagctcgccttgtccggcggtggtgacgggcgtgaccggcgaatcggacggcggcggcatcgggcgtgactggcgaatcggacggcggcggcatcggccacgtggcatcgggcgggaccggtggaggactaggctaggtggatctggcgggtggctgtggcatcctcgagtgtgacgggctgaaacctaggccccacagatttgggagtggcagcggcggcacatgcgagcactggcttggagaatccgacggcggcgggcttgaccggcgaaggtgcctcttttcttcctcatcgccagtcggactcagctcccgctcctgcctctgaagtgcttctaggtcctgctcgatgatgttgccgcttcacgtcaacctcctggcgcttgttcatgccatcatcagctcagccattcactggcaccacgttgatcggtacatacgctccagatgaagggagaggaaggagattaaggaacaagatgaggatattttggtccagaaaatcttgtaagttcaccaaagaggtaagtagtggcttatctcaaatatatgtaagattgtaatggcatcacttcaaatagttgaatagtaatggtatttttcaaaatagataaaattgtagtggtatgatccaattaacccaaatataaacccatgtatcttagcccggtgacaagttcacctcttctaacagttaaggttgtaaaatgagtaaaagaaatagtttaggggttaagttaaccaacagaatagttttggggagtagtattgattttttttctagtttaaaacggatgaaatatctatgttagcaggaagtgcattttggcacgttcagagcatgagagcagtgctttaactctgacaatgattggaatttcctagacgtttcagtgtttcgtcgaagaacaagttccggccggatgatgattaccgagctaggcgcatgtttcttgggtgttttgcgggtgttccttttttttttttttgtaagtttctttcgggtgttttggtcactacggagattctgctgtacagtagtgatgtctgcagtagtcgtcaacacaacagttagctggatggcgtatgtaacttggacctatttgctttgtgtaattgtgtggtatggtttatcgccacgagacacgccgcccaagtatcgacagctcagacatttcgtatggccatatagctcagacatccacccaaaggtaccatcgatgtcatcctgctagcactgcaataatcatgcgaccatgtatacataccagtcgttccgatttcacgattcttaacgttgaataacgttggacttaaataattaaaattttactaacctaataaccataaaaatatttaacttgaagacacttaaacacgacgtcaagattagtctaaaaaatattttaataaacatagatatttacttattttgtacacatattataataaaaaattgatagtcaagcatatttcttgaaactatgttattgtctaaaacgccgagagctacagaactaggtagagttgaaatatctgtttcctttatttttgtggcaaaataataaagaaactgaatattcatttttatggctgttcaagagagccgcctttgaaaaatcaattttattttcacacaggcgtgctattgcgcgaattaatcagcgatttccacccaacccttagttggatgtggttcaaacaaacaccggtgtagataagttgtccaccgtctaaagggtatatatatattagtgtagcaattgtgttttcaccctcactttcatatacaattgtgatttttccctcttttttagggtttgtcaatttgttgttgttattttgaaatgaaactaccgtttacccctagttcagatggctgttaggtgggcatgaaactattgagttaaattaaagaaaaaatatttatgaaacaaaaaaatgaccattctaaccccatgtgtatcacctacccatgtccaactcatttccaaattcttattgttagcttattgttagcttattgattggttgcttgcacccatgcatgcatccatccaccatgtgccattggcatgccgacgaagccgccaactccaatgtccaatcttgtgtcgttcttctcttgtagttgacttcctttgttcgcatgaagcaaatgtttatgcaagttgtgttaaatacaaccgatcttttatcgtggtactcaaaaaacaaatacctcggttagatttagaaccggtactaaatttatttttagtactggttaaaaaagtctaagtcccaaaaacatctttagttcctgtttaggttaccatctatagtatcagttgggaac

SEQ ID NO: 74792 - DNA, 15604 bp, Oryza sativa
  unsure (1)..(15604): unsure at all n locations
attcctgcagcccggtccatgtgaaccaaggccaaagaacacacaaacaagactaatcctgctaatttaagtgttgattaggatgttacattaacatgtaagtgaggagagagccgcatagacatacattgttcagaaaaatgtttaataaggcctaagagtgcacggagaaaaataaaaaaaaagaaattatgcaagaggtagaactgacaataataaagcgaaaatcaagtttacaaatatagcatgtctcatgcctgtatacatcgtgtcctaaccaacttctaacttggtaagcttggccattttgtgttttttcatcttggttcgcacacatcaaacatgtacatacactaaaataagtgttttacaagtttgagtactaaattatacctacttgatatatgtactgcttgttaaatatgtgatccgaattttgggcccataatatattcggattagttatctaataggacactactttataggattagtttcctattagggctcctagatttctgctatatatatcccttgtaaaccgcacggggagggtgcgacagtccaatgtatcccctgtgtttgtatccaattcctctatagtgatcattgccggtcggcgcccgtggttttttcccgcaaggattttccacgtaaaaattcgtatctccgttgtgcatctattttcataacaagtggtatcagagcattggagattcgatctatagtcgcttcgttgttgggttcgtggccatccatcagatcgatctatatgatgtcctggtcactggcgtgattccacgatcgaagaaatcgatctcatctgatcggcggcagcaggcgcgtgtcgtcgcgtcgtctcgccgatttaaagcggggtcatctgtcgactccgagcagccggcgtccacctaccaatctaccggcgtcatacacacgtcgggactcaggagatcaatctaccagcgcacgcccacgtcgggagaaaagaaagtcaggaagcggaagccaccgttcctgccctgttcatgtgaattaaatttcacgttggatttttcctgcgtgcacatatccatcgtaccagggatttaagccttgcattgttttggttctgttcaggggaacacaaattcacgttccaaattgctatgttcacaaagccaagtctaccaggaggttttttacggagatcaaatacttcgttttatgcacctagagtgtttcgcatttctgttagggtttgacaaattgtaccagcagattcaggattttattcccaaggcgagttagaagtttgatctaccactcctggattgagatgcaatctcgttatggcaagtgaagatgcaagttggcgcatgtttcaaggaggataagtcatgcacctgagattaaaaaaaagtacattcaagtcgtcgagagggagcctcgctcctgtcaagatcacaaggtgatcaaattgtccggcgaattctgctaccattgtacccaacataccaggaggttatcaggggatctaagtactttgtttttgtgcacaagaatttttcgcgtttctgtttggattccagaaattaatgccagcagatttaggattttattcccatggcgagtttgaagtttgtacatcagtttcgcgtctctgctgggttccacaatgtcataccagcaaatttaggatttgttcccaatggcgagtttgaagtatggtctacctcttctggattaagggtgttatggattatagtccaagtgactatttggcgcacattgattttatcatcacgaggttctttggagattgaagatttttatgctacaagggaaattcgtctcaaggaggagattgttaaatatgtgatccgaatttcgggcccacaatatattcggattagttatctaatatgactctactttataggattagtttcctattaggactcctagatttctgctatatatatcccttgtaagccgcacggggagggtgcgatagcccaatgtatcccctgcgtttgtatccaattcctctatagtgatcattgccggtcggcgcccatggttttttcccgcaagggttttccacgtaaaaattcgtgtctccgttgtgcatatattttcataacactgctaatgcaatttactcttacaacaatttacatttcacaatatagaagcctgtgggggccgatcgtgcgctcctaatctcttaaatactctctccgtcccattttaagtgcaaccataagtttccgtatccaactttgattatctgtcttatttgattttttttataattagtatttttattgtgagatgataaaacatgaatagtacttacacgtgacttttgttttttactttttttaaaaactttttaaataaaacggacgatcaaagttgtgcatggaaaattatggctgcagttaaaatgggacggaggggctatcaaccatatttctatgaatgcttctgaattatttttatcattgttacaattagtcatgttccaattcggagatgcatgggccgtgaatgctgttaacgtgggcctaagaaaatagcccagcaggccgcagtttcttttatatattttcccagtttttttaagggaatatattttgccaggtcaataggttaaccaccaggacttaataaagctccttagggtgaatagctaatatgggccctgaagtttcgcttcgggcttagtttagtcattgaggttttaaatcgtccagacaagtcctccaaattaattatttgggttaatataatccttggacccataaaaagtgacacgtgcgtatgccaagtcatcctcgcatgcagcggtctacccttatataccatatagaaaagaaagaaaaaaaaagaaggtaaatatttcgcacgtgtatgatcgttttagaattgtcacttacgattgctgcagccaaccacggattgtataaattccttttgtcgttcaccctctgcaacaatgttgggcctaggctggcttgttattttttctgtttgtgtctttttttttaattatgatatataagggtagaatgatatttcatttataccgctgcatgtgaggatgatttggcatgctcacgtggcgttttttgggtccaaaggctatattaacccaaataattattttagaggacttgtttggacaatttgaaacatcgatgactaaattgagcccgaagcgaaactttaggaccatattggctattcactcagctccttaaatgttgttttcgtgaaaaccgaacaaaaacctccgacttggatcaattttcgcaaactaaaattcgaattcgaatttgaattttctcgttctgcttgttggctatcgacagaaaaccgaattcgagtttgaattttctcgttctgcttgttggctatcgatagaaaaccgatcggaataaacgattttcctaacggaaataaacggcaagattagtccaaactgaacggagaaggcaagtttaacatcggctccagcgttggttaattcgttaggttaatcttgtagagattcatcgataagtggtatgtggttttaaccctgaagtcttatgttcaatccccaacacacccataatttcttcttataaggttcaagcgcgtggtcttatactcgatcttattgcagttcaaaacataaatggggtcctgcagagctattaccaatacataaatgggcttacatattgcaatttgcagttcagtagtggccttacggcacagcccatcagaacatgttctttattttctcacgctttccattctgtcccggtaaacaagtcatttagattcatattttcttaatttgtttaggaatttatatgagttcttcgaaaaaataaaattcaaatttgaatttggatgaaatggaccgatttagtcctcagcaacatagcttttgtcccgcgtcggttagtcagttttttttgtcctgttttcgttcaaccctgtatactcagtagagtttaaattctgatatctataattacgcacacaattaaaaaaacatatacatatatataattacgcacacgtggatgtgctcttaatggggattttgtgaggtttatagatttacggttggcctgtcttgagcgtgtaaagggcacgccacaccatacatcgtgagtgtgtgcacatgtcttccctttacatgtcgttaccatgcttaattctagctagtttagaaatgaatcatcggggtcgttgctaacatttgtgcctatctagctaggctcctctaataaatgaaaccagaaaagaagtggttgtgtagatagtaggtttaatgaatggcacgttgggttcagtcaagtcatcgattgtcaagagaaactttattttaatactaataccatttttaatatattacagtagcttatagttatcatgttcctcttattcttgagaagtctcccttagattggatgggtggctatgtctactctatctatcaaacatatttttaagagctttatttatcatctgtaaaagattggatacataactatttaagtatagatgttaggatttaaacttaagtggatgtaaattcatgtacatgtaactcgagagattggatacataactatttaagtatagacgttaggatttaaacttcagtggatgtaaattcatgtacatgtaactcgaacatcaagatcaaaggtgatatttgccataattttactacggtcaactcatatatatgatctattatctcaaactaaacggattttcacaaaatcttaggaagctttctaacaaccatggaacaaggacaaaggacaacctctactagctaacacctaaccattcacaaaaacttagtcaaggggctttttctagtttttatcaagttctaaatctccggctaagcctcttagcggttgagctctccaacagctaagacattagctgttgtcgaaaatattaggaaaaagttcaaaaatttgacagaatttaggctaaaagttagcatatcgatcactcacttgatttgcacatcaagttcatcaccaattcataattcatacttcatacgtggagttcatagttcctaattcatacttaatttagaggctaagtacaactattagcggccgataaatcttagcatcaaaattgaagtatcctagttgttcccctctccatctttgccgctatagccagaggtttagaacattggtttttatgaaaccattgacaagcggtgaaattaatctgaccgaatttcgtaaaagaaaaaaaattaaaatccacttcaaacttaataaaaaaacccaacgctttatgcttttagccgtcctagaaaatatatttttcgcagaaaccggccagttttccttggtatgtaaagttgtaaacccagtcatggtcgaccatggtgcacgccgaagtcgagagctgttggctcttatggtggaaaatattgacccccgtacacatgatgaagcactaggagtgaaacaacgagtgttggcacatgtccatatgcatcttgcatgattgatcgcgccagtgaaaccactgttagggcatacggtgaaaatctagtaaagatgattctaatctacttcctccgtttcataatgcaaatcattctagcattgtctatattcatataaatgttaatgaatatatacatatgcatatgtctaaatttattaacatctatttgaatgtggacaatgctagaatgacttatattatgaaacgaagggagtagctagctataggctgtggttgcatgcgcgcatggatatgctatccagcttcccttttgtcttacacaatatgcatgcttgcgtgcgttaatatataataactagggatgatgatcgatgcggtcttcagctcacataagggaacacacaatattcttttttttgggtgaaatttaatttgcacttattcatttcaccattctcccgttagtgtgcatttttgggtgtgttccgtagccaggctgtggcagccacagctgtagccggctgcttgcttggcttgtgtgaaacagcgctgcagcagcgctgcagccaagtagcccaacagacccttttgttttgccatccctattaaggctgacatcgaatccactggttcataacttccccccatgacaacgagcacgaggtagttcattagtgcatcattaattaagtattagttaaaaacattgaaaattagattaataagatctttttactcaactttgctataagaaaatttttataacacacgtactacctcagtcctaaaattttatagaaaagttgctttaaaaattatattaatccatttctcaagtttattttggttaatacttaataaatcatgcactaaccgccgctctatgtgttgggagtgagggttccaacccactcccgaactcaatctaagccaatgattcttcatctgtttcatactccctctgtccaacgtaagttattttgagtttttgtttgcaacgtttgaccactcgtcttattcaaatttttttttgcaaatataaaaaatgaaaagttgtgcttaaattactgtagataataaagtaagtcacaaataaaataaataataatttcaaaaaattttaaataagacaagtggtcaaacgttgcaagcaaaaactcaaaatctcttatattatgggacggagggagtatgaaacagagggagtagttgacatttaacttctttttcttagtaacacattactaacacaagcaaccataacgcgcgcacactcacccctataaacgtacatacgcatgccttattctgatgagcacagttaactttatcttaatagaccattatgcccttgtgcatattccaacattaaacattcctttgaaaatttttaacgagtacaaaaaaaaaggataattaaattttgtctacctaaagtatattgattttaaaaacattaaattggtgaacatgttatttttcttatttttttcaaaaacaatgcaccatggaatcattcggttctcaaatgtttcattaaataatttatagtagggaattaactgcattgcatgtttaatatatatattttttacaatattagcaactacttaatatttatatgtgaaaactattttccatattttattttaaagtttcacataaaaacctttaaaactaactgaaaattttcttacaatatatacattttcatacaacctttaaaactaacaacattaaaactatatctccttattttttgtttgaaatttgttatgacttttagtttcataagggaataataggcctttgggggcaaatctaatggtcaactaacattgatcaatgataatggtaaaagagaagtgagtgctaacagaatagtggtaaaagagagagaaatacaaaacttttaaggcggaaaagagaacacggtttggacggctagcaaaaagaaaaaataaatacattcctttcaatgtgtatttttcagagctatgacaataaaaatagtgtaaaaacttattagtggtagccattacttttccaaagttttgaggtcaaatagctagataatgatatatagttatatatataatgtagtaccatcttctgtacgtagttttctttccatatggtctagatccatagaaagagagaaccattggtagccattatataggcatatggttcatttgcttctaaacatggagctatattttctcaactctatatgtgcatctgtgcatgtttgcaacaacctaacatgacatcagtgacttttatacatgccctaattatgtgtgtgtgttcatagatcagtgcatatgttgcgtgcaacatcgatcgctttgtgtcaattattcatcagtccaatcatgtgggcgtccatggacgacaagcaacacgcgccgtaattaagacagaaattaagcatgaccggacagctactagtcttcaattgcactatattaacattgagatcagaagtagggagtacaatatatagctttctctgtctttaacagaatttcactatattataattggaattgaagttttgaaaaaactaatcttttcattgttagcttgatcatgtacttacatctagaacgatatattttttttttgacttgaaagagttatgaaggattgtctcgagagcagtctacacgaactccatgttaactagctagagatgggaaccggatcctctgatgttaggaaaccaacgtcagaaggcagtagtttcttcatccttcatccaccgtccctggagcatccaacgcctctcttgcttttgcttcattgtagggtgccacaatctctgttctctggcgcgtgaaggggattgattcatcgaggcggcgagcgaggaagcgccaagcaaacgaatcctgagacaaatcaacctgtattgactcaaacctcacaaatcaacctggaactttattcgatcgacccaagaaactcaagatcaacgaatacataagctatctgcgctactccaaccttgacaacaataaatcataaatggcattaagctagtgcagagcagaaaaaaaatcataataatgtgtgagctcgacggcattaattaattagttcctcgccggcgagtggtacgggctcggcgttccgtacgacggcgtcagcatcggcgttgggtgcggcggctggccagggtgcggcttgggcgccggcttggtcgacgacgcggctggcagatgggcttgcagatggtcgccgacgcgcacaccggcgacgtgcagtgggtcttgccggcgacggcaacgaaggttctctccgacagctgcatgatcctcgacggctcctgaccggggcatgccgcgttatgtttcgccgcgctgtggagctgagccacgctgtcggcgccgcggaggtcggcggcgagcggcacgctgaatgcgccggcgccgtcgagcttcccggccgcttcatctcgtactcgccgtcagcgctgttcttgcacttgatcgccacacggagacctgcacacaaatatatacttcctccgtcccataataagggattttgagtttttgtttgtaaattttgaccactcgttttatttaaattttttttgtaaatataaaaatcaaaaagttgtgcttaaaatactatagataataaagtaagtcacaaataaaataaataataattttaaaaaattttgaataagacgagtggtcaaacgttgcaagtaaaaacttaaaatcccttatattataggacggagggagtacacttgacttaacaatggcaaatcgtacaagatcgggctgttgtcgtcctcgtaggctgcgttaatccggtttggatgtgaaggacgaaaatttgactcggcgacagtgaccgcttccttgatagccgtctcaatgaatcgatcaccttcgcgcgcgagagaacagaggttgcggcaccccacaatgaagcaaaagcaagagaggcgttggatgctttagggatggtggatgaagaaactactgccctctgacgttggtttccttacatcagaggatccggttccctagagatgatacaagagaaaaaaaaaagtttcccttagcccatgcattattgcatattcctatacttgcctctgaaaaataacatacttttatgacttgaaagagttacaaaggattgtctctcaagcagtctacacgactccgtattaactagagatgatatagcgggggaaaaaagtttcccttacccatgcattatgtattcctacatagactctttcgtctttaatttgtttttgagccggttacactggtccttttcatatccaaggagacgatcataatgtacgtaacaaaaaatattacgagagaaataattgatataagagataaggtataccgttcatttggcttttctttctcatgcataatgtacatcctatatatagcactagcagaataaacacggatggtcatagacatcgtcgaacgctctaccacacaatctcaaacatatatatttttagagaaactatacataatactaacttccactgatcgcaaaaaaaaaaaaaaaagagtggtggtggtgtctcctgtttgcctccactggcttaaatccataaaaaaaaaggagctttagttttgcctcattctgttctccccaatattcacaggcagatagcccaaatcttcaaaccccgggaccccacagaaatggatggttccatcttgctagcaatgatgcatgcacacggctagcttgttcgtatatattgtcttcatgtgccattcacatatactacttgcctcttgtatactccatccatatcccaaaataaattagcttctatagatgaatctggatataggttatgtacttcagattcatatccaagaattgatttttttatgggacatatgggagtatatgtattcatgttcttatctcaaaatttaagagctagctgagggggcctaaattaagggggaaatagaaaaacaagtggacttgtaataggactttttgttggagaaggtggatactgcatgcttacattaggatttgttgcatcttagaatatattattgtgtatattgtatctttaaaacatactccttccgtttcaggttataagatgttttgactttagtgaaagtcaaaccatttcaagtttgactaagtttaccaaattagttttattaaattaataattaaatatatttttataataaatttatctttggtcaaaatattactatttttttctataaacttggtcaaataaacatcttataacagaaaacagagggagtatgagtgttgcactttctgaggattgctacataaaagaaatttcataggattttagaagagatatatgatgcatgtttgtttctctctcgcagtagagcccaacaaattgaaagcaaatccaatggctctaatttgtaggggagtttgtggttaggcaaatgtctagctcagtaccctccaaattatttggatcaatgattgttaacaccagtggatctacacatctaatccctctagctaccatagtaccatgataattaacaatgttttctaaagcaccccctgttaactaattaattaatctgtactccacaacatagggtagggtatatttttcaacaaattcgatccacggctgggaccacgcatcggaatccgtgcccggaagatgcacggcatggatcatatgtgctgctctatctcaacctctcttctccagtacaaaaaggcacaggaccccactgactaatcaacaagattagcagttaaataaaccttgggttgcatgtaaaataagctattaatttgcatgggttagtatgcatatacgtgtgcacatgatagaaaagaatggtgctattgctataggcagatcagaagaaccagagacaagtaaattaagacgttggttttattgcaagttgggagatttggcaaatcctccttgggattcttcgtgagtcgtcaaacttttcggtttcgttttcttcgaactatgtatatatagcttttgagatttcgttttatgtggcccggccctccaaaatccaaattggcactgaaaaatctcggcttttcgttgtgccgtctgctagagtttatagttaggtaaagctccaacatctcccagactatgattagcacttgtgttattgggttaatggtacccacattttcactttcttatcaagccaagtaccattgagatttaattagacctcgttcggaacacgatgacaggaacgattaattgttataacttgtgtagaatatacgtataaattcagtacagatttaaacagatataagttcagctgaacctcgctaagaaatatatatcatgaatctctctttgtcgtcaccaagtttgggtcttatccagtgattttccgtggttggataccgaacactggtttttacaacattaatcctagtagggaattttcatgcattacaaatgtggccttaccctagacttgcatattattgtacctagcatggactctattattgtgttcacctttctatcatacttgtttgttaataacatagtcttgattttctctttacaataaggttttgtggaatactccacacttgagatatttatttgctcgctattcatactcttagctaaaatgttaaacaaaatatggtaagcgaacatatctctactactttaaaagtgtaatcgtctgccttccgttcccttctcaccatgcaccagaggttgtgcgtccctttatgtgtacgtaatcaatatagaattcaatacttttccctcaatccacccacctagcctatccctaattatataggttagtctatgttttattctcaatccatccacccagccaatccctaattatatgagatgacccattggaaagcacagaatcttactagtttgaattaaatgtcatggttacccaaagaatctcaagtgatctatgaatgaaaagattgtagcaaattccaaagaaaaacctaggtcaaaaaaatccttcgaatggaaattgttgcttttacgcatcgcaaaactgaattttgaatatattataacagtcagtctcattactggagttgcatgcctgcaatcaatcgaggattttgttccttgcacacatattgatatactgactcttcagagagtgataacacaaaatggatctgcaggctagctgctgagccattgatcaaccaattttgtcttttcctggatcaatgcaaaaaaaatattcagtgacaggcatacaacctgaagaaccaattaagtgagagttgatctgattaattaactgatcagacgggtcgacgggacggccgtttacatccctagaggctctaacacaccttcatcatgcatgcatatgtgctattttgtatagttatgtgtgctataagtatataatattaatctatgtagcaacatctctagatcaggtcctagctatgatatgatcttccaggtatatattggaattggagtgagagagcccaaacatgcactgttgtacagaaccaaaatacaattgcaagtagctacatcatctataattcattcatccatatatctgaaactgcaaggaggctgctggctagcttcctcctctatttatacacacacccctctcacaggcctccacttgcatctctctctctctctctcccaattatatttgtagagagagggaagaaaagaagagaggggaggagcaatggcagggtctgaggagaagaaggagatgcaagaccccaggacacaggccatagcatccaccattagagttgtgcccaacttccctaagccaggttctctctcctctcttgcttgttgttttttagcttaattattcttgcatcctctcttgctttactgtgatttcgagcttagttcttgcatgtctcgctagttaattcatgtggttttctagctctgtcttcttgttttgaaaccgaacgatgttatttcttttgagtataaatatttttcagaagtattatgtatcaactggttggcttcttctttctgatcctttttttcagcatatatgtgctcataatctcatatatacatgtgcaataggggctgcaattctgtaaagaatattgaccttgggggttgcctttaatttcaagtgccaaaatctgtgtttccttgcaaaggtccccactggtactattgatccttgcctcgttggttctttccttcctttttttgtttattggttctgaacccaaaaactttcatgaatatagcttgtttcttgtgtgactttatcatgagctttttgcagcttgtaacctataaccaaatttctcacattactacaatttataggcatgcacatgcatggtttgagcatgcacatttaccacaaaatattgttgctgcgaactgatcttcctttatttttaaaattatttttcctgctatattatgtcatgaagacatatttaatcttcctattgaggtgaaactctcactctattcaaaaggctaattatgtggatatttcgataagcgcatccatcgtgatgatgaaggtggtgtgagcaaaatgttgtgtattcgagacattatgattttccctttagaagtcttttcccactctatatatatatatatatatatatatatatatatatatatatatatatatatatatatatatatatatatatatatatatatatatatggaggggtatcaanagagatcgcgcgcgcgtgcgcgcgcgctctctctctgcatttttctcaacacacatctcatcttcccttgcccgcccaaatttaatttatagaattcccacaaatactttggaagagttttgtggcaattatttttttctagaaaaaaaatcgattgactagatctgcgaattaaatcaatgacacatccctgcagaagaaaaggtctatgcaatacctttttttttcaggttctttcataatatttgtttttcttgatgaaatgtgcaggaataatgttccaagatatcacgaccctacttctaaatccccctgtgttcaaggacaccatcgacttgttcgttgaacggtacactggcaaaggcatctccgttgttgctggtaacatataattgttttgttttttatctcaaaaaattgaaaaaatcaagatttatttgaacttgtgcgctttgtttattcaagtactccatccgtcccttaattaatataagggattttgatattttgcttgcactgttttgatcactcgtcttattaaaaaaaattgtgcaaatataaaaacgaaaagttatgtttaaagtactttgagtaataaagtaagtcacaaataaaataaataatagttttaatttttttaataagacgaatgttcaaacagtacaagtaaaatgtcaaaatctcttatattaagggacggagggagtagtaactaatctgatctttatctcaaaaaaatatcagatcttatcaaatccattgaaatatataatttatttttttaatactaagtcagagttattatttatgaagatccaaatatagttaattaaaagcgtgactttgacaggcacacgatgggtcgattgaaaatctagccaagttgtacagtacaatatcttttacttgtcgttttttatactgacccggcctccaataatacatactcctaaccgttaattacctacttattactgtagaaaatcggtaaagttcagtagtatcgaagtaatttcatggaaaaatctaatgacatgattttcatttgtcgattccaaaaaaaatgctaagtcaatttaatttataagattaacgaaaataattctaaaatgacaaataaattagagagagagagagagtgtgtgtaagatcagagcgagagagattattcgtatgaggagtgtcacagtcaaatgtacagagaaatgaagaataatgcagcagtagtaattgactacaaaacaggaggtttggcctctctgtctgacccttttgtaaagttcgaaggcttccagatgatatgacaaaaatatttgcctttccctccacttgtttgtgcctgttggacaaatattttgag

SEQ ID NO: 74793 - DNA, 4911 bp, Oryza sativa
tcgatcgttctcgttcacgttgtcgcggcaacgtacgttgacgtgttcgttctcgctctcgttcgttcgatcgttctcgttctcgttcgttaacggcggtgtggcggcatcggggcggcggttggcacggcggcgtggcgacggcggcggcggcgtggcgttgtggggccgtggcggcggcggcgtggcgtggcggcggtggcgtggcgtggcgtggcggcggcggtgtggcgtggcggcggcggcattgcgcgcgcggcggcgaaggcggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcgtcgtcggcgcggggatttgccctaggcagtggcggcgaaggagagaggccgagagagatcgatcggccgaaaacgtttaagtgttggtgaagaagacgagggcgcaccgggaatatatataccccttgatctttactcccggttgttctcaacaaccgggagtaaatatcttatcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattttaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaagatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctatgcaaaatttgatgacctcctctgttccataacccttggcgatgcttgcctctggacgagcacggttacgaacatacttcttcagaacgcccatgtacctctcaaaatgaaacatgttgtgtaggtacataggcccgagaatacggatctctttcacaaggtgacaaagcagatgcatcattatattgaaaaaggaaggtggaaatatcaactcaaaactgacgagacattgcaccacttcattctgaagggtttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccttatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctaggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccccacacaaataattattcttacaataatgac

SEQ ID NO: 74794 - DNA, 39023 bp, Oryza sativa
tgacgccgttgacttttttaaacatgtttgactgttcgtcttattcaaaaactcttgtgaaatacgtaaactatatataaacataaaagtatatttaacaataaatcaaacgataggaaaagaattaataattacttaaactttttgaataaggtgaacggtcaaacatggttaaaaaagtcaacggcgtcaaacatttagggacggaggaagtagttaccacgaggaggagggagaggatgatctggaggctgatctgcggcgtgccggggctgagcccgcccgcggcggtggcggcctggaacgcccccgtgagcgccgcgccggcgagcgacgtggcggagcagagcgtgaacggcgccgggaagtgcaccatggtggccgcctgcagcacggtggtgccggacaccaccagcaccgcgcccaggaggcacgcgcacccgacggcccagtcccccccgccggcgttcgccgccgccgccgtcgtcgtcctgtggctgctgctacgcgtggcggcggcggcggcggggctctgcaggacgctcatggtgacggcgccggcgaggcacagcaccgtcccggcgatcttggccctcgtgtaccggcagctgaggtcgaccctctcgaagccgaggcacgcggcgacgacgaagatgaagaccggggcgaggttgggcatggtggaggcgatggccggcgacgtcttcttcatgccgtgcagcatcagcgcctggaacaccgtcaccctgcagccaacgacaaggatcgatataaatctgtcatcagacatgttttgcacaaaatgtgataataatcgtttgacgggaaaactattttaatctctcaaggggatatccctttatttttttcacgtcacttaaatggttgtgataaaaaaaggtgtattaatacgcgatataatactccacaaacatacaagttcaaattcaatttatacatctcgtaatgaaaaaaaacaaattaaaccacaactagttaacgtatatttagagtcaaatttgtttttttcgttgcgagacgtagaagtttaaatttttttcttgtatatttatgaagcgatatatcacatgttaatacattttcttagtttttgtcataatatttaagtgacatgtaaacgatgtaaacaatgagaggatatattaaaatccacttcccgattgacatgttatacatgcataccctccgagggcgagcaagaagaggcggagaagaaggtggttggcgttgaggtgcgacggccatctcttcctctcgaggttgatggcgaaagggagggtgaagaggcccgtggcgaggctgccgaaggtgacgaggaagagcgggtcgaggccgagcgccagcaccggcgcgagcaccaccatgtacgccgcgcccgcgagctgcaccgccaccagccccgcggagatcgccacgtcctcccactcccagctgcaccaccccgccgccggcggcagcacgggcagcagcagcggcaccgccgcgtcgtcctcgccgccgccaccgccggtggccgctggcgccattggacgacgcgcgcggcaggcaagggcgaagagggcgcgcgcgcggcgcacggcaccaccacacgcccacgccacgcgccccggccgtggaacggaaacccagcggtttcctctttggcgcgcgcgcgcgcgtgcttgtgtaggtgcgcgctttcgtccgctcgctcagcccaccacgttgctccgcaccgcacgtcccgcgcgcatgcgcagtatcgctcgccgctatttttgggcatcctccccgtctagccctcttttttcttcatcatgtatatatgggatacagttgataaacagttataaagagcctgtttggcacagctctacagctcagtcaaaaaatttcagctctacctagagtagagctgaatgtacggccccgtttggtagggctccaaactccaactcccagctctaaacttctactctagttggagctagctcctattggagttgcagacccatcaaaagtgtttggcaaatttttagctccagatctgaaaaaaattgaaaaaaaagaaaaaaaaaggaatcctcgccgccagccggccagcccccgcgccgctgccaagcccgcacgccgccgccagcccccgctccgccgctgagaacgtgcgtcgccgaccagcccgcgcgccactgccgaccccgtgcgccgccgccagcccacgctccgccgccagcccgcgcgccgccgaccagcccgcgcgccgctgagcccgaccgccgctggttgccgccggcgccggcgccgccagcccgcccgccgccggattttgccggagaagatgggaggagagagaatgggaggaggagtttagggtagttcaatggcatttttgtgtaaatacataaaaaattaaagggtagtgggtcttttggggtgaagtggagctgtggagcagaaaaacctagctccatccccgtagtacaaaattgtggagctgctctgcaaactccactccagaaaacagagaatttgtaccgtttggcacaactctagctctaggtaagttggagttgggagctggagctgtgccaaatggggtcgtactctctcataaattaactagagagttggagttctttggcacccgagctctatggtcgctgatgcgttggccaacaaccattgaatccgcgatctccatggctccttgggagtccaggcaatcctgcaatacttgcagatttggtcgtcgttgtgaacaacaactctctaagagggtcatcctgattctttcatctagaggtgggagagttcggggtcgtactccacccggtcggcttaccttgacctcttctcgggcaggatctcgtttcggcacctgccaatctagcgatcttttgccccgccccgatgtcgctacttcatgtggctggtcgctcaccgacgctgctggacggctgaccgactagagaagcatggactgccgcacccaacctattgtgccttctgcgaccaactggaagagacaatcgaccacattctgattgtgtgcccggagtccctccagctatggtggactatcctttcgagcctcggtctcccttagtgtttcccctctggcactaattccttccatgagtggcactgctcttgccggctcaaagttccgagggagcgtcgtagtgggttcgatacaattgtgactcttggcgcttggtccatttgaaaggaaaggaacaatcgtgtgttcaacaaccgttcccggtcctggcctgaggttgtcacagccatggcgcaagaggccgccctgtggcatcttgcccatcccatgttgctagtgctccctagttagcgtgtttggtcgttcggtcgtcacattgtaatagcgagagtaggcttaagtgcttgttttcctttttctcttttttctcactctctcccttctttgtttgccgtttgtataaattttattcctcttaatacaaaaagtacgcaatccttttgcgtattcccgaaaaaactagagagttggagttgggtttaggctgctccataactcctccactccagacctaactcttggaactaaaattaggagttggagctctaccaaacaggaccaaaagataagcaattataatagcgaatttgttatctgtattatgaatgacttagaatgagggatactgaaaattagaaaaaaaatccaaaacaatttaaaatgaagtttcaaaattctaaaatcaattctaattttggttgcttttggtaagccaacaaaccaaattaatttcagaaaatcatatatgataaaagttgcacaaaatcgaatatagggcttgttcagttcttatccactttctacaataccaatttactttctacaataccaaaattggcacattttcgtatcgccaaatttcagtagcgttggttgtgtttagtttaatgtcttagactttttaatagtgggaacttctagaattattaaagtttggtagtatagcatcaataataatgtgtttagtttgttgttttactaaaatttggtattgttgaacaacaaagtgaacatgcccataatacgacttgtggcataggttaaaaccaccacgacataataatgacttgtggcaacatcaaatattgcggtgtcaaaggtttaaaaaaaaccccgggtattatcatctggtcaaacttttgtaagacctgaattttcagatcaacgactagcacatgcagaagcagacttccctatgaaaactgcgcctgaaatgaagtactgtcatatagcctaacctagtcatacaattcataacaatataggattagaggttgcctaaaaactaatcaacagcagcctagctaatgtcacagaatgacagcacggaaaaacagggccacatgttccaagcaaaaaacaacatcgcagtcgatagcacaacaggttacaggtgagcccaacggatgcttcgtttcagtggatgcacagctttcttgccgagtggagcagacagacatgctctgataccttctctcttgtgcctacttgggtttatctgtaaggctgacgagggatttcacgatgccggggctgattctgtctgcaagggcacctttctctgatatcacaaacgatttctccttcacaaagctctgtagcttcttggtgtcatagtctagtcgttcttgatctgcatcattatgaaaatgaagacaatgagttaatttgacaaaagaacaagttatgctcctagatgacacaaccgcaagtgaataatttttttttaatccttgctgcactttaaaatggacaatagaggccttcctcaacagtattgaaaatagatcaagagtgtacctttgtctagaacagtgtgggccacatgaaatggaacacgagcaaagatatctgatcctggaaacattaaccatgtatcttccttggggtcatgatctccacatgttgggcatatctcctttaccagctgcttgccagaggttccttccaaccctttcattatgatttcaaagggggtcggaacactagttttggttgtcttggctcttttccggagggctgtcagtgcttccctattaccattccttatcctatcgttttccactaactggttatcacagaaaaacataaagttatcagtatcaatacctatctaacatattaacaagaaaaaggcaagtcggcaactcataaatacctgatgccttgccagaagaagctgctctgcatcagtttcaatgtcaaccagtgcttcttgaagttgcttcattttaggatccattatataactacaaaacaatgccatttaatttgaaactgtaagtgaatcatgtaacaagaattcatgaatcttcctaccataaagaaatgtacagtgatggcaggggcaggcccaggtttttcaacttgggtattcgaaattattagagatagaaaaaattttccaacccaaaatctaatagttgtataatatgtaacggtataaacatgatttcataaagtcatagatggatagaattgaccataaattgaatgcgttaagcatattagagtatagtactaaactattaaatgacaaaacatatcaaatttatagagcatacaaaatggcaaaatgataagaaatcttataatttaaagaactttccgtttcttaatattttgaaaatgattgacttggaccagttggttcttgagttctcttttttacagcagctttttctaaaaaaaatttagattaaccatgggaccatttttttctcttcatgtttcaaacatacaaacaacaatatcaaagagcaattgagcaaagcagcactggtttctaaatcctaatctatatagttattcacaagctaaaataaccaatatacttcagtctgaaattctgaatcagagaagggaacttgtaaaaaccaatgatgcactagaatctctatggcttatcatcaaagaacaagcataagacaatcaaattcctgaaattactttcaactagattactagaaatctagaatatctgtggctcatcatttagctcatcaagaacaagcataagacaatcaaattcctgaaattactttcaactagattactagaaatctagaatatatgtggcttatcatttagctcatcaagaacaagctacaagcaatatcctcagttagtcaattcgacagttcctcttcctcaccgctgctgcagttctgcgctggccggtgaccggggaccgccggtcgccggaccggggaggcgccgaggcggcgacgcggcgtcacgacagcgtcagcgggcgcgacgcgcgagtgcgcgcggcggccggggggccgtgccgccacgggcgacggggcgcagggcgagtgggcgaccggcgaggcgggcaggcggctgggctggcacggcgacggcgcctcggcctaggcgcccggcggctggcggctgggggaggtgagaactcaactgagaagagatagggttagaaatgcatttgggctttgttctgctattgggccaataggcctgaaatggtgggtggtgggagggttagtaatcctttcagtttgggcttcttttgagttttgaatgtgtatatgcattttttttcttttttcctatatatacatatttttttagataatggaatataatatcccggcctttgctcaaaaataactatagccaattattacaaagatccacttcagaagagagtgtagttcaagacaagttgaacacaccaaacaagagaagagaggacccaaacagagaaaagcaaaacaaaatgtggagctagaaggcctcgtccaggcctaagactgaagttcgaagccaatgcatagaccaatgacaatatccttgtacgaagaggtttctccaaagcggtgccccaaggaggatgcgacgtggatcgccgccaccgctcgttcggaaccgaagcaaggttttcacccggagaatatggtagggaaaggaaatgggtatgctaaaacaacgcctccaaggaggggaacgacgccaaacagcgtcgtcgttgtcagccggccaaatggctcagcaaggctttcgcccacgattccctgtccaaacccacaccaccaatccgcacaagaaagatcgttgtcggtcaacaacattgtcccttcagcgattcggcaaaggccacagcccacaattgttcccaccatcgatggcgcgcccgcacccggactcctccttccccgccgccagaccccttccccgcctccacataccgccgccgacgacgatgcaccgtcagccggatgatggcctttaaccatcgccgccataggtaccatcgtcgacagccgccaccgccactgccacagccaccaccgtcgccagccgccaccgtcagccaccatcgccaccgccacggacacccctgtccagccgccaccgtcagccgccaccgtcgctagccagcgccgccagacgccagccgtccagatccgaccggggtggtgcggatcggaggtgcagcgcgaagcgcgggtcgccggcatcatggaggaaggcatcacgggcacggtgttcacagccggagcattgacgagggcgccgcgccttcctcgtggtggcgaggttcttgacgagggccggcgtcgcggcacacgccgcagtccgccgccgttgtcggcaacttcgtcgttgccacatccgccaccatcgccgccgctagccaccctcctgccaggttcgcggagcggtgccggcgtcgaccgagcccatcgccggtcaccccggccaagcggggagaccagatctggcgacgcagtcgcccgtcgctggagccgcggagagccaacaccgagcgccccaccgccgcgcccaacgccgcgccgtccccgtcaccacgacctcgccgtcccgccgccatcgtcgccacgcccgcgccggggcgaggtggagccgaggaggatggccccgccgccgccatcccagcgcgtcgcccggctttgccggcgacgagctccggcggcggcgaagcacagaggagggaggaggaggggcggcggcggaggctagggttctaccccctaggggcggcggaggctctttcttattggatctctttcatacccttaccattaggtttccttcaggtggctggttggtttgcttcaaaatatccattactagcaaatatgcccgtgcgttgcaacgggtgaatatcaaataaatatggattgtcaatattgcttgcatacttatttaaatgcaataaaagcagatgcatcacgtccaataggaaattgctctgttttttttttaaatctgggtgcatatatgagtaacgtcgagcgagactcttagtatccatactaaatattgggtgcatatacgagtcttgcttgtgttttctgtttttctaatataggttaagaagatgtttgtatcctacttccatgtaattcttattcttggactttgtaattcctgtgttgtaattcctaagctatgtaattgtatctaactcggtttacgcttcaatcaatccttcaacgtgcgcacccaaataactgatcgggaacggtggtggaaaaaaccgggctcaccaaaaaaaaaccgtgaaaagaaatcgccacccacgaaaaaaacggtcggataaaaaaccagtccataaaaaaaaacacttccaagagaaaaccgcgtgcggaaaaaaaaccatcgggtctcgcacatacggacgaaacggagtgtacaaaatctcaaattggtccatacgtagcaaatcttcaaattttataccgctttacatattaggaaacggatgtcattataaaaaagcaaattattgcacaacaatttcatatatattaaaatgatggttcaaagtgattaaaaattagttatgtaaacattaaatgatttttagcgaaaaaaataaaggcaaaatgaataaggcccgaaagctagcgacggtccaaaactgcgtgcgtcggcccgataatgcacgaggctcggccagtgcggcccgttaggcaaggaggcccttcatcgcgtgcggcccgtatcgtgtgcgagcagccgagtagaccccaggcaagcgcgagcggccgaaatgtcggttagcagctaagcaggccgcgtgcgagtacgtgcagcccagatacactcgcaggcccattatccagtgtcgttgttgcttgcggtggtgtgaggagttttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgtcgcctccgttcgctctcgggcgacggccgtcaacgaaatttgcaggcggcccccttgccgccctccgctagggcgattttgtactgtgcggggggccgcctgcaaatgggcagcggggggcctggaattttgcaggcggcccccttgccgccctaggggagggcgattttatactgtgctttatatttttttataaatatcaatagttatcaaatctttttatgttgaaaactatacaagattaaaatctccaagactggtaaaatacaattttattattttttagggcctatttggaatgttacggtacaaatattttgttagtgccaaaatataagcaagttttggcactaacaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcgaattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtttaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggtcgctcacgccacgtgggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttttatcatgagggaagacttgagtatgcatccatccccacaatagcacaaaggacggtcacaccatggtggaaaccaaccagcaaaaggatcgcttcgccagttgagacgatcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactatatgtcaacaggcagcgccgaaagttgatagtgacaactcgagctgcctcttttcatgtatgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatgtaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctaaactgtaccgtgcgaaaccggtgctgtaggtcgcactgctccgaagctaggggcgctcgaaggcaaacgaggtcctgcgaggatggaacatcaagttacgacggggtgatgttttcgcacaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacacatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggtgtctggagtgaaggtcacacgcgcacgagtgcgaagaaggtaccagcgaaggtagtcacggtagttctcctccgtgtgtgggaagagctcgttgatcacctcctctgtagctaatacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctatgtacggctcccagatgacgtcgctcggctgtagatggtcaaactcgaacacgaagtccgggtaacctcgtctcacctggacgtgagcgtaacgacgctgcaataaacatgatcagaattagacatgttatgtgaagaaaaaaaagaagacgactgataaacttataacgcagcgaagttgcactaaccccacgtcgacaccagtaagtccccatcgtgggaccgtcctctggccactgcgcgctgtgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtggccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccccctcaacaagcctacaaagtggtagaaggcctgccgcacgcaaccagtatagagcaaacttcaaacataagtacaacacaaagcaaagttgagttgaaatgtgaacatacgcgtaccaaggaacgtgacgggggtcgacacgcaaccactcgcgcgacgtgcgtggatggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagtgaattactaacacatattaaacaagagtacaaacaaacaaaagtgtcaccatacggaatatttctaattacaacaataactgcagttacacgatatgagtacttagtccgaacactcatcacgataacattatgatacaacaccgaatagttcgcaataccactagtataacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaacataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgctaaacactatgttgttatcggccatggacggaccaattttcttgtatcgatccctaaagtacgcttgcgtgccgtgaaggatgaattcaataatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttattcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccaaggtacatgatcaccctctgatataacaagttcagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaatatcccctgcattgataggaccctctacatcttcggtttgcattgaaacatttatatctttctcttgtaccgacacaaatataacgaggggccatgaccgttcaaaagccatttccacatatcgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgataaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgtttttttggatttttagtgaatataatgaaatttcagagaggggggactgggctttatagggggaggcaaaaatcgccctcccccagggcagcaagggggccgcctgcaaaatttcatgccccctggccgcccatttgcaggcgaccccccgcacagtacaaaatcgtcctagcggagggcggcaagggggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaattaaaaataaaaaaaagtcgtggtgtgagtcggcacgattgacggcgtcggtaggatattgatcggacaactgagatttcatgagcttaggacaaaacaccccattcctgaaaaacctaaccataagccatttctaccctttcccccgatttctccagcgtgaggagggaggtgatggtggcggcgatttggtagagcggcggcgactgtgtgctcttgcgcagcgggcttaggccacgcatggctccgacggaggtcaagctggcggtgtgccacgaattgatatcatgtctacctagtcgggtgcccatgtgcactaaggctgtgtttgaggagaagtagattgggaagatacgtaaaacgaggtgagcaattagtgcgtgattaattaagtattaactattttaaatttaaaaaatagattaatatgattttttaaagcaactttcatatataaaatttttgtaaaaaatacaccgtttagtagtttggaaagtgtgcgcgcagaatacgatgtgcaatctcacccaatcacctaagaacgaatactaagtgccagcgacgccaaggtgatggtggcggcggtgatggcacagggtgggctgaggtcagctatccgctcccccacctaggttcacctccgcaactgaggcgagcctcagtctcgcacgaccaactcaggcaggcacgggactggtctgggttgcatagtaaggtaggtacacggtagagctgaaaaaataaataattacacagatcgcgataaattttcaagacgaattttttaagtctaattgctctatggtttgacaatgtggtcctatagtaaacatttgctaatgatggattaattaagcttaataaatccgtctcgcgttttactaatagattctgtaattagttttttttattaggcctccaatatttcatacgacaccctgcataatatctgatgtgacgaaccaaactttacacctctcaatctaaacaacaccccctaagttagaagtattttaatgtccatagtgcaaacactgtgagcatcgactgtaataatttgttagagataaaaaatggacgctagatgaaaattcaatttagctaattaaaaaaactgattattcatctattttgcgttaagaacggtatatacggctgatattttggaaaattttacggaaaggctaaaaaactgtcgacacatttttctctagaaatatgtcgatttctgatccattagatcaactgtaggattcgtgctattttagttgacgaaaataaaattgtactgcaaagaatcgaacctaggatctccagtggcttgtccagcggccctgaccaactgatcgagcaaagattttggcttgaattgaaattacacactaattatacttaaattgcatatcatttacatatataatttagagacttacattgtaaatacactaaaattacatatgtaatttagagacttacatatgtaattgtagcacttacattgtaaatatactaaaattacatatgtaatttatgaacttacaatgtaaatacataccgactattttttttatgaaaaatatgacgccataaatataactacacccaaattttatgtgggtctcacggccacgtgtgatgcgaaccagcgaaccaaaattgtcttcgcttttctgccgaacgtgtcaagccgagagagccgcgccttgattcctccgccccgcccttatcctttccctctcctcctccgccactcgtttctctcatcctttctctcctccgcgcgctcctctcagctggcgaggagctccgatgagcaatggcgccggtgatttattcattttcttggatgattttgattcattgttgttagatttgtgactttgtgattcaatggatttgtgattttgtgatttatttggatcggatttgatctcgttcaagggggcatgggcatacgggacgggatgagcgacgcacaggtgaaaaggacacgcggtgacggaaaaaaagtgtgacggacgaaaaaacacatggtgtaaagatgtgacgaccggaaaaatgctaatatttatattagttagttatagatatagatatagatatatctatttttttaaaaaaaatcttgggtattcatttgaatacccatgaattacagtgggtccgcccctgagtgatggtccacaaatctttatatgtggtgctatatcctatccaccttttaggacgaggcaacaataggataccacaacatatttacaaaaagctgtgcagaaacttacttgcaaaaaaaaagggccgtagaaataaagaacactgaaccatacaaatacaagcaataacatagctgcaataaagaaacaggagggaatggggatttggtggtgtagaaggcgcaatccagatgcactcagagatggatctaaaaatctaacggtcccaggatgaagatcctgatctcctagaccaattttcaatatttgtgatatattttctaaaagaggatcaattgtattttgtcttagcaaggaaaatataataagataatttacttaaggagtaccatgtgtaaatcataatagaatagagcaagaagcatctagatcagagaaaaaattgaactagttcatgcatagcttggacatcagcatttactgtgcagaaaattcctgaatggatacagtagttcggcaatggccaatggggtacatccatggttctgtcttatggtgtcttcgtttattcaaaagcatatcatggtatgtgatgtcttatcatctactccctccgtcctacaaaatcatgaatcctggagggggaggtttgtaaaaaaaaaaaaaaacgatctgtgcacagaaaaaaagattgtgggccatagtagatgggaaaggagcctgccacctctctctctcctatcgttttgaccgcagaaaccttatctcctcggcttttctcgtctcgttctctcctccctaaatcgcatcgctctctcttcccccaaatcacgcccagatgcgacctcctgcctccacgccttcctccccgcaaatccctcccttctccatgccgctccccctcactccctccctgccttcctccccgcacatccctcctgctcaacgtggcggcggctggcgggggaggcgacgagcggacgccggtgttcttgcgtacatgcggcctcgggggtagcggtgacgagcggacaaggcatcggcggcgacaagcggacgcggcctcgtcggcggcggcgatcggcgaacacggcggcggcggcgacgagcggacacggcctcgtcggggttcttgctagttcattcgtcggggttcttgctagttcttgtagtatctggttcttgctagttcttgtagtatctctttttctctgttcctggctctgttcttaattgacagatgcgaggctccaccagtccacctccccgcgcctccctccgttgtgttggaggctttgctacgcggcggcggcggtggagccttgcatgcgtgtggtatactggtatgtggccgatgcttgctttgcatgctgatggacgtggcttgttcgaatgcagctgttatggtggaaggggattgacgatgggaaggacaaccacaaggaaatttatgcttgtctttttttttaccgttaattaatggttgtactttgtaatttggtgagggcatactagtcttttaccactgctgctaaagtcacctcgggtttataggaatcgtgattttatgggacggagggagtataagactacatcatcctagcaaatagcatactgctagctgataagatttgtatgttaagccaaaaaatgctgctacaagcatgacgtcactacggaacacatctctccccaccaaaaatttgtggaaaaccctaagcacagctgtttgcagttctcactataagcttgaatcagctctatctaaatatatcaaagttcacaccgatgcaaaccgatcaacaaatgaaacgatttccacaatgaattaaactacagtgcacttttttttttttacaggaatgaccaaaggaggccatccaaatgacattaagattgaggggaaaaagttacaagacagcaaattatgcatactaagtgcccagctaatagaataaacaataacaaaatagaacgattaaacctctacaaaaacaaacaacgagatttaccaactctaatagcacaaatgaactgattggttccagtaagggctaagagtagtttcagtcaatctaaatgtaaacaatcacataatcacaaagtcacaacatacgtagaaacaggataaaatcagatgcagagttgcgcttggcaacttatcatatctctaatttttttttgggagggggggggggggggaatcacaactctcgtctaacaatccagccctctctctcagcaaccacagcaacttaggccccctttgattaaaggaaattcataggaattttagaggattttatttttataggaatttttcctatatagctctttgaatcaaaggaatggatcttatggaatcctatgaaattcctatgaatgcctaatgccatgcaagttttggaggaatatcatgaggtagaacctcatagaaactttccttcgagtctttatctctcctctaattcatgtatttttcctgtggtctaatcaaacggtcattcctgtgttttgtaatcctctgttttatacttatattcctatcaaaatcctacgattttcctattcgtacgttttctcaatcctgcgattaaaggggcccttattgaggattgcttttgaatttctgttcagaagggagcaaacttagcgaagggagggccgccggtaaggggcgggtgactggggatgcgcccgccgccggcgagagaggagggtttcctcggcggccgctttgctggggctggacgccggagcttggaggcggcggctgttggtaaggcaacgcaaggcaaaggcaagcagagagagagagagagaggatgggccagatattattgggcttccaaaagaggcctgaggtgggcccacgtgacagtctcacagcccactcccctcaactccgctcttcccaaatgggcccaggcccaagcctgggtataaaagcagagctctcgccatcttctggcgcaagcctcactctcctcctccccgcttcggattccaccgtcgcggagctcggcgcgggcggagatggagggcgacgccgccggagccggtggcggcgaccggtcgagcatcgtgatcggcctcatcgagaaccgagccaaggaggtgacgcctctcactgactaaccccccccccccccgccctcccatccctccccctacacccccgcacgcatttttgcttgtcggattgctcgcctagctagcttcctcctcttctcctccaaggcccccgagggtttccgtttcgcgttctactcggtcttcgctgcgccgcggatcggcttcgatcgtgtcgtcggcctgcgtgcgtgttgtgttcgcgctcccgcgggggtggtggtcgatcggatgctgctcgggtggattacttgctctagctggtcagattggtggtggtggtgggggggggggttcgtgttatatggcgttctgagcggcttgatttgagggtttggtggttttaggatttgaggctccagctccatttccggggcgattagagcataccctgtcctcgatagtgctgctctagcggttcgaatcgagttggtgtgatgtgtacagtaaattgttggagaggtgggcacaattactgcagtgacctgctgttgcaattttttcctccactgatttggccggcactttcttacaagttgggaatccggataaccaacggtcaaaggataaagccatttccataacagcaccatgcgccatgcgggaaagcatttttatctacgatatattagttgttctccaggcttgttttgaaggagttgcaagtttcattgtaaacaggaaaattcattggatcatggtgcattggcgcagaagagagaaatttgatcaaagtgttgtagtagatcaactcataaacttattatggatgaattttttttagataatgtattatggatgaacagattgtgaaaatgatttctccattgtacacacttgttttgtggtttactaatgaacaagatcttctgagacgctgacctctctgtacatctttatttttcttgttctaagtcaagtgtatctttagttttggaagcatctcaacatttttgccaacgtaagaattctttgtagtgtcagttttggaaaaaaaaaatcgtgatatgaacacgtgtagattgtctgtgcacgtcagttgataacttgatatgcacaccatccaattcaactcaaattgaaaacatacaaacaaaaatcatggagttaattatttctcaatttctttattatgaaccaaaagatcacgaagatttatcaaactagtatttttgcaggttggtgttgctgcttttgatttgagatcagcctcactgcatctttctcagtatattgagaccagttgctcatatcacaatacgaagacacttctgcatttctatgatcctatggttgcaatagtgcccccaaacaaaacagcagcagacggtatggttggagtttcagagctggttggtaaacatttgccaacaaataaaaaggtgatggctgacatatgcaaatttgttctatgttttctcataatatgaacccactttcgtttattctaaacagagttcaccttttagataacaatggcacgtggctgctttgatgacacaaaggtataatgatttgtattcctttctgaccatttatttgcttaattgttgggtgattaactgctgcttaacatcatgcatgttcttgttttcttttaagggtgctgttatggtaaaaaatctttcagctagagacccatctgcactcggtttagatacttattgcaagcaatactatctttgtcttgctgctgcctctgcaacaattaagtggtacgcgtgctatctttgtctcgatacattgctgggctacattttccctgtttaggattaagttaataacttctgttatgtatctcccatgaacatagttgtgtattgcttcaatatggacataacgacttgacaaagctgtgtcataatttctattttttcaaagtgtaattggagcatatgaacttactatgtactacaacagtgcaactctcaaagcaagtacttactaaattattttacaatttgtctgttacttctcatgtcatttcataggagttatgcctaagcacctcatttgatgatactacttactatttatacaatgccccagaatatttgttgttacttagtacattgaaatggaaactgagataggattttcaagttggatacttggattctataaagcttatcttggatcatcaaaacatatttctcatattgttttttttggtcatagataactatttttttcctcgtattggacggaaatgaggataaaaccgaaatatagcagatgattagatctcatgttgatagtgttgataagtatcacaatgacaatttactttgtttcttcttgcaggattgaatcagaaagaggtgtaattatcactaatcactcattatcagtaagttttttagagttttgtttcatataaatcatcgttgtttagcctttttttcacctgtaaggccattcttacgatattatgtatcaaaagtctccattttgtgactactcttctatgggctatgctgatctgaaaaaaatctatacattatggggtcccatacattatctctaaaaacgttttctctaaaaatgttagctgatgtttccgtatttttctcttatatatgtatgtataacttttcaggttacattcaatgggtcatttgaccacatgaacattgactcaactaggtactcttttggttaaattgagcagtattatctgtcacttgataaatcatcttcaccaaaggagcagaaacaatataagttaaaattttctgctacacgatctgaattgccttcattgttccatatatgcacctagcagtgtacaaacattggaaattattgaccctcttcatactgaactgtggggaactagcaacaaaaagaaaagtctctttcagatgttgaagactacaaagactacaggagggtatggctttcccattctccaaactaatcttttttacatatatttacactgcaacattcaatatctcctcatttttgcaatttgaacaatcttttctgagataaaaagtttcatgtcaacttctattgatggtacaaaatagtttaactttatgtagtctatgtattgaaatatcaagcacactgcaacaattctcttcaaacttgcttgttcaggactagactactgagagccaacttgttgcaaccgttaaaagacattcaaacaatcaatactcgtctggattgcttggtaaggagattaatcttttttgttattctcaattcttaaattggaatgtctgtttgatcaaattggtcatacggtaatcctgacatttgaaacttccaaagttgcacatattaagttctggatcttctagtaggctaggttctggatcttctgtgggaatgaactaacttcatggagtatgaaccctgctttatgcatgtggaaatcttagtgcatatagtcttaaatcgttactcgaagggtttaccacaatcatgtttgtaccatttatagttcatttcctgttggagcactttgcaatataatggagaattttactgcaaccatgattgtacaccacaggccatatgtgaaagtatttccatgagaaggggaagcaatagttcttgtaatattgatatgcaacgctcctttgcaagaatgaaagtcaactggaatctgggatataacaagtattcagttactaatattatcatcgaaaatgatcagtaatatatccaataaatgcatgtttattaattttatatcttaaattttaggatgagctaatgagtaatgaggaattattctttggcttgacacaaggtcttcgtaagtttccaaaagaatcaggtgaacttatgtcctttttctctgtagaaaattctatatcctcttctggctgtgcaacactacagataataggtaaaatggttgctggtgttacaacttccataattttattatgcctcagataaagttctttgccacttctgcttcaaacccaaaaaggatactgatgaagtgctaaagcctgccaatggtagaaagagccaagggctgatttctgacattattgttctaaaaacagctctggatgccataccattcctctccaaggtagtgttatagatgtgtttgtcctagtattcaatttagcaatttattcattctgatttttcattttgttttgtttttgaagatgcatgttattttgttcatttaagggtaaatgtcttttattctagaaacatacccatctaccttttcacgcatgtgatgtgtagctcatcacaggttctaaggggtgcaaaaagtttccttcttcgcaacatttatcagactatatgtgaaaacccaaagtatgcaagcatgagaaagaggtactgttttctgacctttttcctcccatttcaaaggagaagttgaatgaagactgaaaacagcatgctaacttcaggcttagtcttcccatcctgcttttgtttgtacatttgtttttagtttttagtaatattgccagtatattagcattatgtgactgtaaatatgttcgtccacatttattaaataacaagtatatccatctacattctaaaagtaaccattcacctttgatttggttgcatgttttcttttatgatcctagaattggggatgtcattgatgaagatgttgttcattcaagggctccttttgtaacctgcactcaacaatgttttgctattaaggctggaattgatggactgcttgatgttgctcgtagatctttctgtgataccagcgaaggtgtctatcgttttcatgtttgttttctaattttacctaacacagctgattgacataatgcatttttcagccatacataaccttgccaacaagtacagggaggattttaagcttccaaatttgaagataccatataacaacagactaggattttattttattgtaccccagaaggacattactgaaaggctccctaataaatttatccaggtatgtggatatatcccttttaagaaccagccctcttagctaaaccataagatgctaaccaaatatttgtgaatgtgtaatcaattaggtagttagacatgggaagaatgtccactgctcaagcttggagcttgcttcggtaagtttgcatccagtgaattatcatccttgggcatttttagtaattcaacacttactgccacactgcaaatttaaccatgtaattattttctctgggatgctattttcaagtggaataagtgttagtcaatagttattcatttatgttcttttgttttccctcaaagaaagtttatcatcttgtttaagcatcacggagcaaactattcttttgccaaaagcattgggacagtgttatatttttcttctttataagtgtatggtataatttcatcatagctacacgtgaaataagcttttattttatcgattaggatatgacattgaaaaaatataatatgctattggagagtttatttcttcatacggtcacttattaccatgtgctttctacccaaatttgcagctaaatgccaggaataagtctgctgctgctgagtgcttcttgcgcacggaactttgtttggaaggttgccatggccactaaacattgagtattcaacatttttccattggagttttgttactttatttgttgatattgatataggttaagctctggtccagttatcagatacctgttattataattttctagtgataaactagagagttaacatgcaatacatgcatgcataatgtatctgttgcattgggatatcaaattctatatttgttgggcatcctccatataggtagcagctattgtagaacagaacatcatcattcttcttaacttagaatagggatctcctcattttgctttgtttatgaactttttagccatccatttctttgctttcctggcttattttggctgaattggtgggactttgagggtatcatacacttgactaattcaactcacgaacttaaagggaattgaagcttgtggatagtgtaacttgtttctgtgcagcattttacatttcaactagtattattcaagtgtctaaagaaatatttaacttgcataaatctgttctgttgtttcagggcttattaatgagatcagagaagacattggtatattaacgttgcttgccgaagtattatgcctgttggacatgcttgtaaattcttttgcgtttacaatatctactaagcccgttgatcgttacacgagacctgaattcactggtgggcaattcaattcaacactagtaactgatcttgttaaggattttttttagtgatgttgtggagtcctgatctgacagttgcttccaattaagcagatgatggtccgatggcaattaatgctggaaggcatcctattcttgagagcttgcataatgattttgttgtaagttcttcatttgttatttattcctcagtatttacttcatttgtatgtctttttcatcataaatttgttgattgaaatagcaatgatcataatactgtttatatcatgcagcctaacaatctctttctgtctgaagcatctaatatggttcttgtcatggggccaaacatgtgcgttccataaacattgtatccaaatgtctatagcaggctaattatatatggaaattcatctgctctctgcattatctgctgttgcaggagtgggaagagcacatatcttcaacagatttgtctaatagtcattcttgcacaaattggctgttatgttccagctcaatttgcatcactaagagtggttgatcgcgtattcacacggattggcactggggacaatgttgaaaataactcaagcacagtatgcaaattcatctcttctatatggtttatacttatgttatcttgttatttgacttacagaattcttctaaaagcacgtgaaacaataaaatgattagataaagcattcaactgttactgttgatagtcctcaagtaatatttatcccctgagtaccattctttaggcttgtttcctcccagattaattcctatttattatcttaaatctcctgatgcacattatctctattgtgctcaaacctatcaaatttaagatgttttcttgtccatatgaagtataaatggtcatttgcattgtcctgttccagtagttggtgtttttggattccttggtggatttccttaatatagcattagatatggagggtcttaactcctaagatcggtacctgtttgtcatatttatggatgactctacatgaagaagcgcgttgaagtagtggattaaccatcttatctaggatcgcgagagcccatactataccatttcttggtaatatctggatggctgatctggacttttgaattgtttgtatactgtcatttataaccttccttcaagttgtattggccttggacacttgacaaagcaattcacatataatatttcttcgatcaaatcaaatatttcatcaatagttggtcgagcttttcctttgtgagaggcatcttgtagatatttgctttcttaatgaaatgaagcacagttctcctgcgtttttgagaaggaaataaaaacatcaatgctgtatcttttatggagtattagtaattagtctgaagccaattgatgtatagtttatttcaatgctgctaatcagcttaatttctctttgcagttcatgacagaaatgaaagagacagctttcattatgcagaatgtttcttcgaagtactatgggtctaccatgctgcaatagattggattgctgtttctcttgtttccttgtaatgaccatgtgcacatttgcacacttacaggagcctgattgttgtggatgagcttggaagagctacgtcttcctctgatgggttggcaattgcatggagctgctgtgaatatctattatctaccaaagcgtaagaactattaacctcttaagtaccacatttgatccttttcatgcagcataatttgacttatcacagtcctaacttggtggggtctgtatgaaataacttatgtgccttttaattgagtgcttctgaaaaagagatgatgatttgtgtacgttgtcatacttaaattcttagcagacaatgaaatagataagggcagaagagataaactaccatttttctacatgcatgcttactatttttgaacaagaagaggaagctaatatgcattgtaagactggagggagtatcaatattcacagcagatgttttcttgtcaatagttttgaaactgcatgcttttctaaatgtgttgtctaggcttctgttattcagttacctcatccaacatttttgtagcctatttattcaaccatatccatatgttctcatcttgaatcaaatatttgatcgtgataatggttagtacaagaacatttactacttgtcttgtgctcaccttaggccgtgctaccatcaagtttcagatatcatatttatcacagaacctactacttccgtcccaaaatatagcaacttttggctatgtatcttgacacgcttttgtccagatacatagctagaagttgttatattttgggttagatattagcagtaagttcagcatagtgcctgggggtgcttgacatgctgaatgcagctggtcatgtttggttaatcttgccaaccacaatatggtctattagttacagatataaccttttaagacaagatatcatccttgttgagcaaatcctactatcttagaagcatcactgtcgggtcttttcacccaatgcagctacacggtgtttgccacgcacatggagagcttgtcagaacttgcaaccatctatccaaacgtgaagatcctccattttgaagtcgacctgagaaacgaccgcctcgatttcaaggtataacctgaatcgttgacagtcacatgacttttttttttcatgtctcttaacatcatggatcatacaatccctctgcatcagttccggttgaaggatggtgtccggaaagtaccacactatggtcttttgctggcaaaggtggctggtctcccttcttcagtgatcgacactgcagcaagcatcacttcacggatcacagaacaggtaaacctctcagtactgattagagctgatgttgataacacagtgtgtgtgactgcttagattacattatgcaactcaaattgtatgcccattttcttctacttgggtccttttcttttttgactgcacagccttgctcgttcctgctgctggatttgatttcttctactcgagcgcattgatcaagtcaagtttacctgttttgatcccggcctgcaggaaatggtgaggaaggacgacaactgcgagcagtaccggtcgctccagatggcgtaccaggtcacgcaacggctcatctgcttgaagcaatccaaccaaggcgatgactacatccgggaagcgttgcagaatctcaaggacggctatgctgcaggccgcttgacatgagaagaaaaatatatgtaaaaaggagtttttgtttctctctcctacagctggcagcatgtatggattatggtcgtatggatgtagccatgtagggcaccccctcccccccactagcctcgtacaaaccatgaacggggtcgggtagttcctagaaacgggttgcaaggctagcatatattttttggttgccatactttttcacgccacattttagtcatgctacagtttcttagttacgtgtttggtttgctgccacaattgtatcataccttctaaactttgagatccacatatcatgctctcaaatttagagctaagcatgtcacacttgtggccaactatttctaagttacacttgtaccaccatgccacaactagtctaaacttagttatggcaaagttaggcatcaaccagacatccccttatagctgcatcaacgaatagaggtttgggaggcaagaggtagaggggctccggataactcaaaatgcgattatatcaaatgggcattttcagccttcaccaaaacacgcttttcatatcaagcgtgagaagggagatgaaaggaagcacgcaacgctcgtatatgtactctacgattgactatatcttatgcacataaggttttcatgcatagcaactatttcccctgtttcacaatgtaagtcattctagcatttcccacatccatattgatattaatatatatatatatatatatatatatatatatatatattcattaacatcaatatggatatgaaaaatgctagaatgatttacattgtgaaacggaggaagtagcaaatatcataaaaaatatctaaaaaaaattatattacatcgatgtgttaaattttcttttccaattcattactccctccgtccaataatataagggattttagagggatgtgacactttctatcttgttcagattcatatcactaggaagtatcacatccctctaaaatcgcttatattatgagacagagggagtatattttagctgtaacaaaatataatcaatttttctcttaacacccttagattttggtgtagtcagcagttactacagaataagataataaattgcctatataagccactgatctatgctttctgttgccgtttagtgaacagttgttctgctgcacacaccattaacccgactccagtagagaacgcgaccagtttgatccatgttcagtgaagtcctccagccgcttggcataattatcttctgtcgtcaacccatgcaatgtacaattatatttacggcatcgtatatgttttctttctgaaaatgcggttatcaggcgaatgctaaaaacactcgcaaaaccctgaatgttgttagactcatgcaagtttgtcgcggctcttcaatgatctgattatactcgtcaagaactgcttttcaccacggtatctgttgaatgagaaacgaatgccaaggtgattattatattatagcatataaaaagagcgagacattttttttttatgaaatggtgttcttacatctcgagtgatgagaaacccaggcacattatgcctatcgccatgtgaatgggaagggtctgcttgaacctgtttctattcagaaacatcctttcagagaaagctgtggtcaggccagaaatgagcaacacaccccagcctgccggcaagcagtggcggaaagagaatgagccctgtaaaataaagtcatcaggtatttttgttagaacagaaactaaaacaaactatgtgaaacatcaaccgaacctcttaccttgaaatagtctttaatgaatgccgctgaatatgtgattcgcagcagcatatctttacaaacagtcaaggcacaaagaaagttcttaaaagatactttaaaggaaataagatggtagtgattaaccaaaggatactgatggaatttgcagcaatcaacccaactgcaccagcagatttaatcaggacaacatttagcacaatgtaaattgccgagaacaggagcaacatatcatttgactgcttaagcttgtcttcatttgcaacagcatgaaggaaagcttcagatgtgcctgaaagtacacattaacataatcagtgcaactcaatattgcatcctcatgaggaatcaattgaatgtgttactcatgcccaattacatggttgtataaaggctaatatgtgcaatttttaaatatagaacacatcatcaagtatagctaactattgatcaacacaagaagcaatgctacttgttggtacactaactcaattcaaaaaggtcaactacagttcatcatttcagattttttttaatacataatttaagcatgaagacagtaatactgtacaaaaacattgctctactatgatataactggtaaatagaagtagtaagtacaaaccattcattgctaagcatatgacgtagaaacaatagtaacgaagaataactgtagcatctccatcactgtatcttgccccataaagtagtctaagaagggtatatgaataacttggaccaaatgagatgacccccaagcctgcaaagttaggacactttaaggatgactgtattcgaatgagaacgtagagaataaagttggtagctactaaacatgtttactgtacactacatgtactgcaattgcttgcttcttactccctaagaggacacagtaaataacacacgcaaatgcaatcaatatagcattcaacattggataacaaacctatcagcataataagcttaagagctccgagcaaagaaccttccaaattggatatattctggggattttgtcctgtggataaaaggcccattattagagcttttacagaaatatacatctaaacatatgcgtggaacatattgttttgaaataaacaatattgctatgaattctggtgttggtcaaatcaacatttcaaggaaaagttatcgtatcttaaagctgcaatatgaaacaacaataataccaaaagatatattttcaggcagtaagaaatatggaaaatgatcaagtctaaattgtaaggatcaaataatcaagaaacataccaaagttacaatttctgaaaggagtataaaaaaataaactcttttttttaaaaaaaaaaaaaaggatgaactgccatgtttggtgcaatgcctgcccagccaacataggttaattttcattgaataaccaatcaaagagatgttagacaaaacttcacagagaaactttcaagttcagacaccaaagggataaggaatgtgattctcatatctaaatgaagtaaatgcagaagaacctgatgccaactgtgcaaatgtagcataagaactctcctcgaatggcaggaaaactattctaacaaccagactccctgcaaataaacaaaacatgaattgcacatacccggcaacattagaagataaaaaggatctgaaacaaacagcggtcggcatacttacctaatttatccacaagaccataggcagcctggttatatggagtatcaaaccaaacaagaacaaacttttcgccttcttggagcatcagtttcctgaaagtctgtcctgtaaacaacatgcacatgtgcaacaactgtttatcgcagtccatcatggctgacaacctgacaatttgtttgttttaacatcaagtggaaacaaacataaacatgtgatggatcaaacaaaacctaatgatacaacacaatgcaaaggcagacatagaaggaacctgaatggaaggagatcggaaattttggtatttgtaaatataagaaaataggtccaatatccaaagaaaatgcaagctgcatagacaacctgtgacaaagcaaatacaaccaacttttcctgcaagaaataaattattgtttttgtgttgtgttgatcaacaattgaataagaaaagaatgacatgagatgaacaccaattaattgaaaagtaaagaaagaaaagattacttggacatatcactcagcagaattcatatttttgttttgtaaagtcctattattgtcaaagacgaacttaacatggaatttacaatggaggcataaccaaccaaaaaaacataaggtgatctgcttaaagttgaaaataactagattaagtaacactataagtctaaaatacatatagcttaattgttcgatttggcaattagaatggtcagtctaagactttgtttggctagattagatggttagccagattatacacttatatttggaaaaatagaactctaaagaggtttagttgttctatgttatcatattcactttttttgtgggttaacttaatcctaattaataaagttaaaatgtcacaacctgattaagttaatcctctctaacccacatcctgttaaccctgaacaaatgtagctaagagagaaatctcacaccaagttattttctttggtgcatggaccaaaagaacacaatatgaaattggcaatggaactttttgatttgctagctttcacaatgtaaccataaccaaatagatggctataccagtatcaggtgtaaacaacaaaaacaatgtgaacttaagcattttattttatcagtgataacaaactgagacagaaagtgcataataagttgaatagaacgtcaatagagtaaaaacctctgctgttaccattttagaatgtccttttgttatgaagataaaagttgttaaacaacgcagcagagtagccacaggttcagtatacactcttatttgatagtatttcttcctctgggagagaatatacagaggttctgccagtagctccagtacgcaagcaaatgctgtcatattgaatcaactaaatacattagctctcaacgtgaggaaagtggacagaagtcacacaatatgaaaaaaataaggcaaaacatgtggagtgatatcatacaaacaggaaagacaaagccattcatagccgtgcttttatagatcatatccaaatagaaaaacaaatagataaatgtctaaaaggaccatcttgaaatgctacaaataactgtatgcttgcatgaatgctcatctccattttattgatcaagagccaggtgttcaacaattgcatggaagatataatatttcagcaccactaacgagttaatatgtggaatattctaacttaatcaactgattcattcattccaaagagcttatcctcaatcaactgactcattcactctgacgaatttatactaaatgaaatatcagtcaccatattcaggacaaatacacaaagcttgtacagaaacttggttaatacaaagcttaccgataattaatgtagctttagcataggtatcggataaccgcaatttctttaccctcaacacaaataagctgctgataaaggaaactaagatgccaaatgggacaatcatccaagctacctttagtatctcttcatcacttatcgcattgccactgtaatataaatattttaaccatcatcatttaaagagtatattccaatgcaattgctagaaagacctttacaatcccagagcatgtttcaacatgttcaagtggttgaaaattgagaaaaaaaattaatagtgcatacaaactactaatagaaagcaattatttgctcaccgtttgaacagtatgctgagatgacacgttaggacttgtaagaaatgaatgaaattgtgtaattctaccacaagtacagttctaaggtttatctagaatatgtatatgaaaatagattttcacaagtatgcaaaataagaatgtgattttggttgattataaagaaataattaagttttagcacactagggctcaaattcacaagtgcacagcccgcatgcaagataagcctgcggacagagagcaactcacatgggatttcgtcctcatttcactcaaacaggttagctcacagttgttgcattaaaaccctcagcag

SEQ ID NO: 74795 - DNA, 15620 bp, Oryza sativa
atcattagcatatatatgaatatgggcaatgctagaaagtcttacattatgaaacggagagagtagatgatttgtaatggcatttctctaattcgacataactgtaatggtatattgccgccgccggcaggcaactctgtccctacaacatcggatcggaagcgtaatcagtgggcgactcaaaatttgaacgccatcgctgagaaccgtcggatggacttaatttcacgagcaaaacattacggtcgctcgagggctgacctgcggggcccaaggttttgtaggcagaagtcaatcgcgattcaagcgatcaatcttctccctaaaccactgcaactttcttcgctcaaccctaactcgacgaaaccttcagccgccgtgtgccatcctacgtacgccgagatgaccggccgcccagcggcgccaccccggggcctgattgctccaccatcgcacccgcacggcgcgctgccgcggaacaaacaaggatcgggagcagttcaggctgctgctgctgcgcaagacacaggacagcaaagaaggaactatgaccaagataatcggggcgcacaggatgctggacgtggatatacgcacgcggcaggcaaccatcgtcaccaggatcagccgggcgaggcttcaaccggcaatacagaggaccgcaacactgtcctgtcaatcaccggccagctgacactcatgctagtcgccgtcctgatcagagccgcagagaagaggagcgccaagaggttcctgctcgctaggaataggtaactgaggtgccggctaaacacaaagcaatggcaacaactgaggtaccagcggcaaaggcaaagaaaccacgaccacctttttgctacagatgcaagtgcaatggacatttgcctgctgtgtgcaaggcagatttgaattgcattatatgtaacaagaaggattcacatttgtctatcaagtgcccaatcctgaagatgccgaaaccaaatgcgtcgctgcttgggtttggcaagaatgagcttggttttcttcaagtgccagactttgattacaagctcgagactacagttccggcacctacagctttagtcacgatcacgggtggacacctaggagcggatggggtacagacagagcttgccaggcttattcgagcagattggaactgggaggctttgccacacggtaaagattctttcctagttacattcccatcggaggaggaactgaaaagaatggctgatgtcgagtttcgcctaaagaatcatggggttgctctgacgatctccgagtggcaggaagcaggtgatgttattccctcatatgaattggatatggcatgggtgcatgtcaccggtgttcctcatgcttggcggcattatctcggtttttgggcacttggtagtgtaattggggctacagaagaagtagacatgctaaccttccggaagttgggagtgatccgaatcaaagtgggcattatggatagggaacatttccctttcactactgatgttgtgtttgggaagcatgggtatgagctgatttacactattgagcctgaagattttcaacctgccattcccaccccatccaatgatactatggatcatgattctgcgggtactgataatggtagcaacatggatggaggtagtgctgatcatgcagcaaaaaagaagaaggcgaatacatcgacaccggagagttcgaatgctgcagtttcaggtccaactcctatgcagttagcagtgactccttttggggatcgtcgccctgtgccacagagacagcaaattatcctgggcactagagtgaacaagcagcacattgcggtcactccgttaagggtgaccggatcgacatcatacggtcggagagaagtttctctctcgacctcaacagctgcgccagccgcaccgacattgattgtgcttctaccgaagtcttcatcatcgatggatactccacccgggctgacaatggcggtgtctccacctacgcctgcacctttggggtggtcgctcacgtcgaccccacccccatccgctcctgtgcagaccctgccggcatccactccacccatgtagacccgttggcatcgtcgaggcaatcaacatcagcgccgacaaaatctccactagtgccgaccctgccgatgcctacttcactcgtgcaaacaccaccagtgcctactacaacaactcaaactgctgcctatacacatgagggtcatgtcactcagcccggatcgagctccatcaagcactcgaccttcgggcatgtgaggtccccatgcactcctttacaggaggaaaagaccgaagggcttcgccatagtgatcgctgcaatgcagccatatcatctaatggcattgcagcggccgatgaggattcaacgacgaaggctaaacgcagggcagcgatgagaaatctggatgggccaatgatgtccaagatggctgacttagcgaagtcatcactttcgtctacatcataccttgacccttctataggtatgcattctaacctcccatcttcttccattgtttatttatccaatgaacaattttcctccaatttgggaaagataggagtttctttgggtagtggaagtgaaaacgtggccttttctgttaatgctattaaacatatgaaggttgacagatggaaagtagcacctaaaactaagatgaaagctaaggttattgatgaagcgaatgatcaaaatccttttgatgatggtgatgatgaggatgccaaacctgatggcatcttactcgctcacttattcaaggaagtttctgaagtagacttggatgatgcggagcttagcacaacaatttgtgacttaatagatacccctcgaaaatccaaatctgcttcaaaaaagaaaggtcaatcgaccaggaccaaaagtaacaagaacaaaaaaggttgtaaatgaaaggcatcttctggaatagcagaggtctacttgacttggctaaatattggtatgttgctgagaacattaaggaacacaatcttgattttgttgctttattggagacaaggaagaatgatgtgtcaaagacgaatcttgatcgcctagctgggggcgcagatttcatttggcactgtcttccccctcgtggcagatcaggaggtatattactcggtattaatgcagctgtaatggacttgtccttgattgtggaagggaaattttacgttaaattccatttacgcaacaaagaggacagattcgaatggatcttgatggcggtctatggaccagcacaggatgaattcaaatctagcttcttagctgagctagtccgcgcttgccaacaaaatccacatcccacgctcattggtggtgatttcaacattttgaggagtagtacagagaaaaacaacaatagatataatgaccgctggccttttctcttcaatgctgtaattgacagttttgacttgagagaaattgctttagcaggtagacaattcacatgggcaaattccttagccaacccaacttatgagaagttggatcgagtcttaatgaccacggagtgggaatccaaatttccgatagtttcggtacatgctcttgagcgaggggtttcagatcatactcctcttttgcttgatactggttctgcggctttcatcgggaaccataaacagttcaaactagaactaagctggttgactcgtgatgatttccacgaccgtgttgtcgaaatttggaacaagccggtcaaagggcgcaactcggtccaacgatggaacaataaaatgagtgctttgcgtaagcatctacgaggttgggcggcccatatgagtggtatgtataagcaagagaaaaaaagtttgcaatcgaccatagatgaattggacatcgctgcagaggttcgagtcctgactgaagttgaaagagatcaacttactcaagcaagagatcgactagttatgcttctaagagaagaagagacaaagtgatttcaaagggccaaaacttctgatgttcgtctaggagataataataccaaatacttccaaatggttgccaatggcaaacacaggaagaaacggatattctacctagaacaggacgaagggaaaatagaggggcaagcagctctcaaggcctacattactagtttctataagaaactatttgggccacctgaagataacccttttacgctagatgaatctaggactggggatatatcacaggtcacagaggctgaaaatgaattcctaacggcaccatttttggaaaaagaaatacgagatgctgtatttgacatggagcataacaaagcaccgggcccagatgggtttccagcagaattctatcagaaattctgggaagtcattaaacatgatttgatgaatttattccatgaattacatactggtgaattgccattgatcagtttgaactttggggtgataactttgctcccgaaagtcaaagaagcgaatcgcatacaacaatatagacctatttgtctgcttaatgtcagctttaaactattcactaaggtcgccacaaataggattaactcggtggcggaccatgtagtgagtccgacccaaacagctttcatgcgaggacgaaacatcttggagggtgtcgtcattttacatgaaattttacatgaactacatcggaagaaactaaatggagtgatcttcaaaattgattttgagaaagcttatgataaggtcaaatggccatttttgatgcaagcacttcgtatgaaaggattctcaaccaagtggatttcttggatcgagtctttcgtttcgggtggaagtgtatcaataaaagtaaatgatgacgtcggaccttttttccaaacgaaaaagggccttcgacaaggtgatcctctttcgccgatgctttttaatattgtagctgacatgttggttattctaatcaatcgagccaaagtagatggacagatttgtggagtagtccctcatctagtggatgatggcatttctattctacagtacgctgatgataccattctttttatggatcatgaccttgagaaggctcgtaacatgaagcttctgctttgtgcttttgagcagctctcaggtctcaagattaactttcataagagtgaattattctgttttggtgatgctcgagccatggaagaccaatatactgatctctttggttgtgcttctggcgaattcccattatgctacttaggcattcttatccattataggaaactaagaaatgcagattggaaaggggtagaagaacgctttgagaagagactcagtagctggaaagggaaactactttccacaggaggaagtttaacattgataaactcagtgcttagtagtcttccactgtatatgatgtctttcttcgcaataccgagaggtgtacttaagaaacttgattattttcgctcgagattttattggcagtgtgatgatcaaaagaaaaggtatcgtttgacgaagtggagtattatgtgccgacccaaagaacaagggggtttaggaattcatgatttagatatgaaaaacattgcccttcttagcaagtggttatttaagctactcacgaccgatggggtctggcaacaattgattcgtaacaagtacttgggctcaaaacctgtgtcacaagttgagtttaaagttggggactcacaattctaggccagccttatgaaggtcaagcgtgactttttacgatttggcaaattcattatgagagatggtgcccaaatcaagttttgggaagacaagtggttgggagaagcaccattgcgagaacaatatccttgtctatacaatatagttaggaataaacatgatactgtagcaaaagtgctacaaaattaccctccgaatgtatcttggcgaagggatctcattgggccaaaattagtggtgtggaataaccttcttccacgaatcgctaacctagttcttactcaggatcaagataagtttcattggaatttaacccaaaatggagaattttcagtgaagtcgcattatcttgccttggtacattcagatttgcccaacataaacaaagtaatttggaaattaaaaataccgcttaaagtaaatatcttcctatggtatttacgtcgtggggtagttttgacaagggataacctagctaagcgcaattggcaaggaagtaagaattgttgcttttgtcacaaagatgagacaatattacatttgttttatgagtgcagatttgcccattttgtgtggtgcattatacaagtggctacatggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgtcagcccttggagcaggtggtcagggaatgttttacccagggacatgggtggcggtctagcttgaagattggtgctccctgatttttactgctttccttctattgttacaaactcttttgtgggtttgtgtgttttggctgtgtgcatcctagttatgcagaggccgggagttttcttagtatggttctatcaacaatgtaatcgtctgagattaataaaagcttcctttatcaaaaaaaaatatatccaattaacaaaaaaaaaaaggacatgtattagcagcatgacaatctacgtaatcagagcaggaaagcgtaattctatcgaccacaaaacggacggctcaaaggggaaggaaagcagataggcccgcgatagcttaaacccccctcctcctcctccgccgccgccgccgcccgcgctcgccgccgatggcggccgccgcggcgacccgcctcctccgccttgccccgcgccgcctccagggcccacccagggcgtgcccgttcgccgccctcccgctccacccgacgccggcccggctcgccgccaccacctcgaggtggcgccgcttctgcgccgccgcgcaggcctcggcgccgcccccgccaccggccgccacggcggcggcggcggcggcctcgggggaggccgtgggggagttcaggagacggacgcgggtggcggatgtcaagggaggggaggacgagggcgccgcgtgggttggaaagcagctcgccgtgcgcgggtgggtgcgcacctgccgcgcccagaggaccgtcaccttcgtcgaggtgaggggaagctttgcgtttgcgctctcgcatccctttctgtttgaagcgtgaattcgtgatggtggcgctaatggttagcggtcttgtgtttgatgaaatgaacggtgcgaatgattagtttgcgcacattgcataaaattgcattgtggactaggaattgggagtgctggaaaagatgctttccttcagtgcactattcacattgcttccccaatgtcgttgatcattttacatttcatgaaacatttcgatccatggttatgcgattgtactaaactagctttcattgtactacttttgtacaaattacgataacaagactgaacttctggatagatattacagaaatcatttttgtgactgtttgataagtcgtccttcttttgatgagaattgcagcctgtttgacttgcataccagcagttctgtggagtgtgccattagttgtttggttgatgcctaaccttgccataactaagtttaggctagttgtggcatggtggcacaaatgtggcttagaaatagttggccacaaatgtggcatgcttagctctaaatttgagagcatgacatgtgggtcccaaagtttaaaaagtgtggcataacacaattgcggtagcgaaccaaacacatgcctagaaaattgtggcgtggcaaagtgtggcaaccaaccaaacagcatgttacttgcctacttttctctaaggcctacttttgtgttattaactgctttgaagttagaaatcaggacaatttctctaaggcctacttttgtgttagtaatcagacttcagacagtctttcatggaccagcaatactaatctagtaatctgcatgccatgagtgcacagtataatgaatcagagtatctcatattctgaatgcataggatgttaatactgtcatctggagactttaaagttccctgaaataatggtaatgactattggcttttactttaaatctctaacgcgtcctaaaatttaaatttatttcaggttaatgatggttcttgcttgtccaacatgcaatgtgtattgactcctgatacagaaggctacgaccaggtaagcaatcattcagggaatcagggtacaactagatagtagaaacaatacatgttaattttgttttgttattctggtcaataaaaatagtttgatcaatccaatggttatcttgtgaacacagaaaataaaactctgataattgtgacatggcaccaacaatgacaccagcgttgtctagttatgtctcaattccttttattttccttgctatagttgcagccaatgtgttcttgtggctatagtacattttactggtcaatattttcattggtggatgtcagatagactctatcactactggggcctctgtgttagtggaaggagttatagcaagcagccaaggtggtaaacaaaaagtggagttgaaggtttcaaagatcagtgtggtaatggtttcattctgcctatagtttcctccttttcctttttatttccttttttctttgcgtgcctcacaaatctaaatgaaatgtggacagattctggagttaactagctatttccagatatcaaaataaaatttctataatttattgatataggaaaatacttgtggagtagttaaggtatctctttttgtatgctactatgctagtcttgtactcttgttaaagacagatatgagcgttaaccgaacactcctatatcgaataagttatttgatgatccctaacgtggtaacacacaatgcacaaaaaaattcgcccctatgctttctttttatataaagaaatttctgatggcatgacaaaaggatagacctatagactgttaatgttgattgagaatctgcagttgcattttgctttatcaggctgtagacaatattatcccaggtaagcacgcttctagtgcatttttttggtgtgttctgatgtaggtttcacttctttgtacagattggagaaagtgatccaacatcttttcctatacaaaagaagcgggcatcaagagaatttctgagaactgtagcccatctccgtcctcggacaaatacttttggcgcagtatgattttactcattgctagttcttttctgatactttttttttgctcagaagctactaaatctgtagacttgtgttatgccttggaaatgatcatgccctttctgtccacaacttttctacaaaatgctcatcattatccttttctagatgcgttgttaattccctaatttagctcataaattagcatacaagttgtgacaaggtttgctatgcaaatattacaaaataagtggcatgtttatagatgacattctgtccaatccaaccttggatatggatctgccaatgtggtgatgaaatacatacattatgtagaattgcaatggactatgatcaatgcagccatggacaggaaatgtgtgtgattctcatattggcaagaatccaacaaactgctgatatagcatcatattctgcacatcaaaatagtgcaaacgttggtagttttatgtgttgtagtaagatgaacttttgcgttagaaagtgcctttttcttatgatgaagaagctggctggtgtccaacatttttcatctctctagttatgtaacttattctatggaatttttactgtactgttgtacttatttaggtggcaagagtgagaaatgctttggcatacgcaacccacaaattttttcaagacaacggatttgtttgggtagcaagccctattatcacagcatcagactgtgaaggagcaggggagcagttttatgtgacaacattggttagtatttcgtcaataagattctatagagtagtgtatagacagattgcttggtatgtaacaaatttactgtttctgggggaatgttctgctcataatgtcatttcctgtactaacatgctgttcatattgcaacacacattttggtcttctctatttttacctcaaaaccattagtgtactttttgctccagttcagaaattaagtgctctttttctttttttcctcacaaaaaaaaaagaaattaagtgctccgcatcatcctgtactaatatgcttgtccaaatcagaaactacttgaagttttcttttagttttgtacttctgtgtctgtttagaacagcttcactatgttattaggtgcactgctaaatcagtttgaattttccatctacagatttacttatttaaaaatcattaaagttctgctataacagttgattaagtttgtcatgattggtttttatgtatctgtctatatttaaagatatttatggctctgagtatcacttattatctttttatgtttacaatatattccatggaatgatcagagctctccattttggtttctaattgccataacccctttcattatgtttctatttaatgctgttagatttttttccctgtcatacagatttcgaatagtgctgaaggtggttctctagtcaaggatattccttctactaaggatggaagggttgattggtcacaggtaaaacttcagaatgaatgcttatgcaaccttttgttgttaaaagtcaaatgtttcttccccattttaagcaaatttacccgtataatttttgtgatatgctctgttatactgcatgccaacagctgttcaagtaatccaaatgtttcaatgtctttgtggttttcgtaacaatggttatttgcttgtatctatgctaggatttcttctgcaaaccagcatttctgacagtgtctgggcaactgaatggtgaaacatacgctacagctctatcagatgtaaattttcatttgccagattcatttgaaataattttctgtcgtatttgatatagctgtaaccagtgtttctgtttcctgacattgcttattctacaggtttacacttttggtccaacatttagagctgaaaattcaaacacctcaagacatttggctgaattttgggtatcgcaatattcttttacatttatgtttctttcagaattttaaattccagaactcttaatttacaggttttttttttgttggtttgtgttccggggaagatgattgagcctgaacttgcctttgcggatctaaatgatgacatggcatgtgcgagttcatatctccagtatgtagtaggtgcccttttttgcttggtgctcaactctgttagtgattatttcattcagacaatattttatggatgcttcacagttactgacttgctgaattgtggggaagatgtctctatatgcttacaccatttacctagttactgcttgtttgatacaggtgaagtatgttctagagaactgcaaagaagatatggatttctttaatacatggattgaaaaagggatcatcgatagattaaatgtattcctctcagatctttcttctgttgctgcactatggattgttttggtcaagtttcatgctgaaatattgaaaatgtttcttcttgcaggacgtagttgagaaaaactttgttcacttgtcatattctgatgctattgagctacttgttgggtccaagaagaaatttgagttcccggtaacacacaaattcaattatttatattctcatattctcatttggactacattacaattttgttccttgtgttctatttaaagtcctaaccaggaaacgaaaattgactgcatatctgtctttggtgttggatggcatgtcaacatgcttgttgatagaacaaatgcttatactttttgtagttactgataatttgatttgtttaattttaattagtgtgcacaaaattacctgtttgttttctacttctacatactcagttctgtgtactgtggatccttcaacaactgtccctgagtaggcaaatgggtaaatgcaagaatgcgagtgattattttacaaaaataatgcctctttcttttgtcttttgaaccatccataggtcaaatggggattggatctgcaaagtgagcatgaaagatatatcacagaagttgcttttggtgggcgcccggtgataattagagattatccaaaggtttatatcgtcactggtctgtgattaactagttcattaacaaagttgtcatacttcaaaatttccttttattttgcttaggaaatcaaagctttctatatgcgagagaatgatgatggtaaaacagttgctgcaatggatctattggttcctcgggtaagcatatacaccaatagctgacatctcaaacaatacatcatatgtaaaattccgagtatataaatagacaaaatggaggcaaagcttctagcatatttgaattagttgatttgtaatataactcttttcctgttcaatttcaggttggtgaactcattggtggaagccaaagggaagaacgtcttgattaccttgaagctcgcttggatgagttaaatcttaacaaagatagctactggtggtacttagatctacgtcgatatggatcaggttaaatttcaaatatcaaaatgagctggataatgcaatttctccttttacattacagatcatttaaaatttgttattcggtagcatgatttcccccctgtcatgatccataacgaatttccaccttttctgtaacagttcctcatgctggttttggtcttggatttgaaagactagtacagtttgcaactggaatggacaacattagagacaccattccatttccccgggttccaggctctgcagagttttagaatccaacattgctcacaaatactttttgcaacattctttcctgagattgggatttcaagaaaagtatacactctactgtttcattgtacagagtttagttaagttattgcttacatcgagcaaaacaatattgttccaaattttgttgtttggagtaacgtgcttgcaaatttcattgaacttccgatgtacattattgttactggacgtgttataatgatcacctgatggattgatatagtgcatttgatctgttttaccgcatagcaagaattttgtctataccggtcctgtcagaattttatctcaaggtacgatgatttgtttcacaagtaaattttgctgagaggagttatgatagtacttaaatttaccacatagcaaggaatgttgtggtctagtcttgcccttctggtgacaatgttttgattagcaagctcatttaaatggattttttttggttacccatagcgccctaaatattctttttcaataaaatacctttcagacgctatacaggaatcaaaggaagaaagctatacaatttacacgctaatcttgaaataacagcggtttctctatatcgttggctgttccgtcctcaaccattctgtcaacctggcattctttcttcttagcccacagaacgacataaaggccggagaacaggaaaaccattcccagcatgctgcatgcatccatacataaccaagagcaaatcagtttgcttttggaaaatctagcacgaactaaattgcagtcatgcatatctaagtttctaaacacaagcggtacacattgaacttatgttagcacaattattgttgtttcaagaggtcctacatgtcatgtttcgcttaacatagattagacccaatgaatccattagatttttaggtatatactacttttgttttttcaaatagataacactgttgactttttatcacacatttgaccattcagtttatctaaaaaatttacgtaattatatattttttttgttgtgagttgttttatcacttaaagtactttaagcataatttatattttatacatttgtataaaatttttgaataagatgaatggtcgaccatgtattcaaaagttaacagcatcatctatttaaaaaatggagagagtgagtatatgggcctgtttggcacagctccaactccagagctggagctcaaccaaacagtttcagctccaccaaaattgggagtggagttgggtggagttctctcacaaaatgtactagagttgtggagctgggttttggcagctccacaactccactccaaactcaactcctggagttatatttaggagttggagctgtaccaaacatgccctatatatgcacatagtgagagaagaactatacctcactgggtggaccaccctacccaagaacaaggccgagaagatcgccgatccgacggtctgcgtcgggctaaagagggagaccaccacgggccctttcttctccagcgcccatgtctggaacatcacgcacaccgagcttactagcccgccctgcatacatacgcctccatgatccatccatcaatagtcacccgtagcatccttattccttacactaataaaacaaacattaacatgcatgactcatcattgccagttcacctcataatgttttttttctcctttttctaaagtctaaaccggtatgtatcaacagtgatacgatcaatcactactgattgctcgctaccggataataaggaacgatagtgatgctggttatggaattgagatttgcttgatagtgcaatagtaaaggtgtgtgtggtagtgttcaaccctaagatcccccattcaatctccaatacactcataatttcttcttaaaaaatatttggaaaacgtctctcctttcaaagctcgtttttttttaattatgctgattgcgaggtggtggtggccggttcaccgctagcctaggcaagcgctagtgttgatcaatttgcatattcatcattcatggtttaatttgatgtgttaactagtatactccttccgtactcgtaaaggaagtcgtttaggacagcgacacggtctctaaaacacaactttgacttcttttttctataagaatatttattgaaaaattgatatatgtatacttttataaatgtatttttcaagacaaatctattcatataatttttatatttttaaactcaacaacttgagagttattcatgatttatatttcaaggtttgacttaaacattatcctaaacaacttcctttataagtatggagggaatatatactacttcactatatataatactccctccgtctctaaatatttgacgccgttgacttttttaaacatgtttgactgttcgtcttattcaaaaactcttgtgaaatacgtaaaactatatataaacataaaagtatatttaacaataaatcaaacgataggaaaagaattaataattacttaaactttttgaataaggtgaacggtcaaacatggtgaaaaaaggcaacggcgttaaacatttagggacggcggaag

SEQ ID NO: 74796 - DNA, 87218 bp, Oryza sativa
  unsure (1)..(87218): unsure at all n locations
agtcgtccgtcaagcgtgagtagaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcaagaaacacttagcatatacatgactattttagtcttagcatgtaatattgtttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctgtcagggcacgttccgaccagacagagatagggacgagctgacactcaccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacagacccttcaggtacttaccactgcaggccgattccagcaggatactccaaggtcgaagttgagttggtcgaaggcgcgtacgaggacctcgaactggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggctatcaagctatcggactatgagcgaacgctgaagaaagcatcttctggaaagtccaaaccagtccctcagcttggagagcaaccaaaccaggagatcgagccgttggtgaccggtaaagaaatgacaatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccatacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatataaaccatgcagcaacaggggcatgcaaaaaaaaaaggtcagctcgatctttagtcccggttggtgttaccaaccgggactaaagatcgatcttttactctcggttatttcacccgggactaaagatagcgatctttagtcccggattggtactcccggtttggaaaccgggactaaaggggggttacgaaccgggactacaaagggtttctccaccagtgagccaacaggtcggctataaggtgacctgccggcggcaaggtgagcggtacctacacactgatacaaacacgacaatgacatcgtcttctttctcatatccctcgtcttccctagagataatcgatgccgaatccttccgcgttcactcggacgacaccttgtttccattgaaggcaaggtgtttgaggacggcgtggtaactctctttgtcctggccatttcatgctctccagattatccgaatgcatccgcttcccgacgacaggcctccttggccgctagatgcattgccttgcagcttcaaattaacaaaatgtacgtgagtcagcagtgtgtgtacgaaatgttatgttcggtatatactagagtacgtacgagccacagtacaaaagcaatgtacggcaggacaatacacaacataacatacatggcgcataggctgaggaggtcggcaatggactccatcacggtggccgcaacgagaacgaggcccgcgatttagacgagtatatcatggcaacaaagcacatgacatgtctctgtgaaagacgtggccacgttggtgtttgtcacgttcgactcgcccacatgcaatgtgaccgcggcctgggcaagcgcattctcggccgcttcgtccttgtccttgaaggaggtagccatggagatagccccgtgttggctcatggaacaaggttgaagaagaagaaaaagaagaagaagaagaagaagaagtggttgctgagcgagcgatgggaacttacggttgtgaaaccttgtggttctattgttgatggatgtaaatgatataagtataacccaatcacggcgattcggaaaattcacgcggtgtgcgacgctttgttaaccacattttaatttgcacaacgtattgtttcacatcagaatttaattttcccttgcgggcgtaaatggtcatgtacgtactacgttgcttcgttaaccacgaatggcctggccgttcattggaactcacgtaaatattgtgcggttaccgagaatattgcaaaaagaatgatggaatggaagcgaaaccaatgggatttcccaaacgtccgtacttcgtgggaggtggtggtttgtgaccagcggtgtgaatggggtcgatatatatgcccccgccccgcaccactccacagtccacacctctcagatcccctactcccccattccatccctccctccatgtcccacgctgacatccccccactccctccctctcatgccggcgcagacgttaatacatgctcctcctagagaaagtcaacgtggaccttaacatagattcagtgctataataagtaaaggaagtacatagattcagtgtcaagctgtagaccttaacattttgttgatatgtttatagaaggaaatcttatgctactgatgtacatcgcatactaaaaacttgatgaagataccgtttttcctcgatttccgttagcacggttctcaaattactaaatgatatacttcttcataggcaaaaactttttgattataagttgttttagaatatcatataaatctatttttaatttataattgttaaaacaccattaatcagttgttaatgactccagttttatgtgccatcacttaatcttcgtatttcaaacgggaaatagatcatcttcacgcgcgcgctgcctgtgcacacaagcatatagctctgatattgctcagaagtgaagaataatcttgtgcaagttcagagcaaaggtgctgttggaaattcggtcataattcggcatattttaatccaaaatattaagacaataaacatgacatttgcagtatgagtagatctagtgacagtgctagatgtatacaacttgagtatgcttaatatgaaataagcatcaacatttacaaagtaacgcaatgctgccattgcaaagagtattaacaaagaaatatctaatagaatcgggagaatgaaagtataccccgagaacgtcccaccgctggattttgaggcagtattgcttccgttgatgtcgttcatcttcttgtctccaatctccgttgacatcttggtgaaggtgccgatgcagcagcagtagccacgaagaacaagagcagtcgcgcttgaagtgctatccaaaaacttgatcgcccgcctacccgtgcaagttctcaagcggacggagttccggaggcacctgctcgtcccatacacctgtgcacgcaggtgaatagaaccggggaaggattctgcagctcaggaacagaggaggaggaactcgaagtgcaagagtcgtgaagaacttcttccgtccttctggtcgctgcggagtatacatatgcgagcacgagagtaacgttcggagtcatcaaccgcggtgtttaatttcgtaaccgacgcgctcgttaatacggaatcaattcacgacgtttaattccgtaaccgacggaatcaatttacgacgtttaattccgtaaccgacggaatcaattcatgacgtttaattccgtaactgacgcgttcattgatacgaaatcaattctctgtgtttattatcgtccgttacaaaacgagagagcgcagcagcagcagttgtctgcctcgcctctcctcgcctcgccccgcctggttgtccgcgcaccatctcaaccggtcaataaagactctccactagcttcgtatttaagttgagacctcttcacttagatttccaaggtgatattattactcatagcacttaatgtgggccaatggaatttattaggatttaattgggcctagcccattaatctaacaatccccaccaaatttcatggctcacaggaaatgctctcgattctgatcctgtttgttataccagtgtttcggtggagactgttaagttgaacttccacctaggaaaagagctacaccagatcacaactgaataatggactatgccttgaattgtcagtctagtgcgattcaggtttcactcaaacccttaactggtactaggcagccgtttgcatcccctctgtttggagcgtataagtcatactcctggccttttcatgagtatctagatatcacccagatctcatagactgtgactagcagtcggactcatataggtgtgttccttctaagatgttctgtaggccaacatctctgctttatgaaaagccactcggatcatattaaggtgtataccatcctaccatacagattagaagagaagtgcatcatgaagataaagcccattttagggtctcttctctcagttacacaatagtttgtttcgccatccaaattcacgggatctccgatcacaatggacaggtttccaccatgtgcaactctaagtgggtctcaagcccatctccctcgatgcacagtctatcacattacgtggtagccccttggtaaactgatctgccagatttttagccgtctggacatagtccaatgctatcactccggaatttttctgctttctgacagacttcagtcttcttttaacatgcctggatgacttcatgttgtccttcgaactgttcactttaataatcactgtttgattatcacagttcatcaggattgctggtactggtttttcaaccaccggcaagtccatcaggagctcacgaagccattcagcctcaactgtggcagtatctaaagctgtgagctctgcttctattgttgacctcgttaagatggtctgcttgcaagacttccaggaaacagcgccacctccaagtgtgaacacatacccacttgtggcctttatatcatcagcatcagatatccagtttgaatcactatagccctccagcacttttgggtacctggcgtagtgaattccatagctcattgccccttttagatagcgcattactctttcaagagcatgccaatgatcatctcccggatttgaaacaagccggctcaacttgctcacagcaaatgagatgtcaggcctcgttgcactagctaagtacatcaatgaaccaataatctgggagtacctcaattgatcccttgctattcttcggtttttccttaatagcacactaggatcataaggagtaggagctgccttgcagtcactataaccaaagcgactcaagaccttgtccacatagtgagattgcacaagtgtaatcccaccctcaactcctctcagtagtttaatgttaagaataacatcagccactcccaaatccttcatttcaaagcttttggacagaaagtccttgacctcctcaatcacattgaggctggtcccaaagatcaatatgtcatcgacatataaacacaagatcactccctctcccccaccatagcgatagtacacacatttgtcagcttcgttcacaacaaagccagcagatgtaagtatattgtcaatcttctcatgccattgcttaggcgcttatttgagaccatacaaggacttcaacagcttgcacaccattccctcctgacatacccatctggttgatccatatagatctcctcctccaactctccattgaggaaagctgtcttaacatccatttgatggacgagtagaccatgagaggctgccagagcgagtagtacacgaatcgtagtcaagcaagcaaccgatgaataagtgtcgaaaaaatcctcgccttctttttgggtataacccttggccacaagccttgccttgtacttttcaattgtaccatcaggcctaagctttttcttgaaaacccatttgcatcctacaggcttacacccatatggatgctcgacgacttcccaagtaccattagacataattgagtccatctcactgcataccgcttccttccaatagtcagcgtcaggagatgaatatgcctcttcaatggttcttggagtatcatccacaagatatacaatgtagtcatatccaaaagactttgcagtcctttgtctcttactctttcgagttgctacaatgttatcctcctcaggattttcctcaagcgtttgatcaatgtgttctatcggcacaaagtgctcaggggataaaataggttcttgactagaagtgctaggtgcatttttcataggaaattcattctcaaaaaatgtggcatctctggactcagtaattgtaccaactcgcatgtcgggtactccagaatttactattaagaacctatatcccacactgtggatagcataaccaaggaacacacaatctacggtctttggttcaagtttacgctttttggctataagtacatttaccttggtcaaacagccccatgtgcgcaggtgagagagatttaatttcttcctttcccattcctcgaatggtgttacttccttatgcttagtaggaattctattcaggacatgacacgcagtcaatattgcctcaccccactattccttggaaagtcctgcagtgtctaacatggcattcaccatctcagttagagtgcggttctttctttcagctaccccatttgactggggtgaatagggaggcgtcctctcatgaataattctatactcttcgcaaaaagaaataaactcattggaaaaatactcaccacccctatcagaccttaaccgtttgattttcctttccagttggttttctacctcatccttatagatcttaaagtaatgtaatgcttcatcctttgttttcaataggtacacatagcagaatctagtgcaatcatctatcagtgtcatgaaatatttctttccccctttagtcaacacgccgttcatttcgcacagatcgaaatgaacaagttctaatggtgccaaattcctcgcctcagatgccttgtgaggcttgcgaggttgtttcgattgaacacaagtatggcacttagagcctttgactaaagtgaattttggaattaaactcatattggctaagcgtgtcatacaaccaaaattcacatgacaaagtcgcaaatgccacacattggactcatcatcatcatcgtttacatggttcacaactttattacacatatcatccaaggaaaagcgaaacaaacctccgctgtcataaccttttccaataaacgttccatatttagatacgacacatttattggattcaaacacaagtctaaaaccatctctacacagtagagagccgctaactagattcttctttattgaagggacatgctgcacattcttcagctgcacaatctttcccgaagtaaactttagatcgaccgtaccaacaccatgaacagccgcaagcgatccgtttcccatcaaaaaggaggaacctctcccgacttgataagaagaaaacagggaaatgtccgcacacacatgaatattagcaccagtatcaacccaccaatcaggtgagtgacacacagagagaactgtaggtaaaaatttaccataccccaatgttcctctaccctcactaataaccatgtttgcaaacttcttgtccttgtgctcaggacaatccttggcccaatgctcaggcttgccacacaaaaagaaatctccttttacctttcccttgcctttcttcttaaaattggttgtagccttgggtttgacgtcaggtttgactttcttgttgttgttgttggatgcgtgagggttcttcttctgcatcaaattggcgctagaacctccctcgatctttttgcaccggttatcctttgccctcaccttctcctcaatacccaaagagccaatgagatcagtgacactgaactcttgcctcttgtgttttagagaagtagcaaaatccgaccaagaaggtggcaatttggcaataatgcctccagccacaaacttgtccggcaactcgccgttgttgttctcaagttccttcagcatctgaatctcatgagcctgttccactacagaacggtcatcgaccatcttgtagtcatagaactgttccatgacatacagcttgctgccagcgtcagaaaccccgaacttggcctcaagagcatcccacatgtccttccctgaaggtatgtgcatatacacatccacaatattatcggcgagcacactgatcattgctccacggaacaagcaatctgtagcctcaaacttagcctcctcctcaagagagagaggcggttcactcggtttgccccgtgagacaaagaaacaatgcatcaccgtcaaccacaaaagtgcacgtgctttccatcttttataatttgaaccatcgaaagcatgtggttttagtgatgcagcaaagccaactaccgaaaaagacctaacaagtttttggattgttggaaatttggtcataattcggcatattttaatccaaaatattaagataataaacatgacatttacaatatgagtagatctagtgacagtgctagatgtatacaacttgagtatgcttaatatgaaataagcatcaacatttacaaagtaacgcaatgctgccattgcgaagagtattaacaaagaaacatctaataaaatcgggagaatgaaagtataccccgagaacgtcccaccgctggattttgaggtagtattgcctccattgatgtcgttcatcttcttgtctccaatctccgttgacatcttggtgaaggtgccgatgcagcagcagtagccgcgaagaacaatagcagtcacgcttgaagcgctacccaaaaacttgatcgcccgcctacccgtgcaagttctcaagcggacggagttccggaggcacctgctcgtcccgtacacctgtgcgcacaggtgaacagaaccggggaaggattctgcagctcaggaacaaaggaggaggaactcgaagtgcaagagtcgtgaagaacttcttccgtcctttggatcactgcggagtatatatatgcgagcgcgagagtaacgttcggagtcatcaaccacggtgtttaatttcgtaaccgacgcactcgttaatacggaatcaattcatgacatttaattccgtaaccgacggaatcaattcacgacgtttaattccataaagttcattgatacgaaatcaattctccgtgcttattaccatccgttacaaaacgagatagcgcagcagttgtctgcctcgcctctcctcgcctcgccccacttggttgtccgcgcaccatcttaaccggtcaacagaaactctccactagctccgtatttaagttgagacctcttcacttagatttccaaagtgatattattatccatagcacttaatgtgggccaatagaatttattaggatttaatacaggtgctcccttatttttgagtgcaggtcacggcaagacaggaaaaggatttgcttaatgttaagatgtcacgctaagaaaaaaaaaagaagcatgtgctccaactccaacgctttgaaagagagtgaattttctttgtacaaccattatattgcaaatgtaaaaattatgttatttgagaatacaatagtgtaaaagattggcgctcctagatttctaatgccattggaaagcacccaatacttaaaaaaaatagggcgtctggttcttgccattgccattttattgaggtgtacgtgaggctcgaaattaggccaactagcccaccacttagaccaactagaccaaatagccggaaaactccaactcgagctatgctttaatcaactgtagagaatggttcaatgaactgactttggcctgatatatatgatccctctagtcaaaccaaccatgataagtacgatctttggtgaacgtcatttaagtgtatccaaaccaaaaaaaaaaagtgtatccaggcttggtttaagcacagtaggtggcaaaattaccagtacttacaggaaataagttaaataaatttagttattttgtgtgattattatgtaaaaaaaagttattttgtgtgattttatagatttgtactccctccatactcataaaggaagtcatttaggacagcgacacggtctctaaaacacaactttgacttcttgtttctataaaaatatttattgaaaagtaatatatgtatacttttatgaaagtatttttcaagacaaatctattcatataatttttacattttcaaactcaacaacttgagagatatttatgatttatattcctaagatttgacttaaacattttcctaaacgactttctttatgagtacggagtgaatatgtaaaattaattcaggacgtgcagttctatcggttgcatttatgggtagcggataatattccacgctaacaacaaacaggtagaggtagggcacgcagtaggctgtagttataggattgaaaaatagggggtcggtagttggcgcgcgtgttttctcaagtaaggtagagataatttcggtagtagttaagattttcttttttttcacgagacttttttcaactaacaaattgaaaagaaatctatatttgaaattaaatttttaaaattttaaacctatatttgaaaactttcaatccaagatttgaaaactttcaatttgaggtttgaaaattttcaagtttagatttgaaaatttttaagttaagatttgaaaaattttaagttaagatttaaaaattttcaagtcatgattttaaaactttcaactcaaaacatttgaaaaaacacgtgtaataaaaaaaaagcagaaaataaagaaaaaaatatcgccaaaagaaaaaggaaaaaaaagggaaaattgcaaaaaactaccccaaatatcactataagtttgagatggcccctataagaagatttgttgcaaatccccacctctccacctcctaattcaccttggttcgatttaggcaccttctctctacacatgcgtgatttaggcatctcatggcgtaattagccaagtcccgctcatcgtgatgatttgtcaacaggtccctttttgcattagattgtgtggccttaattttctgattaaaccgtactaaacttgctattttgggtcatctgatcaattacaacatatgaaatcatcaggtctaatctaactatatgattactgcttaatgttcaaatgtttctatatgctcattacgtccctggaaaaaaaaaacggatatgttgttcagtccaaaagatatcgatttggaatatatagctaggataccataaaaaacacagtgaaatggtcatgacatcacaacgaaatgatcagtttatactgaacaaacatcataatctcttgcacccgccaagtgggactcggttgattttgccacgagattcttcaggaatcacgcacgtgtggagagaaggtgcctaaatcaaaccaaggtgaattaggaggtggagatttgcaacaaatcttcttatggtgaggcatctcaaactcagagtgatatttggagtgttttttgcagttttcccaacgagaaaaggtcgtgtgggaaggagccaccagcaatgttgctagcgcgcgaattagcaatcctgggaaaatagagcttttcggtccgctccggagaaaaatcaaatacgatcgtgacaaatctctgttacgaatatggataatttctaccaaatatgaataggaattttttttgggaggagatacgaatacgaatatactaacatttctgttcctggcagatatgcggacgttgttgctatacaagtatccacgcgaacacatagcgtatctctggctcctttctgccaattttcttagttctttaatggtattttagccaccaccaatatggttgtgtttagtttacctgaagtttagaagtttggttgaaatcggtacgatgtgataaaaaagctgcgtgtgtatgaaaggtttgatgtgatgaaaagttggaggttcgaaaaaaaactttggaactaaacaggacctatatgctacaattatatacttaaacatccattaaacctcctacaaacactctcaagctgtcacatggccttttataaacgctcataaactatcgtgtggtgttctaataaattagaaaaaaaataaaaaaaaattgataaatatctaaccattgatttcttattaaattggtgcatccataagttttaaccattaaatctcttaaaaatgggatttactatagttgtgtcgacagttttttcttctatggttacattcagtactctagctgccgttggatctatgttaaagatctgtgcttccatccgacttttttctcgggaagagtcccgcttgcagctatagcagctaattttgtgctacatacatgcattctaatttagcactaactttcaaatacgaattcctatatcttttttccgatgtactagagcatcaccgacagtatttcaataataaattcctaaagtgagaaaacctatagaagagaaggcctaaaattaatttcctataatcaaaagtgggccttttctactcctcacgcgcgcaccacgtggccagctcctccttcatctcattattttttttccgtgcgcggtcattttttctccttgcacgcacaagagagagattgggaaaaaatcgttctcttgaggtgaggaacgagatatccggagttgagaacctggatcactgggagaggatactaaatagaatggctgcgcgcgttcttttctgtggattgaaaactatttccctccgcacagaaaacagagcgatctattagcacgtgattaactaagtattagctatttttttaaaaaaaatggattaatatgttttttaagtaactttcgtatataaacttttttaaaaaaacacaccatttagcagtttgaaaagcgtgagcgcagaacacgatgtagaggggttgggaacagtgagcaaagaacacagactaaggaagctgttggtcatgctcctcggatttaggaaagttcagtcaaaaattgcatccaacgtaatccctaacctgtctcccaataatactagttcccaactccggatatctcgttccccgctttaagggagcgattttttttttacgaattgctctctcccgtgcgcacggagaaaaaaatcgcgagatgtaggtgtaggggaggagagaaaaactaattttatctgttggtagttaaagggagtgcccacttttcattacaggaattaattttaggctatcttttagagtgagattagttttctcactttctatattctgtttaggagctctgagaaaaaatagttttgagaattgatcattgtcaatctcttggtgatgctcttagcagtacgtacggttgactctaactttcaaataattattgtcaacgcacgctaacatgttgatcaaccgttgatctgtgaaatccaagggctaaaaagctgattattatttttttgccaaaaaatatgtcaacagatttatagatttatagatagtcccaaaaacacaaggtagcctcacccccactgtgggcaagtacgtacgtactctctctatccggccaccctccaaccctcctactctatatcttctcctatttttttaagctaataactatatttacattatacatatcatctcatctatgacggcccctcacatgtttgagttttgcaggccgtcacaatgaattcatctcaaacggcccaaaaaaaagagaccgacaaagatatactcgcatagacatgttagatatgcatagaaatcgagcccgtcacatatgacacctatcggtgatgagctccaacttaaggcccgacaaagataaccgatgatatctttgtgggccctaatagaagcccgtcaccgatgtccatcattggtgacgggctctaacttaaggcccggttgagataactattaggctcatcattgatgacgagcttttgcttaggctcgacaaagataactgaaacccatcactgttgtaagttttttttggccgttatagatatttattacagtacaaatacccgaactacctagtgtaatggttatcccacttctcactattttgatgggagtgtgagcgggccgatttttgtctctgttttccaagaaaatcataaattgcaaatggaattgaaaaatagtagtcaattctcataaatttagtaaatacttacctgcaaaatttatatataatacttttccacttttttcagctcagggatggaccaaagttggatgtatgggaaaaactgtatgacgtcataccaaggagtatagaaatggtgtattggatattattaacgtcgcggaggaggataggaaaacaagaaatagcgattacatgtgttgtacatgtgcagattacaaacatgagaatatatttgatagcagagtggactgtggacgtacacgcttatctgatacaaagaggtttcatggaggactacacatgttgggtgaagcatagagagcaagaatcaggaagtggtgcacaaaatcaagaagatgaagatcatgagcatgaatcaggaagtggtgcacaaaatcaggaagataaagactagggttcactctcactcagatctagatcgaaaatttttctaagctctgccactctctgaaccctagcggcgccgccctctgggagcccgctgccatccccgagcccaacaccgtcgtccaccgagcccggcgccaaccccaagccagcgtcggccgccgtcgacctcctccacaccgtccttgcccccgtccttgccaccaccgcatcgacgtcccccgccgtccccgagcacgcccaccgcctcacctcctcctccgctggttagaaatttttgtgaattagtaggatttttaggatatgtttttgaattagtaggattttttttgaattagtgaaatatatttgagatgtttgtgtgtgatggtacttagtgaaattgttgtgaattagtgaattattaggatatgtttgtgaattagtgaattattagtatattttttgaattagtgaattattaggatattttttgaattagtgaatctagggtattttattgatgttaaggtgatttagtgaattattaggatatgtttgtgaattggtgaattattaggatatgtttagtgaattattaggatatttttatatatatgaattagtgaagtattaggatatatttgtgaattagtgaatatatatgtatggatgatggattttagtgtagatagtacgtaggttatcaaattatcacataatacaaggtgcatagggtccgaatttggttttatcgagttagtgcattcacagaactgattaagacaccttcggacccagcgcacctcgtattctgtcatttttttgataattattcatttatgtatggatttagttccttggttatcaaataataacacaatttgaggatcatagtgattttaggatttagtacctaggttatcaaaccatcacaaaatacgaggttctttgggtgccaagttggtttggtcgggttagtgcttggacggaaccgaccacgacaccttggcacccagagcacttcttattctattatttttgataattaaggaactttaataggaaatatgtatgtttagggtattttaggggtttaatgcaaatgtatgaaatttgtgatgtgagttactaatttaattaattttgtgattttgtaagttatttagacgatgcctcagcaaggcgaaccaatattgatgacaactagagggtccacaaggacacggacccctaggatagggaacaaattaaatccctaaggaacggtacaccataatagaggtgaaccacctaggagtgttgataagtcccccaaatgttctgaagaggtacaagttgatatgcggggtcatagcgagggagaccttcatcattttggaggatgacatcaacctagtacccgaagccgagaagaacgctgcttagctaaaattcaaggagagcttcgactatcttgcagccgatgaggataggctcaagagggcggctttcaagaatatgggaaattcttggaaaaactttaagtccaggatggtcagtgagtacgtcctcaacccggctactctggagccatttgggaccttcccgttcatcacacgaactgtgtgggagtagttctaagacaagaagtcgacccccgaatcctgggccataagcgagggttatcgggcactccagggtaggaacttgcacccgcatcggcttggcaccggaggatatgcctgacagtaccctcggcataacacaatttacagcagcgcaccgtatcagaggtggtctctcgaaacaccaggaggacatagttagggggtattggctacatgattgtatactaacaagtgtaaactactgacaactatatattagaagtatatgaacgattcttttttttattcatcctccacttagcctagattatattttggcagagtagttcttagttctttcttctgtgtgtcacccttatcatactcacgaattaattaaccccaacatagattttgatctatacaagtaatatatgaattattagcatagtactctcttatcatatgttccattgggattaaataaatatgataccttggattactcatggatgaaatgctacaatggtatatacgtgcgattgcggattatatctgtgaccataaatttaccaagaatatttcggtgtcattgctttgaattatatttctattaatgttgttaagaaatatcaacagggagttggcccgaggagggaggaagaaaaatagagggacgggaaggggactttgggctgggaagggagaggggggagaattttgggcttaaaaaggcccaaaggagagacagaattattttatatttttctttttataaaactctaaaaattggttatgttgattagaattatttatagtcctatgaaaattgaagcaaaattttagggttcattttaggctatggagaatttaagaaaaatacattcgaacttttcttgttttattgtttgttatattttttaggattttaataaattctattatttattttagagaatgatttataatttgggatgaatttatcatggcacgccaaatctccactgccgcagaggcctcctagcaagttctttgtattttccctttgccttcttcctctttaggtaacattttgattggtgtggtatgtgctcgatggaatctccttatgaggacagagaaaaggagatgagggaatttgtatgtgaaggaaacagttcaaagtcccgtgtcttttattacgatgtgatttcctcttttgtgattgtatccatggacctccgaaaggattgtatcactggtataagcctctttcggcttgactatgtggcatgtccttggactgaaacacaagtgctcagtactagccttgaattgtgctctttcttcttgatgaaacatatacatagaggagagaaggtagggaaaacaagaacaaggatgcctcacacgttctcggacacaagggttccatttcaatgttgttggaagaaggttatggtatgtgttgaccacgacgatagcgatagccatggcgacaataggatcttagtgggagccattgaaggtagggtaaaaatttaagggttaattaaatccatgccactgcaactttgctaaatttaaaaaataccactactattcgtcgtatcggctacatgccactgaaaagttctaaaattagaaccataccactcccgtcggtttttctgtcatcctctctcacgtctatcattggtttctagattttggatgtagtttttatttatatttttatatcacggcgttctacgactactcattgatggccgcgatcgacacggtcgtgctcctcatcatggtcgctgcgctaggtttcctcatggtgccttatgcgaaactgtagatccgggggttggggctcggtggtagtcttgacatgctcaacttcatggcgctcctggcgtggaccgagttcgaccttaactggaacaacttcaccagtgcaatcagagagcagcggggaggcattgtcagcgccgagatttgggtctgagaggagcataagcagagaaagaggagagaatgaggaaagacagaggtagaagatggggacattttcatccaatacatacaaaatactatcttagtggcatcattatagatatgcaaatagtaatagcatattttgaaaccacctaatttctaatggcatataggagtatctaattaacaaaaaaggaaaaggaaaatcacctcactctcccatcccccttctgttccacgacacggcctgcccacacggcacggtaagcccaacccaagatggaagaacccgccgccgccgccgcctttcccgatccgccggaggacccctccccctccccctcctccgcgccttctccggccgccgcggcgcctcctccggggccgagggagctggcggcggcgatggaggcggtggagcgggacgtcgccgccatctccgacagctacgcctccctcttcgcctccctccgcgtcgccctcgccaacgtacgtacgcactcacgcacgcgtaactggactaagctcccgcggcttcttccaccctccacccttcgctcgcttctcccatttctccgcctcgcttcgtttgctgctcgttcgcttcgctcactgatatattgtagcctaaccctcttgccgcaaaattgaattttaaaaaaaaaggtcacctcgacgtcggcggagaacatggagtgcctgggagacgtcgtcggccgcctccaagaatccggtgaggatgtttgcttacgaatctgcaaatttctctcgatttcatcataagggtaaacgattggggggaaaaattatgttataggggggtaaggctgtaagagtgtgcgacatttacctctgaatgctaattcttgtatggtagtagtttgcatccggacatggtgccctttattttgatattgtagttggtaattcgatcatttcgccaggtttgcttgcgcattggactgtcatattttctctttgtacagttggggtgtcctaatgttgattgtatcgttggttggttgctttatttttctggataaaaaagaatgattagattcgaccaggtggcgatttttacctttttactctgtccctgcagcactcgaagcttcttcgaaaggaaataagtacatcaattcgtgcttgaggtgatcactttcagctaatcttcgtcatctttccgttttctgctacatctattttttctctatgaatgtagatgggctaattgtagtgattttatagcttattgtatgggtgttccctttcctgtttcatctgtaactgtaaaagcattcatccttgaaactgtggactgtttatatatgaaatagtaattttgctttcagttccttcatacattattttaatgacctatattgcaggttgaatgaggaaatgagaggtctggaaagcctagccatgcaactgtatcctttgttagtttttataaatttgttctcctggatctatgtcatataattaatcaaacaccattttgctgtgcagttttattagttctgaagtatattctgttattcattttgtaagccttaatatttgtaaaagaaagattttacggaagaatgttgattcactagacttggctgtcaatcagttgctccgcctcccctagtcagttgctgttatccagtaggcagtagctaatgcaaggtaactaccactgctatatgatttttggggtcatatgcttttaattcttttttagttttttatatgtgcagtaagtgtttaatgctttcacaaaaagttaacagctagaaatggtttttagattttctgcaatttggtttcaaagcatggacatgctactccacatgtggcctatctgatgatggaccccttgttactacatctcttttataaatgcaccattattagctgttggggaaacacgagctttattaaaaagagataaattaattgttaacagagagtgttcattcatggcctgatggcctcatgaattgactacccgaaatatatatttattatgtatatctgcatactgatagtttatattctggtatgttgtgttatgtactgattcttttataaatcatgtactgcaggaacatgtaatgacattgtttcagcaattatacataataactcgcgctccaagacagcaaatgctataatctgaaatggcacacaccagcaaaggagaagatttaccttgtgtggcaatataaaatactacatccagtgtttcacttcatttcctcttctatatgtgtgcttatgagctccgtatttgtatagtgggttattcaattcaacccatggtgacataatatcattatctgtaaattggctataaagactatcttcatcactttgttctaactccattcaaaagaaagcaataaagatcctttttattgtttgtttgtttgtttgttctactattaccctgtctccgtttagccatcatttgatctatcctatgtgatcacttgattgtgttaacacatatacaatttcttgacgtgttgtttgttcggtcaacttattttaaagtttaaatattctcatatgaataggtctgcactcaatagctacgctagttgcattatgaagggaacttaaagagtgttatcttatcatggacacttattggacgtgcacatagtaccttttcatgctattttttgctcttcatgcttatgtttgtacttaagcagattccatgtgattgcatgatggagccagaaaagatgaaggtctgtgctactctcaaatttgtaaggcttgtatagtgttttatctgctcctaattgctatggttgatttttacatttttattttattcttttacttaacatgacttgagtatgttaaaaaatgtgaatcatagctaccactagtttgcaggcagccttgtaattccatcactattgttgctctccaatatgttggttgatgccatatatttttttggttcttcagatcctaggagggtaaaggtgctgcttcaaatgaagagcacagaatgaatctccagatttttcataggcagtaggtactgattctcatgctcgtaatacattcagatttttatgctcagatttaagcacggctatttatttgaaagagactttatttaagcacggctatttatttgaaagagaatttattcaagcatgagtattaatttttattgaacataggatagattcctcagacgtatcaaattcggtactccttgattgtgccaatgttgattcaattggacaaactactgttgataatgattcttgtaagctactcatagtatgcaatttgaatttcaatatcaagtcaagaaaattatctgttgaactggacttattttatcctctcagatgaagcaacaattacaaatattaatgtatttcccttaatgctatcatacaacaatatactgaaaaacaaaaaataaatacacaattggatattgatctctgaaaatatttatagcaaagaatctgtctttgcaggtagcctcctgaagaagttcacaggtgccgatggaaccttatgacgaaaccgtgggtgcctcatccagaagaaaccaaggcagagtgcaatcacttggaatggtgtcacatacaagataactgcagtaagcaggcaaaacaataggaacatagatgttgcccttggatccctccagctgagcagcgactgcagcctctctccttgagttgcaatgtccccaacaactgtctgtatcctcccagcaacatgccgtagcctgtcatacctcatcctaaccagatctggactctttgatgttgggaatgtatcaaattcttcatcaagctcatctgggtttgtcatatcggcatgagatatccttgtgttcatatgaggtgggaaacgcggccggaaccggtaattccacaatcctatcaagaacatgtagaggaagattgttgggaggataaggtctgggtagaagacaagcatgataaatagcacatgaactaaaactgttgtgactgggtttttccactgacaaacgtcgccaaaccactttcctgcagcaatgaatccggagaagacttgcataagacggaagaagttagccttgcttcgccgcatgctccacaggtgtgagcgggcatctgacatgaactcaacaacttccctgcgaactggtggctccatgcgccctagacgctgtgcgacaagttgcacagcttggtggcggagcatttcctgctgcactattgacagtggttgcgcgtaatgcatcttgggcaagaggggccgagaatatgtgaagagcacattgagaagggatgtggctgtgaacctgatggccaggtggagttctcccattttcttaactcctgatgggtggaggacaagtaatggatacgtgtgtgtgtacaccctcccagtctcaagagttgaaagccgaattcgcactttcccgatgggcttgtccatatggccgggggaactactgtggttgctgtctgcagatatgtggcagttgtcaaataaaccaatggtgagcactgttccatggtcgaagacatcccatgtgtactgttcattgaatctagggttcaagttgtcaacaatagtacgtgtccgcacccatttctgaccatacttggcaacacaatatgcatcgcatgacccccgctcatgcttggtctttgttggattgagcccatttgcacttagaatgccaacttcaagcagaccgattggtggtttccacagctgcttcattgttggccggagatcgctacagtactgtgtggactcatcgagcacatggtaaccaccttcaaggcaaatacgaagttgcacctttgcatagaatttatcttcctttagttggttcagatcaatcagtcctggccttctgagatcaaaccatgctggcagcactggcttatggtcagccctccttggaagccttgcgagaggtatcatagtttcaccaatcacttcatccttgttctgagcaactcgatcctctatttgtatgatcaagtcctcctcgaaaggctctgccgcgacaaacatcatctcctcattccacatgaagtttctggttggtgagcgagctggccttgtcttcagcatttggtggcccagcctcaccttaacaaatacatcaggtatgtggttctccattggaaatatatcctgtgccccaattacattgaccctcacataccacattctgggtacagggtagaccttcccacggatgtagttgtgaagatgggaatcaattggttctgatcctgcgtggatggcacttgggaagcactcatctgcttgagttccataccagacagcgagcatcagctcccctttatccctgtgcccttccttccccacaagtcgataccactctggtgccaatgggctgtcaggagggacccttagtggtacctcatttagatctattgacacccggccaacataatcatcccgaatgaagtccttatccttcacaataacttcaagtgacgttgactgcattacttccctagggaaagcaaacacctcatcccactcaggcctctggttcttctcaaagtgccttgtcttcattttgtagtttccgaggtgcacctcaacataaggatcaagactcccagtgatgtccatgtggggcagatcacgggccttaaccacacgcacaaataggtactgcatcttctcaacaaggtcgtatgcccctgccttttcaccggggatcacccggccgccaataacacgtccgccaccaagtgttgggcttgtttccttcagctggaattctacaggctgctgctgtggaccttgagcatacatcctcatgactggaggtggaggaccttcagctttgttcccgacagcagagtaggttttctgttgctgttgtccgtatgaactttcagggtagtatggctgcgcagtcattggctgcggacggtgctggtgctgttcttttggtaagtgttggaattgcctcacttgatctgctctggtctcctggaaaggatttggaatggcattggcggctacctgctcttgggcagtcgtaggcgtgcttatgaagtcgaactcctgaccaggagcggacactctgactgatggatcatctgtaaggaacaccctgagaccgagctcaccacgagcacgggataagatcgtgcgcttctccagggggtagtgaagaggtgtggcatctgagtggctgacaaaggatgtaccggagatccgaaccttgccaaggcaagtcttggaattgctggcgcggtttgcgtggtacacatacgcctcgaggtctttctcagtgaggcgggatggatcagatatgttgaagtagaactgctcgttccagacagggttgatatccctctctttgatggctgtgcggaacttctggtcatcgaattcgatctcgacataggggttgcatgtgccctgctcttttggtaggaggtcatgagcactggtaacctccaccccaagcttaagattgctcatcatgttctgccactagatcttgtacctctgcagcagattttctttatcctgaaattagaacaagaacatgtatttagaaacctgccattgctgaaaccagagaggtagctggcagcgtaactaccactttgacaaatgttcttggttgcaacaagagatgaaaaaacaaaagaaggttattgcagaagaaagttgtgccagctaaagttggttgggaaagttttgttgggatatcgaatgcccacaagatttactttttcccaaggaatcataagattggtagtaggaatcatcaggttgtttgaagcatatcccgcacagaatgttcaacaagaaaagtgttgacaacaacatgaaaggataaagaagaaaaagtatgtctcctttctgcagatctttgtattcacatcagctggatatcagtttttaactccctgtctggaatttacatctttacagatggaagctatctatcatgataggagtattctgcctcaatttcaaatctttggagggttgctacatacgtgtacgcttgaaatctctattaattacatcctacaagtatctttactacaatagaagtatctttaaaaaattcaattatacccagatgatgacatgttgatgcacacatagtcatcaatcaacatttagactctaaacacatattaaattcaatccacagatagctgcatgcatgcgtataaaatgtgctgaaataataagttacaagtaaaccctcagcagcatttggtagaccagatgtgaggggtagggaaagtgagaggccaccggccaccctcttttctgattgggacatccattgtaaccacataaacaattgatcaaaaatattattataacataacagaaacatcaatttttattaaaacaagaaaataagaagcataagccggtatgaatacgatgcctgtttactattactacagcctaattagcttcctggaaaacgctttgattaacagtgatatgtggtcagatgacataaatgaagaaacaggattctcaggtctgaaaggtagcatttgaattgttcaattaaaagcacaaatgggcatgagctcagaatggagaaaaaaaagtaagagaaactttgatggatggacaccatggagcatggaccatttcttgcacctttattggaaaaggttggcaggtgatggctaagagatgggggagggtgtcaccattggagttaagtgaagtgctccatgatgttgcatccatccatacatacatcagatatcaaaatcatgtttattcatgtgatagtctctattctctaggaagttcaggcacttcattaaatagatggagcaaggaccaaatgaaattaaattggagatctcaacagagaaaataggatctgttttcacatttttgtgcctccttggttgaactttggacggttttataggaactgaaatttcatctcccttcctcaactcagagtaccataaacaaatctgcagccctcatagtaaacaatctaagaattcttcctcccttacctagttacctaactaataactttcatccgttcaacaaaaataactaatacaaatttcaaaacaaaagaggggggtgaagaaaaagccaagacaaacataccaaaacttctctcgggtacaaaaacagaatatgattaaattcacccaaaaacagactaaatcagccacgcagaagcacaagacggactctagaaaagaactaaagcaaatccggaatattcagagcaaagcaaaacatgcagaggtgtcagcagggagggtggtaaccttgagagctacgatagaagccggcagagaagcttctgctccacgtgttcttgatgtcttcttcttcttcttcttcttcttcttcttcttcttctccgttttgattgattcaaagtggagaggaaagagagagagagagagagagaaagagaagcgtacgggactatgggttatctatcctcttcgcggcaacaaggagagaggaggaggaagatgaggacaactggccacacggaggagcagccggagaaaaccccaacgtatggtagggaaatgaaaacggcaggtagctagcgagaggaggaagaagaagacgacgaccccgaagacgtaagagagagatggacagggatagatatagagaggcagatcattaccccagcctatagagcgagaaacacatgcaaatagttgttgcttaattgcgtgttaaggttattaagatattattacactgcttgggaggagctgagccgaaaccagcgtgtgaaaaggggttaatttagaaacagcagtgcctatttaaacaaggattaaatgctctcttaggaggaacccaaacaggattgtgttttgttgtctgtacttgcattgctagtataagggtgaaaacagtagaacatggtcggaaacagtatattattttttatgggaacggtttttggttggtcatgaattttttctatatacatcaacttaactatttagtgacgattacaatatagttctgatagatatgtaaaaaaaaaaatcaaaatttatactttctccgtttcataatgtaagactttctagcattgtctacattcatatagatgttaatgaatctaaatatatatgtgtgtctagattcattaatatttatatcaatgtgagctaatgttttacattatgaaacagatggagtatattggttgaaaatggtaccacttttacgaaaatgatatttcgaacgctcaggaatttcagccaccgtttttgttataaatgaacaatgaaagagatttcgttttaggtaaaattaatcaaggattgttctgttcaaaacttactgttttttaatatgattattagatgtgattaaccaagatttttttatgtaaataatcaaaaggattgggttaacagcgacaggtggaatatacatacacggatcagaagcgtggcgacggatcaacgagaggctgtcatttccgtcgcattccgacgctgacccttcactactgtggctggccactactgttttgtctgtttatttcttggtgtttgcttgcttgattattattccccttttttcctgcttgctttcttgcacactaatacccccatttacttgtggtccttttgtgataattatcacgctgaatcccatcgttttttttaacagtccttacctatcattgcagtgctagtcaaccgtcaatgcactggcggtttttgggggcattatactggcgctgatttttttttatttggttttgttttaacaatataactacctaccccacgatgtaatactgctagtttatagtttagcagattttattaattagtcgtcgtatcatcacatgataattgcagatcagctctcgttttctttcttgactcgacatgcactaaccaaaaaactagtcggggactgcacgcacgtgccggtgcaaccagcctctctttttttcttcccatttagcaccagttaatttgtaagaaaaacgtactctctccgttttcaaaatatttggcactttgactttataataacgtgtttgaccattcgtcttattcaaaaaatttaaataattatttattcttttcatatcacttgattcattgttaaatatactttcatgtacacatatagttttacatatttcacaaatttttttaataagacaaatggtcaaacatatgctaaaaagtcaacggtgtcaaatattttgaaatggagggagtagaatttagaggattttaatctatatatgaaaatttccaaaggaaaggtctttgaaacgattaattaatcctatcattttcttgaaatcctataaaacagataatcctataaaattttagagaaaagttaacaatagctccaacctcttaaaagatatttatgtgagtctatctctctcccttgtctcacgtctttcctgtggtagagtaaattgcattggtggtacacaaacttgttaggatggtgcaatttagtacataaacttataaaatgcccatttcagcacatgaacttgtctagtttgtgcgaacgaggacctaaatatcattgttcggtttttttcatctttttctactatcactatatcatattctattttttattgagaaggtgtatgtctaatagcaaccttcctagatataagtttacatagtatattaatcagcccctgaataataagattagccatgtagtttccttttcgccttcctccgcacgcaccagacaattttatgcaccaaaacgagtattttacaagttcatgcactagattgcacccacttggcaagttaatgtatcggtgatacaatttacatccctgtgatatattcaaaggacattttttttatttttcttgtattttacaatcctttattttgcacatgcattcctatccaaatcatgcaatttttttatattttcttttgtataagagaccacttctcttttcaaaatttatgagcaattgcttagttttgattgactacgattttgttgcttagttttcgtcaagtcaatgagcaccaacaacattttgtcattgacgcgtgtcatgtgggtttgctagtataacaaccatcattattttacaatctcggaaaaaagggcgttttcatgctaatctaggattgatgattatgagctactagtatctatctattgcatcggatccaatagtttttggttccattatactgcacctattaaaatgggtttataatttttacagggataactaaaattaaaattggaaggcatgactgtagaacaaatatactccctccgtattgtaatatatgacgtcgttgattttttatgccattcttaaagaacatttgatgataaatcaagccacaatgaaataaatgataattacataattttttttgataagatgaaagaccaaaagtcgacaaaaaagtcaatagcgttatacactaaaatacggagggagtactttcaaatagattacactataatagattaatggtttaatttattcctttaaaactttcaaatatttttttaaaataattatggaaactaatggttagatttagattctactgctccctctattccaaaatataattacctttaaattttaaatttattttaaatatagctacctaatattgccactcttacaagtggtgctaaattatttgccactaaacccatatgtcatatacacatgagggcccacatgtcatagacagtgagtggcaaataattaattaccacatcttaaaaatggtaagaagttaaatgtcccaaaataaaagatgatcttactttctcatcctacccctaaccatctatatcacaccgactacttaactctaagaatataatgaggggtcgttttatcttgcaccataatccttaatatcctttaaaaccttcataagtaactataactattttgatatggagggagtactatcatttcagttaggacagagggtaccataaagcaagaaaaaaaaggatttgatagggttgtgtttagttcacgtctgattgaaattaaaacgatgtgacggaaaatttagaagtttgtgtgtgtaggaaaattttgatgtgatgaaaaagttgaaagtttgaagaaaaaattgggaacaaaaccaggccggagtactatcatttcaattatctgctgaacaatttttgcaggggagtcctggactgagtagttctagtttgctggtacactgcaaagaaaattgaatatggagtggcctggttgaatgtgctgagaaaataatgcagggtacagctagcgcgaaggaacaggagtatgggtccagacttgagagatactcaacgtaaaccatatggttgactgacttgacgttgacatggacttgttagagtacaagtcaagaaaataaaattcgcatagtactccttatgtttgtatttactggtcgctattacttttactgttcaaattttgactagtattagattttaaactgttagaacactggtggagaaatcctttttaatcccggtttacaactcctgtaatcccggttatgcaaccaggactaagaatctaaaactaaagatacccatctttagatctggttgaaataaccgggactaaaaatgaacggtatagtcccggttggtaactccaacaggagtaatatttttttttcttttttttcctgctagtatgatttcgaaatacacaaatcattcataaaattatccacaaatcattcgaacaccacaaatcattcacaaaatccccaaatacatcaagttgcattttctatatatccccaaatacatcagaaatcattcacaaaatcacaaaaacatctccaaaatctataacaaaattatccacaaattcatccacacatcacatgtcacacagatcaggaaaaaaaaatccacatcgaacagatcggctgtacacatcgcacatattaaggaaaaaaatccacatcgcacagattttacagatcaggcgccggccgtccgccgcctcgccggcctcccgcccagctgcctcgggctccgccgccgcctggggaacgcgccgcccaccgcctcggcagccggcgcccgcccgctggcgcctccccggcttccctcctcgtgcgacggccccgccgggcgcagcctctgcgcgccagccgccgccctccgcacaccggccgcggccctccgcgtgtcggcggtcgccgccctccgcgcgccggccccgcggacctcggctcgctcgatctgcatgcagcaaagaaaaaaggagatgaggagttgaaggagaggataaggcaaagaaaaagataagagagagtaagaataggagatgaggagttaagaggataagtcctaaggattatatacggtacatcaaattttagtcccggtttgtgataccaaccgggactaaagatcacggtgatctttagtcctggttattaacacaaattgggactaaagatccaaacggaggggcctgacaacccctgacagcatgtgaaccggggctaaagatcacatagccccatcttgcttataaactaggactaaataccatctttagtcccggtttttactgcaaccaggactattgtggtttttggccgatcaggcaaagatggtttcttcagtagtggatgtgataccagaaacaaaagtttatgtgaaggacaaaagtcacaaaacacactttgataatactgttgacagtaggaatcggcaataaaaaaaggtagcacacaagagctaaaataaatgggttgtgagacaaagttttactagataggttcggaccctctctatcgacgggggatacccgtaaaccggatatagagggtattggggtacgttggtacgaggatctatgtaatacgacatcaagcaggcagaaaacaaagattatactggctcaggccccttggtaggtaatagccctaatccaattgatatgggattatatgatggaaaccacatattacaaagggaatagtggaactcgatggtattgacaagatcgtagtcaacttgatccgactagatcctcggcgacttggctccgataagctctggcttcgtaggctgtggtggatgtgttggctctgagattcgatgccttaggtcctcccggggggtcccttttataccataggtcaactggtctccaagtaggactcggagacatcagacccgatacgatacaatgacgacccagttctatccgagtaggactccttacatctgtgaattccgtaatggatttccccaacttatgccgaaaacgtccgcatacgcgcaagcataccatgttgatatgtgacgtatatcaaagggtagagggtataactttcccgtaaccctgacagtagcccccgacttctgcttgaataaactcgtgaaaccgatcgcgacttctgatgtcgaagttgtcgtcgttctcggtgtgatgaccgagagacaagaagtgatcgacaatgccgggtgaagctcaatggtcatgagtgaatttaaattgaagtccgagaaactgccgcgcgtaacggacccagaaatttccggcggccatctctcccctttccttggaattcgcaccgtcaaaggtgcgtctatttaagggagttttggttctcgattcacaggtctgagcagcgaagccgtggagcgctgtgtcagccagatgatgatcagtggcccgacaatggcaagaacgtccctgttcccctttgcgagaagggggcagccgaacgcgaagctaccatcaatgtaagtgtactcgacagctcttttgcacttttttcccaagatcgcatcgtgacttcataaagcgtaggatctctctctgactgacatcatcggaccgctcgtggatcacctggcggcggcgtcactgaaggagaacatcgccaaggaggtgtccgatgttgccgccgctgctgccacaacgagtggcggcaacgttccgaagagggggaggaaattctcctccgtgatcggaaatcgtcggaagacacccactccctcgataagcttcctggtccttcatcgcgtgatcggcaaacttccaacttacatcatacccgttatgctccaggcctcagacgcgtctcccccgcctccgcgacagcggcgggttgtgatgcttggcgagaagtaagcggatgaatttgaggttttgtcactttgccaaactcatttagcctgtctcaattgcaacctttcgcagagcggcgcaggcaaaggcggcgcaagacgggtctggaggaacctccagcgcgtctcctgctgtggcctcgacagacgtcgtggccgtgcccaggagctgcgaagcgacgcctagtggaccggccagtgatcttgcggctggtcggggtccgccggctgccgtcctcacctgggaggagctccaggtcgagatggggcgcctcctcggggctggtgctcgcggcattagttgtgagatcgcggaggcgagggcggcggtggcgtcgtcggcgaatgagcgcgccgatcggctggcgcgtgatctggcagaggttcgcgaggacctccagaagatgagagaactggtggccggcaacgagcgacaacggcaggggctcgagcaccgcatgtcggagcttgagaacagcttgtcggaaatccgtggctcgttgcaggtcacctatactggtctgcaccagcttgccggggagtgcggtatcaagtccaccatcccggcgaatcccgatgagttctcgctgacgtcttctcttgcggagctggtgacggcgatggaggaaattccctccaagcatgcggccaggatcggagaagagacgtctaacgggatctacaccggggcgtgccacgtccttgcgtgtgtgaggctggcgcaccctgaactcgatctgtggaagatcttggatcagggggtggctagcgacgcgcacaaggatgtgatggaggaggtcggcgatctgggggagtccgtcctcccgcttttttaagagtagggtcttagctctcttgtactctttagtcatgctttgtaaaacttttattggtcccaaccgccctagtgtgtgcggtcattgccttagctttctttagcattttgatcttgagtgctttgttgtcgtttgtagagatgttgatgtcgaggatgtccagcagcgtgggcagcctgagttgccagtggtcgttccgttacttacgtccgagccaaatgtgccggagggcgatgtagatcgaagttcgcctgtggaaatgagcatggcgacgactcccttaggttggttgtctttgttatcatttccttttcccttccgtctggatcgacttgatttgttgtgctctcgggagagaagagcagcttgacttagtcgtttccatgctgagcaaatcccgagagtgcgcttgctgaccaggattgtcgcatccagtattgaaggacgaagtttgaggtcgcgggactcgagaggactatgctggaagtgagaaaggaccaggccatggagacactccggggtcgtgaggtgtggttcaactcgtatctgaagagttgttgcacatccatgtcgagagtctgtagagagctccgagtaccccgtggggatcccgagggatcggcagccggatacatctcgtggctgaatggagcctgcgcctagctcgaaggcatcggtcaacgtctcgacgaggccttgaagcaggagtgtcgtcgctcaagccgatatgctgaggggcacgtgttggcctgcatacgagatcatcatccgcagctgcaccttgagttcctccgcgaagggttttcacgttctcggaggaaccctgcggagatagatggcctggcgaagttgatggcgccgctagtggagaaggtcttccagtcgatggactggcgttggccttcctggtagtctctgtgttctatcacaaatgtcttaggaaaaagtgtaatatagttttggactttgatggaattgtaagaaatactagtggaatagaaaagaaatctatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgcctcggttgaacaagcactgatcctagccctcagtcatgaagttggaaagtttatttccgattacacggcttggttaatacgcatggcgagaactcttacacgactagatcttacatggtctttcatctctacaggatccgacaaggccttatcggctctgggcgtccccagccgaagttcccttaggttcctcggaggccttgtcaagatggcgtaaagggacatgaggataggtttcaatgctaggtgtcatctaggtacgggatcataggaaaggaacactttgattgtggtcttgacctgaaaataggctttattgaagctgtaagatgtcttacaagtatggatactattaacttatacatagaatttacgtaattgatcaatgttccaggaatttgccaactcgcgaccatcgccgtctgcaattttgaatgcgcctggccgcagaacttgtgtgatcgtgtacggtccttcccatttgggtgagagcttgtttcgccctgcttggctttgaacccgtcggaagatgtagtcgccgattgaaagcgtgcgtgctcggatgcgcttctcgtggtaacggcgaagggcctgttggtagtcggttgcttgaatggcaactcgttcgcgatgttcctcgagtagattcacatcgtcgtttcgctgctcctcctgatcctcatcggaatacttctgtacttgtgtactttgatgtcgtagctcggtggggagcatggcctctgagccgtacacgaggaagaagggtgtctccttgttagacgttgtcggtgtggtacgcgcgacccatagtactgatggaagttcttcgacccacttcttgtcatgtgacatgagcctgtcgtagacgcgtgtcttgattccttgtagtactatgccgtttgccctctcgacttatccattgctctgaggttgagaaaccgaggcgaaacagatcttgactcccagcctgatgcagtaatcttggaaatcggcattgatgaactaggagccgttgtccgttatgatacggtggggcaatccgaatctgcagaatatccctttgatgaatttgatggcgttgttggccttgatttcccctgtgggtgtcacttcaatccacttagtgaatttatcgattgccacgaataggaacttgtagccgccctgtcctcgtgggaatggcccgagtatatctagcccccagcacgagaacggccaagtaagagggatagttcggggtgcttgcgctagcagttttgtgtgtttactgtggaattgacaggcttaacaccgctgaaccatgttgcaggcgtctttgagggcggttggccagaaaaacccttgtcggaaagcttttccgactaatgtccgaccggcagcatgtgacccacagatcccttcatgtatgtcgaggaggaggtgtctgccgtcgtcggacgagacgcatgttaggagtaccccgtttggtgccttcttgtatagatcgttgccgatcatacagtaggacttttgctttacgggatattttcttggcttctgcgtcgtcttcgggcaactcttcgctgcttatgaatttaatgagtggggtgcgccagtcgtccgtggtctcaatatcggcaacggcgcgctctgcctctgtagcccaagagctggtgtcaggggcgaccgggctatctttgccgcttgcctctttcactgatggcgtcgtcaggacgtctagaaaggtgccaggttcaagtggttctcatctggacgcacgtcgtgctagatcatccggttcgatgttgtctttgcggtatacatgtcagacctcgatcccatcgaaccttttttccagcttcctgacttctgcgagatacttggataactcggggctagagcacttgtaatctttatgcacctggttcgcgactagttcggaatcccctttcacgatcagttgcctgactctgagtgcagccgcaactctgatcctggcgagtagtccttcgtattcggctgtgttattggttgccctgaagttgaggtgaattgcatgcttgaattgatctcccgaaagtgatgtcaagatgaatcctgcccctgctccctggtgttgatgaaaaaaatcgaacacaccggcctgggagatctgcttagctccagtgcaggtccagagattgatgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggctatatgtccaatgtagataacgatataaaggcaatcggctgatgataataaaatataacaataatatagtccagtagaaaccaatcggcaaataatgatatgacaaataagcattgatccgaaggttaaagcacacatcggctggaggtccgatgtcatgaaatccacaagattagattaaacagtgaaacctttgttgccatcggctaaatccaacttatatatatatgcaatccttatgagccgatgcaacgtccagataactcaccggctgaaaccccgatgaaacccttattagcagtaaaaaagcaggctagagattatggttctaagcacgacttagtagatcaaacttaactgatgcagcactaagtatgaaaagaaacataatatctagacaatcaagccgttgactttgttttcagggtggtagatgtctaagctaatctaatttagcaacacgatttagccgatacctgcagaaaccctaaaacgagaagcagccattagagctaaattgatatgctaagactagattaacagagacatatgataaataggtaggcaaatatatcatccaaaccagagcaatccaagaggttgaatgtactcatgcagccttgaacgacgccaacgtagacgatacaattgcctggaccaacggaacattggacttaccccttcaccggagatcgaacaccgatgcagccccgcgtcgggtgccaagtcccgctggacgataaaataaagtagaaaaggtaaaaggtggcgatgcgccgaattgtattgatcgtgaggataaattacataaaccccgggtgtacatatttatacccatgggttgatacaagtccttgtcggacaagaaagaaactttactaaagataaaaggaaaagataaagtccttataggacactaaacacactttcctgaagataaaaggaaactaacgaactattcctaattaatagataacttgccatgccgcattctctttgaactcagtctcttctggataagcttcctttagtagatcaatttccttaaccgaatatagcaagaatccgacaaccgacgacttgacaactctcatcggctaatctcaggacatcgaagccgatgctgactctaagccgatgactactccgggcttgccaaattccactgttaacacctggctgttgagtgcgcccgtcaaacgccattgtccacgtttcattgtcgatttggttgtctgacctattatcaggcatggtccaatcggctacaaaatcggcgagaacctgggacttgatggctgttcatggcacgaagtggatatcaaattgacttagctcgactacccattttgcaatgcggccgacaacgtctttgttcctcacgacttcgtcgagagggaaggaggagacaactgtgaccctgtgggcttggaagtagtggcgtagttttcttgatgtcatgattactacgtagagcagtttttggatctatggatatcttgtctttgcgtcgtggagagcttcgctgacatagtagactggtcgttgcaccttctctctcgacaataatgacagtgcaaacggaatatggcgtggcggcaatatagagaaataattcttcattaggttgagggcaataagtacaggtggatttgataggtagcgcttgagtgcaatgaatgccttttcggcctcttgtgtccatacaaatttgtcttgctttttcagcagagcgaagaaaggttgtcctcgttctcccatcccagcgacgaacctacttagtgccgccatgcatccagttagcctctgtacttccttgagtcttgtaggcgacttcatgttctcgattgccttgatcttctcgggatttgcttctattcctctaccagagacgaggaagccgagtagcttgcccgatggtactccgaacgtgcacttcactggattgagcatgaggcgatatcgtcggaggttgtcgatcgtttcccacagatcgtcaatctgagtcgcttgtcttggtcttgataacaatgtcgtcgacgtaggcctcgacattgtttctgagttggttgctaagtgcgccctggaccgtgcgctggaaagtgtttcctgcggttattagtccgaacggcatcttaacgtagcagaataccccgaacggcatgatgaatgctgtcttctcctcgtcctctctcgccatgctgatttggtggtagccggagtaagcgtcgaggaagctcaacaactcacagccggatgttgagtccaccagttggtctattcgaggaagagggaagtgatccttgggacacgccttgttgaggtcggtgaaatcgacacaaattctccatttcccgttggccatccacaccatgactgggttggctagccactctggatgaagtacctctatgatgaaaccagctttgagaagcttgtcgagctcttctcgtatggcttgtttttgatctggtgcaaatctccgcagtttttgctttacttgcttggcattgggtcgcaccatgagtttgtgctcaatcacctccctgggtacccccggcatgtcggacggctgccaagcgaacacgtcagcattgtcgccgaggaaggtgatgagcgcgagttcctatttctcgtctagtgatgccccgatcttgacggttttgtcggggttggcgctggagagtggaacgatcttgattgcgccgtccggcttcagcgtcttgtttgttttgctcactttcttgggtggctcagctatggcgggtgggcttggcgtgtgctcgaccatgtcgaggctccgcttgtcgcattgtactgccagcttagcgttcccttgaatagtgattgttcccttcggtcccgacatcttgagcacttgatacgcgtagtgagacgcggccatgaacttcgcgagtgcagctctcccaatgatggcattgtatgctgtatcgaattcagcggcatcaaaggtgatctgttctgttcggaagttgtttgcttggccgaaagtcacaggcaacgtaattttgcccaatggtttggacgatgactgaggagtgattccatggaagggttgatcggtgggtgtcaactcgcttcgtgggatccccatcgcgtccaaggtgctggcgaagaggaggtttattaggctgtcgccgtcgatcagaactcgtgctaccttgatattccgaatagtgggttcgaccacgatcagatattgccctgggatgacagcagtcttggggtggtcctcttctgagaattctatcttctgctcggaccacttcatgttgggcgcagccccctgccatgtcaaatagacttcacgttccactttcttgtattctcgctttgaggagtatgccgtggaacctccgaagatgtgtgagacatgaatgtcggaatctagttatgctgagtccgattcctgagtaggcgccttagcgtccttctcaaccacatgtactcgcttgcctttttccgatgccatgtgttttgcgagtgactttttgaagacgaggcaatcttctagagagtgtctgtccgtcttgtgtatatggcaccatgctttcttcatgtcgctgccttgtgggtctaggcacttgggagggtccgcgtattctgttgcgaaaacttccgattgagctttcctcttcccactcttgcgatttttcttcttgctcgactcaggtgcgtccttggctggtttcttctctcctccggtcttcggtttgtcgttcttgcgtctcagtgcgtcatccgcatgagcgcatcgatcgacaatttcgaataatctccgagtagtcgtgatgcgcctcattgccaactcctgagtagtatagcgatctctgacatcggatttgaaagcgcgaattatagaagcattggtgatctcggggattatgtttctgcactcgttaaagcgccgaacataatccctcaagtattcgcccgggttctgtgtcaacgcatgtaggtcgtcttcgatcgcgtggcgcttgtaagttccttggaagttggctatgaattgctgccacaggtctgcccacgaagagatcgagtaggggggagatgcatcagccatgaatgtgcagagcctttcaatgcggttggcaagtaattcgccaatgcgttgtcgtccgctccggcagcgtagagtaccatggagtaaacctgaaggaactcttccgggtcggtgctcccatcgtatttctctattgctccaggtcgaaatctttcaggccatcggacatcccgaagtgaacgaccgaaagctctacacccagtgctgggggcagtgggttgtcggcgatcatacgttcttcgtggatgtctatctgatgatgaagatgacgaggatgatgatgatgacgatgagtcgcttggttccggcgtgcgattacgaggacgtcgaccgggttctcgagaatcctgtcgtcgtctcccgttgttgtctcggcgccgatctccatcatcgtcgtcattatggcgatttcctcgaccagtatcgcctggcacccgccgttcacgatcatcgtgatcgtggcggttgtggcagttatcacggtctcggtcttcgctcgaacggcctcctcgttcttcgttatcgtgacaccgtgaagagacgcgatgtcgggaacggttctcgttatctcgtgtgcgtcgcgcctctcagcggccattcaggtgatcgcggagatcgccaatgctgcgaggtggaggggtggctcgatgaggcgattcccgctgttcagggttttcaccattagcatcgccagttggtggctgttccgggtgcgctacagcagcggcctcttcgaacgcgttgctgaggttggtcactgattcccgtaatcgttctgtccaacgtgcgagatcgtcgttcagaacgggatcgtagggggtttccctcagtattgcgttgacggctctgatatgctgggccggagtagtcacttgattctccgcttccgcattggtgcgcgctgacgcgccgacatcgtcgatagccaatacctcacgcggcgtgctcgttgtcgatgatccatagtcttcgaggaggtgcaagactgatggttcgtggggatcgatgtcgattaccccaacaaatcgatccgaaattggcgtcgctccttgttccttgtctttatccctgatggggatgtgtgactgctggaccttaggagatggcgccttcatggcgctgagaaagaccttgcagctcgagaggtcgtgattctttgtcttgtgaataggacaatagacatcacgagttggagaggtacgctgaattccatgctctttgcaggcacgaatttcagcatggacgttgagaaagacccagcaggcttgcagggtgtttttcctggttttgtggataggacaccaggaccttgtcaccttggaagtaatcctcgtcggcttgtgattcctgtcggaaagacaaggcttggccgcactaggatccttcttgggctcggatgtcgtcgacgctccgatctccgcttcggcgggaggatccttcgacatggagtcgccccgggttgtagccactacgttctcgtttccggccattggcggaccagctgagatcggcatagtggtataaaccggaaagacaatttcgccgacttgagtccacaccagtgttgttgaagtaggaactccttggttgaggttggtgttgacactgttgtcaacgaagctggatgtcatagtagtagaaccttgagcaccaagtccccctacctggcgcaccactgtcgacaggggatacccgtagaccggatatagaggttattagggtacgctggtacgaggatctacgtaatacgacatcaagcaggtagaaaacaaagattatactggttcaggccccttggtaggtaatagccctaatccaattgatatgggattatatgatggaaaccacatattacaaagggaatagtggaactcgatggtatcgacaagatcgtagtcgagttgatccgactagatccccggcgacttggctccgataagctccggcttcgtaggctgtggtggatgtgttgactctgagatttgatgccttaggtcctcccggggggtcccttttataccataggtcaactggtctccagtaggactcggagacatcagacccgatacgatacaatgacgacccagttctatccgagtaggactccttacatctatgaactccgtaatggatttccccaacttatgccgaaaacgtccacatacgcgcaagcataccatgtcgatatgtgatgtatatcaaagggtagagggtatacctttcccgtaaccctgacactctcgacgagaagtaatactctgctcttatttaaggattggaatctaccgggtgttgtattgatttgacgatcttggtgttggttgtgcccttgagaggcctcatgccctctttatataggtcgaagcgcaagattacatataaaaacctaacctacggcatctactttacaatattgtcgaaataagactttaagacgtttccttaataccttaatcataatccgttacatattctagagatataacctatcctctacaaccagtcggataaaccagccatgtggatataaggtactcataatctccacaaatacaataaccatttaaagctttgttcaaatcaacagttagcttgagtctttcagttgcatgtaaaacggagtgagtgattagtacaaaattaattaattaagtattaactattataaacttaaaaatgtatttacttgatataaaaagtctcttgtaaaatacagatcatttagcagtaaaaaagtgtgcttgataaatgcaattggacgcaacctaaagtatttatagaactttttacgattaagataaatggttaaactttatgtatttgtactccaacgccaagtatttgtgcactgcatcagttagtgcacaacctagctagttcttcaaaacaattattcaagcacgcatatataatgcatggctaatgatccaagtatgtagattaaataagagacatgagaaggtagctactccgtgcacatctttggtggaaaaactagcctgactagggtaggggatcaaagagatgataattaatttactatataatgaggtactagatgacatggaaatggaataagataggcaggatatgttccccgtttataatgtccttcctcgatcggaactgctaacatccccgtttagtataaggggatgtttagttcatactacatctttggtcccgttcgattctgtaactgggcttggatgaaaatgaagattttcatgtcacacttttcaaattgttaaacggtatgtttcgtgcgaaaattttctatataaaagttgttctaaaacatcagattaattaatttttcaaacttgtaataattaaaacttaattaatcacacgttattaccacctcgttttatatgaaacacttcatcttcaggagattcaaacaccatagggatgttagccgcttcttaggcaagtttgaaaaaaaaaagttttgaagtcatcaactcgtaggattgtgcggttgaaaaattaatgtgcctagccatgatcacaaatcatcaaccaaactcttcctaagtaacgtgtctaaactttatttgacaaatttaaggcattcaattaaacactccctaagtattttttttcagccaaaagttaatagatattttcatcttaggacgtgtttggctagtgaaaaaggcaaaaataaacatttagctaacccataaaaaacatagcttgtctttttatatgcatattttagcatcaatccaaattaaactactctctccgttccaaatgtagcaatctaaaactaaattagattttttgcactaagaatctaaacacatgttcctcaatccattttcacgctagtatcctctagctatattttataacaaagtgagcgtttaacttacacacaccaccaaaattttggtacaatatcaaaccaagccgatccttagaccagcaatctaactatgatgaacgtttacttacactacatgaagcaccatctacgtaccacacatcacatataatagctttctcagtttctctgggtaaatatagttatggggtgtttaaattcaggggtgtaaagtcttggcgtgttacatcgggtattatataggggtgtggtaaggagtgttcgggcactaataaaaaaactaattacagaatccgtccgtaaattgctagacgaatttattaagcctaattaatctgtcattagtaaatgtttactatagcaccacattgtcaaatcatagagcaattagtcttaaaagattcgtctcacaaattaatcgcaatctatgcaattagttatttttgagcctatatttaatacttcatgtaggtgttcaaacgttcgatgttacatgatgtaaaattttggggtgggatttaaacatggcctaaatatagcttttacgacgcttacgacatggttacattttgcggtaatattctgctaagaccatgagagtgtgtctccgcaccttttttttttagggtaaatttgcttgatttgatatcatactttcacaaccatgagaagagcatagtaatccggtggtaagagagctaccagtactattgactgccagcgtttgagtccccccgtactgattttcacaccatttcttctctcttcgctgttacgtaatcgaatttttcggacaaaatccccaataaattataagcggatcataactacttctatatgcaaaaatcacttcccagatcagatgtcggtctgctataataggttattctcgcaagcataccggctggatagcaagtgggtcccacgaattttaccacacctctttttctcatcctcctcttcctctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactataccggcatatctatcgattctatagttatatgcgaaaatcttttatgtagtagtgcttataatcgattctactatcagtatcccatattatcatctttcaaattaaaatggagtatttcacaactgtagcaaccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtattttgataaacttttacaaatatgataattttgatagaatattaaaattttgatataatttttccacaaatttggtaaaatttgggtattttgaagaaaaaaagacagaatttgggcacaatttcggcatggtttttacacagctaacaaaatacatgtagcaatcatcacaaaatcacacaaaatcaagcaaatccaaatcatgaagccaagcaaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctctgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgatagggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttccaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcagtggaccgagtccaccgtgcgccctcccctagtcccgctgacgtgtggggcccacctatcggcgcgcccttcccctttgatgacgtcagcggctgtgccttttcctttgaaaaattaaataataattccgcaataaatcagtaataattctagaaatttatttaaatggctcaaaacttctaaaattcatatctaattcattcgaactccgaattgggccattcaacttgcaaaattcatctaaaattgacctctacatgtttgttttactttttatgtactgttttcttggtttttattagagtttttcctcgttttgcgtgccagtgtgtagttcccgtcgtttcggaagtccgtggtcatgaggaaaagagttcggaagatcaaagtgaagaagcaaggcaagtcacacattccccttgagcattttgatcctaatttacaaatgttttatcgtttgcaaataaaattgcatgtcttgctaattacatgggatcagggttttacctatctgctcacttgtgccatgtttacttgatatctgtcctttgtcaacattgggtaataaaacgaatagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttgcgggatgccctggaagaacttatcgtacttaccataagccagcgtgggcaacggctgggcttgtagtgtagctttcctctagccgacgcatccaggcaagggtgggcgtgatggagtttggatgggccctgcgacggcctatgcggcttccggattcacctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacgaaaatgtgtcgtggggctgtgtcttgtgggtacagttgtacacctctgatcagagtaaaactattcgaatagccgtgcccgcggttatgggcagtcgaccaaattcaccgtgattagtcccaccttaataaattgactcaatgcactgtagttcaggtgggttggttgggcctgttcaacgtggtgtagcgttgatcagtggagatttaatgttactttaattactcaacagttttactgttttactcaataaaatgttttacaaccgcctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacgaagttagaagaccaaggctcagaccccagttgagttttgcttgtggagtggagctgaagccccgctaggatcgcctttttccgctgctgtcattctctttcgttgtgaggactaagtgcctcttctgtaagtattttacgctttatttacgtttggaactgtttattacttgttgttttgtgtaccctggctggtcctagacagagatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaaatgtctcctctcgtccttcggcatttctttgcgaaacggtttttaaaattctcctcgatgtccctccaattcttttagttgtaaaacctggaggacaaaccgtcagcttcgtgtctgttcggaagtcaagtcaagcatcaagcttcgtgcagcaaagagcgagaaggtcagttcagagtcgtcgttccgcgaaggtcaagaagagttttcccggagttacctaaacccaatctttcccggaagagtagttccgttagcttttagatcgtgtgttgtttgcttgtgtgtaggggtatggattgcatcattggtggggatgcgaccatactaggttgtttgcttaagcaacttgaatcataaaaatccattaacaacagatcagtaggcaatcggtttaagaccttatctttagtaacccctctcatctccccctccctctcttgtgcccgtagcaattggtcagtatgagggatagttgcattgggtcaggatctcaacagtttcatggatcaactcggtgcaatcctatgggcattccacgtcaacttcatgaagatcagcttcaaccttaagtcatggctaatcagactcagacagtggaagagttgttacaacagatgcgacgtcggtaccagatctatcagatgcagcaaatgcaatggcaatgtcaggagccacgtcaatgtctccaatcgcaggtgcaagtccaaatgccagcccggaacccaaatcagagtcagagtcaggagttcccaatatcggcaccgaagacccctgtcaaaatgctgtccagatccccgaagataactgtagccgagtcatcgtcagaccaaaggaaagtaagtgctacctgttatgactgtggtgagcaaggtcactatgcaaggaactgtccatggaaggtgttcaccaggtcacctgaaaaatacgagaagcagtgctcaggaagtaaccaagctccaagccagtctaccgacaagaaggatggtactttgcagcccaactatggagcgaacaggacagtaatatggaagatggataatggtaggaccatgatcatcactggtttggaatttactcctgaagacgccgcaaggatacccaagcgtcagagaagaaaaaataccttccgtggagtacgtcagctaacccgacacctcataaagtacggcccgcccagacccgaagatgatgaatcaggagagcggttctctgctgacgatgatgataatgacgatgatgatgatgatgaggatgaggcgacacttaacagtttcatggaaagaggaatggagttcaaagcatgtactagatgtgggatagtcggacacactgctagtttatgcctccccacatgtcgctgtggtgaatatacccattactcagatcatgccctttgaggaaggttacatgattcttgtgtgaaggaacagatcatgtgcctaaggactatcagttgaacacggtcatagctaagaccaagaaagaacaagggacaaccgtgcaacccattcgtcgaccaatggcagacgacaacagcagtcacaatccttctgctcttcctccaactccagctccagcggaagccaaccatggaagaagcaacatcgccagggatgttcagaaatcactgcttgttccagtttcagctgccaaagtgcacaatcagaagcctgcaccccgggaccaagcaagtcgattatgtcgcaactgtcgtaaaccaggacattgtttcagcgattgtcctcttccaagagcagcaaaggcagttcatcgttgttcacaagttaccagcactgcccacgacaccaatcgacagctgaatgtgcaacctccgcctcaatggattatcgtcaagggcaccgtcaaaggccgcattgttccaccagcaacagcttcaagccttcagcaccagcgccagcagggtaagcaatgccaggaaaccaacagctcgctacagctacaaagaggcagtatgctccttcgtcagcacccgcagcaagtgttgccagcatcaggttgcccaactattgccaatcctagcaatgcacctcgtattgctccaatccggaggcccatcggcaaatcatcactcggtaatcccatgagctagaagatcctacctgctacagctgtcaagaggattgccattccctcctcgaagatcaatgcccagagcaatgtttccgatgcaacttctgttagtaggaactaaagaaacaagtcagttaggtttaaataatggaagcaatagcagttctagacaagacttctacttttcaagttcagtcgtgaaaagggcagttctaatcagtagcagtctaccagtgtttaattttgtaatacttctccttgtacatatatgtttatggcagccatgtaatgaaaaggaaatgttgaataaaatatgagttagccagttcctctccttttatggttcatcttgagcatgcagaagcaatttattatgtgtatctgtcggtgccacaagaaaccaagagtttctcttctaactcatcgcaattttgttgagctccaaaacctgtttgctagccaatagaggaatggttaaccaacggagtgaaaatggttagacactcaacacttgacatgatgagatctctttaaaggcagcatcagtggtactcaaatgaaaagagggatggaatatttgaaagtgacatcatataaagaatcttgggaactctctaaccttggaagctgttacaggatggtaatcggcaattacgccctagtggtgtgatcatgaattcagtataagttccaggaatcatctcaatgtttctcaaaagttgaaaaaagaaattgttccatacatgagtcaggaagatacaagagtttggtccagaaatagaaatgtgtagtcaacaaggtatatggcagagaatctattttcaacaaatcatctttaccgaagatatgaaagcgaagtggttatgatcaaagagcagaaactctcagcagcatcaaagtcagtttccgatagttgttcagattgcagtattttccggaaagttgttgcaggatctatagtccgtcaacccaggaagagtcagcaaaggatggtcgaagaagtgaaatgtcatgccatggaaaggacctcttgagttggatctgttaagtgatcagtgcttgtttcaaggaatgttaactatgcaatctgtttaggcatatgacaccaaaaatcaagtcagaagcaagatagttgtaccagcagttagaactggttggggaagtagtcaagagttagtaagatcaggagcgaaatgagaatttctttatgtggagtttcctatcagcaactgagggttaagttccaaatcttgctgggatgaaagtgcgtcgtcatttctctattttgatgaatcggtgaagttcaattttcaaagtgagggcctttgtaagtaagagaagtgttggttatttttcaaggacaatagtccaattgttcccagtcaggcgaaagtaagactactccctgtaaggggggtaggtctcggagatgagttttggctcagttcgtcgctgttttagtgaaggttcaacctagtgcagcaatccgagtagcacttgaagaagcctgttgcaaggtatcagaagagctaagccgatctcagggcatccgattgaattctaaggtacacccgtgaggccagatcaacaactccgcttagagaagcagcatcagggacagttgcagttcagacgaaagattgatcaagcagcttcttagaatacttactgttcatgtcaagagcagcccaagcgaattaagggtcaatgatttacgaatgccagagataagtcttaggaacaactccatccttctctagccagcttggtgaactgtcaggttatcaaattgctagtatcaacggttcagcccaagataagagagtttcacgagcatccgcagccctagtttgggtcagttcaagcagaaccaataagttcagttttgggaagcaatgggacaacagggttgaatccagccagattgctcgtataggtttgatcagttaatcgatcgtgttgggtaccagaactccagggatctaatccaatgaggccagtcagttcagttgtttgaagcaaaagaaacgaatggtcgatgccgatcagttcaattatgcaggtttggtccatcgagcaatcaaacaatcagtcaatccgaaacagaaaaaaacagtgcagtgtctagatcagtcagatcggtcaaaccgcccgcacaaccagttttctctctagccatcccagaatctcgggacgagattcctataagggggtagatttgtaacgccccgattttcgtttgggattaaaaatcatttaataatgcactttctagaaattaaataaaagttaaagctagttaatcaagtgaaattattgagggaattaaaaatttcctttaaaaatcaaggccgggaatattttgtaatattctttgtgccctaatgtactctccggaattttccgtgaattttcggagctcaagaagtaattttaatagcacaaagttcattgaatcaattaaataaaaagaaaacaaattaaaaactccccttcctccttgggccattttcggcccaagaatccttcctctcccccgcggcccgcgcgcccctccccctctcgggcctctctctctccccctcggcccgctcgtccttgaagtgtaaataaccccctgctccctctctctctcaggccgacaagtgggaccgcgggacccacttgtgaggttcatccccaaccttcctccatcccggccagcaaccgcccgaagccgccatgccacccgttgccgcccacgtcgccgctgattccggccctcccactcgctccctggcgcccaaaccgcataaaatcggttcccctccacctcctctaccaaatcccccacttttccccaatttttggcgccaaatcgagcccccacttcgcccacgatgtcgcccacgtcgccggccgttgccgcatcaaatccgccacgtccggccacaatttcaccctcccgagcctatataaaccctccccgtgctctcctcttccgtttccccctctttccagagcccggcactctctccctcgctctccccacgccgctcccgcgcaccgccgctttccggcgagctccggccgcccaccaccgctgctccacccaccgccgcacaaatccgccaccaccgtcggcttcgcggcgccgtgctgcagccaggcccctactccatttcccctctccgcctccggaacatcgctgcctcacgcaccacctctctccgccgccgttgtcgcctccagccacgcgccaccgccgctcccgccgctgttgtgctgcgccgcctccactgtcggcttcaccgccacgcgggcaagctcggtctccgcttcgtttccccgttccatcaccggaactccatctcctctgtcagcccgagccgccaccacctcgccgccaccgcgagcgacctccaacctcacactctccttcgtcggctccgcagcaacgatagggagcccgacatcccctcatccaagctcttcgtcgcgggaaatcctttccccgctgtgagaggtgagctccttccctcatcgccggcttccggccgagttttcccgccgccttgcgcctcctccctattccctaactttccctccttgttccccagatccttccggtcgccgtccgccggttcccgctcgcggaacactgccggaccgccgttgccgtgccaccccgaggagtgccgccgccatctcgcctccctttggtgccgtgccgcttgctgagcatcccctctccgctctttccgccgctctccgcgtgccgacccgcgccgccggtgtcgtcgccggtggtcgccgtccggccgcgcgttgccgtcgtcgttcgccgccgctcggccgcgcctgtactttggccacccgtggaccactcctgtggtctgggtccatggtgccgccaggctgcagtggaccgagtccaccgtgcgccctcccctagtcccgctgacgtgtggggcccgcctgtcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagtttttcctcgttttgcgtgccagcgtgtagttcccgtcgtttcggaagtccgcggtcgcgaggaaaagagctcggaagatcaaagtgaagaatcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaacaatatgcttagccatgcttaattaccactagctcagttgatgggataactgcagtattagacctttttagtatcacgaggagctgcgtgctcaagacacccggccatgcttcatggtcgtaattgtccaactaaaatgcgactaaatggtgggctgtgggtgcatggttttgctagtcgcacccatggcaattaaggaccggttcacgggatgccctggaagaacttatcgtacttaccacaagccagcatgggcaactgctgggcttgtagtgtagctttactctagccgacgcatccaggcaagggtgggcgtgatggagtttggatgggccctgcgacggcctatgcggcttccggattttcctaggcatgagaggggactgcccgctgccttgcgaggagtgggggtgaaacctgaggtgtggtgtgcttggttagagggggttatgcgaagggtcctgtcacggcctctttccggtatgttgtggtggcatgtcggcgcacggaaacgtgtcgtggggctgtgtcttgtgggtacagttgtacacctctgatcagagtaaaactattcgaatagtcgtgcccgcggttatgggcggtcgaccagattcaccgtgattagtccctccttaataaatcgactcaatgcactgtagttcaggtgggttggttgggcctgttcaacgtggtatagcgttgatcagtggagatttaatgttactttaattactcaacagttttactattttgctcaataaaatgttttacaaccacctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatggggtttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgttctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctctgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagnnnnnnnnnnnnnnnnnnnnnnngatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctatcataaaattgaaccacagaccatcaattgcaaaatagtaaaagggactcatcgcgtaccatgatcgcaagca

SEQ ID NO: 74797 - DNA, 10199 bp, Oryza sativa
  unsure (1)..(10199): unsure at all n locations
gtattggtctgggacccgtctcgttggcatatggtgaacctgtgtcggctttcgaaatgccttgtcatgaaagccttaaggtctctagacgtggccgttttgcacgggctggatgatccgggttagtaatgtcgtgtgggtaaagtgtaccccctctgcagaggttaacaaactgttcgaacagccgtgcccacggtcatgggcggatgtgaggtgattcctagcgtagttttgtttgactactgctttgtgaaattgctgctgtggaatgggttcgatgtttggaaaatcggcggctgatgggatcagccaggcccgggtggccgtttgaaagctgttggccgggtgccaaccttgatcaattcaaagactgatatattgcacatactccgaccggacgagacgcactgcttatccgtgtcgtttgagaagcactcacttagtcgtttcaaaaaggagtttaaataaaatcaattgcaaaaacaacagccttttctttgaagcctgcattaaacacttaattcccatggcttgctgagtactcctgtactcacccttgctctatataaataatcccccccagttgctgaagaagatgatgtggcccccgctgacgaagagttcttccaggagcaagtcggctacgatgagttttagggtttcggcctagttcccaagtcgcgcctgtgatgtttggtccaagtcttggcttccgctttcccttttgtaatgcagttgtgagctcaggatctgtccgcagcccaacatgactgtactcctactctataataaagagacctctgtcgctgtgatatactgtcttcctgtgttaccagcactgtttcctgggactggtatcgattaacaggttaatttggagcgtcacgggctagttccgctcggggctagttcggggcgtgacacgttgtccctgccctcgccttgccggatccgcaaacaccgtgaaccttgacgacaccagtttgactttgaccgaacatcttataacctaaaacggaggaagtatcttgttggaaacacactgttgattctgagctgttagcgaggtcgctgagccctaatttcttccataagtatgttcctggttgacatctggccagactgtgatctgctgtttcaaaggcagggcattgcggagggcataggtcacaatggggattgtcaatccattttttcttcatcatattgccatattggcattagtgtttaatatctgtctctcaaagctaaagcacataatgtctgatgaaaggttaacagcaccattctaaaaaaaaaaaggttaacagctgatatgcattcgaggtggagcgttgtttgcaaggggacagagctctttggtcaggtgaccgtgactctgaattggggcagaaatcattcagaaacagctgcatatcttgtagctctagctgtcttggtgagaagggtttggaaatttggatgcagttgtatgtgccaagacttaatgacaaattatcatgagtcactcggagaggagtcactgagggcatgtttggttgttgcctaatgttaccccttgccacaagcccacaactcaactcgtccttgtttaacattacacaacatgtttgccatgttggtggaccactgggcccctagcctgtactactactggacttcgatagaagacgaattgacttgctgctgccgactgctagtcgaagtctttcattaaacaagtaggatttgcgagatctattgctctgaactaggtcccgtataatttccttccccaccgggagctccgtcctgcactcacgcagtcacgccgcttggtctgttgtctttgtgcatctccgttccttcgtgcttcgctgttcccaaatcccaataccagccacgccgggttagttcactgacccacccgaagcttacactgttgcagtctaaatatgttgccacttgctgtcttgccatgtgccgaaagacaacatgggtcactccagtatctagtttacttatccatagaccacagctgttgaattgtgtgatcggctactagtacatcactgctcgtgattcagtacgtacaccgcggtaactggtaaggaggattcgcatcgtcgacaatggcggctgcagcggtggctgacgaaaatgggtcgcccaagaagacgaagcagggtggcttcaagacattgccattcatactaggtgatcctcctcgtaacctcgtttacacttccatatcttggtttggttcttgatggaattttcgttcagtgcaagtactgcatctcaagtgttcgattcgtgttctaagagtacactactccgtcaatgcagcgaacgaggtgtgcgacaggttcgccacggccggattcaacgcgaacatgatcacgtacctgacacagcagctgcacctgccgctggtggaggcctcgaacctcctcaccaacttcaccggcacggcggcgttcaccccggtgctgggcgcgatcgccgccgactccttcgccggccgcttctggaccatcgccggcggcggcgtgctgtaccagatcggcatgctcggcctcgtcgtgtccgctctcgtccctgccctccgccccgcgccgtgcggcggcggcggcgccgcggccccgtgccagcgcgcggacggcgggcagctcgccatgctgtacctgtcgctgctctgcaccgcgctcgggtccggcggcatccggccgtgcgtggtggcgttcggcgccgaccagttcggcctcggcgggaggcgccccggcggcgagcagaagtggagctacttcaacctctacttcttcagcatggggctcgccgtgctgctcgccctgacggtggtggtgtacatccaggagaccgtggggtgggggtgggggttcgggatcccggccatcgccatgttcgtctccgtgctgtccttcgtcgtcgggtacccgctctacgtgaaggtgaagcccgaagggagccccttcaagcggcttgtgcaggtcgtcgtcgccgcgttcaagaagatcaaggagcccgtgccggacgacgccggcgagctctaccacaacaaggagctggacgccgccatcgccgccgacgggaggctgctccactccgaccagctcaggcaagcattttcaatgcatcgatctctgtgtccttttacatgtggttcgttgtttattttgacgcaattcaacgtgtcagagagttaataacgtatttgccccaccacgtgaaggttcttggatcgagcggcgatcgtgacggcgggggacatcgccggctccggcgagccgaacctgtggcgggtgtcgacggtgcaccgcgtggaggagctcaagtccatcgtccgcatgctgccgctgtgggcggccagcatcaccgccatcgccgccgggtcgcacaacttcaccttcgccatccagcaggcgcgcaccatggaccgccacctcgcgccgagcttccagatcccgccggcgaccatgatcatcttcaccacgctgaccatgctcgtcagcctcgcgctctacgaccgcgtcctcgtccccgtggcgcgccgctacaccggccggcggtcgggcatcacctacttccagcgcatgggcgccggcttcgcggtcgccgcgctgggcgtcctcgccggcgcgctcgtcgaggccaagcggcgcgccgcggcggccgagcacggcctgctcgacgcccccggcgccgtcgtgccggtcagcgtgttctggcttgtcccgcagtacgcgctccacggcgtgggcgacgcgctcgccacggtggggcacatggagttcctctacgaccagtcgccggagagcatgcggagctcggcggcggcgctgttctgggtcgccggctccctcggcaactacctgggcacggtgctggtcacggtggtgcagagcgccagcagaggggagtggctccaggacaacatcaacagggggaggctggactactactactggctcgtcaccttcctcttggtgctcaacctcgcctactacttcgtttgcttccatttttacaccttgaagtcgttcgaggtggacgccggagacgaggcgcaacggcggcgagatgttgccgggagtgcagaaggagagactgagctctctgctggttgtgttgttgcgtcaagaaatggggtgttgtaagctagcataattagggagtgacttattgacatcagtgaagtaatttggtcagagctatctttcttttagcgagttcatattcaatcaaatatttttctggcatacgatcagaaattatttttttccgggataaattgatacatctcgccttgatattttacttgtttatgtaaacactgatcaaacagagaaaatcctttgaggacatgggcatatacacttcttgttcttgaatatatgacacacaaaaatacgttcttctattnnnnnnnnnnnnnnnnnnnnnnnnnnnnnttatatggtgagatcaaagcataaaccatctatgtagtaaaagtgaacatattattctgttccaatccggcaaggggattgaaatgcacattctacttcaaggttcctcctttcttgccatcgccctcgttgccatttccacggtagagctcgagctcctcctcaggtttcaccgtctccaatggcttgaaggtgtagtacctgacgcagacgaagtagtagatgaggttgagcccctgcaagccgaagacgagccagtagtagctgtccagcttggctcggttgaggttgtcctgcagccactgcccgctccgctgcgtcttggcgtggatgatggtgacgagcagcgtgccgaggtagctgccgatcgacatggtgagccagtagagcgccgccgcggtgctccgcatgctctccggcgcctggtcgtagaggaactccatgcggccgacgtccatgaaggcgtcggcgacgccgtggatggcgtactgcggcaccagccagaagacgctgatgggcagcgagctacccttgggcgcgtcgagcatgccgctcgccgcggccacggacttgcggcgactctccacgaccgcggccaccgcgttggcgagcatggcaatggtcatgcccacgccggcgcgctggaggtgggtgatgccgtttgggtggcccgtgaagcggcggagcacgcggacgaggacgcggtcgtagaaggcgagggtgagcagcatggcgaggttggtgaagatgagcatggaggccggcgggatcttgaagtgcggcgtgatgtcgcggtccatggtgcgcgcctgctggatcgcgaagctgctgttgtgcgacgccgaggtcaccagcaggatgcccgccgcccagatgggcagcatgcggaggatcgacttgagctcctcgacgcggtgcaccgtcgacagccgccacagcttcggctcgccggacggcagcacgtcgccgtccgtgataatggccgccttgtcaaagaacctttgcaagaacaaacagttgattaattagcccctaatcgcatcgccagttcgccgcttgctataggagttcaacttactttagctgatcggtgtggagaagacggccggtggtggagatgccggcgtcgagcaccttgtcctcgtagaggcggcttggctccggcatgacggctttcctcttcttgaaggcggcggctgcgacctgcgccagccggaccagggggctgccggcgggaggcatcttgacgtacatcgagtagccggacacgaaggcgaccacggcggcgaacatggcgatggtgggcacgccgaggccccacccccacccgacgttctcctggatgtacacgatgacggtgacggcggtgagcttggcgagctcgatgccgaagaagtagaggttgaagaagctccacttgggccccttgcgcccgcggcgcccgcgcgcgccagcgtcgagctcgagctggtcggcgccgaacgccatgatgcaggggcgcgtgccgccggtgccgatggaggtgaagagcagcgaggcgtagagcacggcgatctgggaggacgaggcgcgctggcagtcggcggcgtgcttggcgcagggcggcgggcggagcgaggggagcgcggcggacagggtgaggaagaccatgccgagctggtagatgacggagccgaacgtgatggtccagaacctgccggcgaaggagtcggcgatgaggccgccgacgagcggggtgaggttggcggtgccgtggaagttggtcagcgtgttggaggcgtcgacgagggggaggtgcagctgcagggtcaggtacgtgatcaggttggagctgaaccccacattcgcgagccggtcgcagaagtcgttcgctgcattcggtgagggatggcgggaaatgttacaacttcaaaaattgttgagagccagttctaaaataaacacaacaatttcctcctctagtccctgtttagaaaaggagaaatttacggtttcttgagagttattaagagctaggtacaaaaaaaattattgtaaattttcgtacattgtactgtcagaggtaccaaattttacaagtatgtaaaatcactccatattcgacttaagaaattagggaaaatataagcttgcaatggactttgctcattttgacatgtttttttaacaccgttaaggcgttaagttctctctgaatgggataagggcgaacacaagtttcggttaaaaacacatgaggacaaaatcacaattgaaaacagtggtaagaataccatttcccttttgagaaatagcatttttacggtccagcaatttgtacctcctgataccggtacctgtaggtaccaaaaaaatcgaaccgttcaattttagaggagtacgatcatgaggaaaaatagcggtggaggagatggtggcgggggtggtggaggcgacaccgcgatggaggaggaggaggagatggcgaccgcggagtaggcgccggtgaaggaggtggcagccgcggcggtagcaaagcagcacttgtggaggaggtggtggcggcaagggtggcgaggcgacggaggaggcgctgacggcgaagtaggtgccgacagaggaggagctggtggtggaggagatgcggcatgacggctgggaaggagacggcgcacacctctagctctattcatccgcacgcgaaattacattcttgcccctccacctctattcaccgcgaagtaccaaatcagaggcagaagtggtacctggcggtacctaattccgtcagctgttggatctgctcgatccaacggccacgatttgataccgtcaggtactgttggatggtaaaaatcctctttgagaaaacgctatattcttttagatagctaagtttgaacctacactgcaaagtaatgcgtactgaaatttccgttccactatactttagtactcattccgtgtgaaaaaatgtctgtattttttttcgccaagccggcaaatgtttgatagaaatgtttcattgatttattaaaaagtttgtggaaaatttgctctcagtcccttgatagaaaatgcaaacctgataaactcagaattttatatatatataaagggaggtgtcgagctcgtatgtatattctatcattctcgtgtttgtttctggtgaagggtgtcatgtactcatacctaattgtcgagctctttttatattcatcacaaatatctggagattccttctcttatacagtagttaagtatagaaatggggccttttccagccctagttaaaaaaaaagtagttaagtagtaattcaaaacaagggaaactttgttacagttttagcccttcatttccctcaaaaaagttttagcccttcatatatacgatcaaaaggatatttggatatttgacaaaataggctgcttgaatttagtggtcgtgaaagctttgccatagatctgattctgattctgcacgtagcaacagtagtgatatcgtttttttacaaggtcgcaaccacatgagagctactgtttggcatttttaggacttgggctatgcgtaaagatgatccttgatgctgttcgacaggtcgggttcttgggcgtcagtccaaagaaaacgtcatttcgtttcctacaagctcatggaaccgtgcaatttgtcttcgaatgtcgttttgactagtagacaccttgtttgactacatgacctcagaattaattcctactctatgcagctgcagcctggtggtatccagctagcccaagatccccaagaacaccgagatggaattaaacaaaaatcttttggatcaatctttgccaaactactaattttaatgatctaatcattcatgttctgatgtgatcatgtgagcctgatcaagcaaagaaaagaagcagcatttgtgaagcaaagatactaaaatcagattacctaggatgaacggcatggtcctgaagcctccctgcttcggcttcttcaccgccaccacgtccacggccttctcctctcctcttccatcctccgccattgttcttctccctcctcctctgcaggtgaagcttcacagttgcagcagcctctgctttctctctctctctctctctctctctacccaggagcaatgagctttcagtagcgtgtgagaaatggagatgctttttataaaggactcgcgcgaggttgagactattggattttggagcttcagagatatggccgtgccctgaaatgtccctgggaaagaacagctccaccaccacttgatgattgagatgcgacgccattgaggctcagcatccactgcagagtagtcagaatcgaacggcatcaaatctctccactataagcaagtactaacggttttttatttctgatccatatggattatctcattacatgttgtctgatttatcgtcaatatcactttgcaaatcttgcaggaaatgcgcaatcagcatgtctaatcatttgctcaagattagtctcaactctcaagtggtgggatatgttgtgtcacatctcaccagtaactaagaggaagaggaatagaggatccttggagatctgatcataacttggtggaatgtttggcttcaacgtaaccttagaattttccaacatatttggctaaacgaaaaccaggtggctttcttgatacaggaaattataagtgaatagctctttccaaaaggcccatgtgatagccttaaagggattacgagtcaatgtatctgtggagtttatatccatagcaatagctgttttagttgcttcctcagtcttttggcccttggcctttggcttttgattgtactgtgaacaattttgtttctactgcttctaatatattcggcaagtcttttgccgcttttcgttaaaaaaaaaaggctcaactctcaagttcaactacaaccaaaggcaaagatgtttttttctttttttctttaagtaaatgtatttattttccttttgttacttttgacatcatcacatatcacaatcatactaggggcactcatagtgcaagctacccaaaatgagaaacctcaggttaaggtcacacctcctctcccagacaacccctaaggggttgtttggtttgctcctaaagtttgccaaaggttaccacacctcatgttaggcaagtttgacaaagttagtatattgtttggttcatagccacacttgtggcaagattccttcttatctatttgggccccacgtgtcatcaactcaacaaagtgtggcacaatccaattttgctagctaaggtgtggctcactttttgtaagccacaacttaggcaagtgtggcacaaatagtatggtgaatagtggcaaacttagtatagcatccaaacagccccttagctttttcccgtcatcttctattctagtcctcacatgttttcaaactacatatcatataaaatttagcactaaacaccctaaaatctaaaaactagtataaaatttctccccctccctcaatctctctgttccccaatccaccacaaatagcgaagccggcggctcctcccaactggcggctcggaaggcgacagcggcggcgtgagagctcactgggcccctccaatcctggcggtggctcgacgacgaatctggcaccgcgcgagtggcggaggggggggaggcgacgacagatccacgatgccgtggaggctatggacgccgcgatggtgtcctcggtctcgtctccacggcgtgggagcggaagatggcaacgaacttggc

SEQ ID NO: 74798 - DNA, 11649 bp, Oryza sativa
  unsure (1)..(11649): unsure at all n locations
cagcagagaggggaccacacgcactttcttttttgggcgtgaggaacccggaccctagctaggaggcgcaaaccttgcaagggcacaggacccaccttttttttcctccacatcaacattcagcaactaggtaacgctccacgtagaagcattatgaaaggcttaatggagaagtaaaatatgaccatgccctaggactacaattctcatgtgaacatgagtgatctcgcactcctgtacaattaggataacgttttttaggaaactgttttgtctgatttgttagcgttatcagcttttctttttccctaaatccttaactgatcagcgtgattacgagtgacagaaatccacaagctaccgggcgtcactaccgtcaccgtcgacggcgacggctcggcgtgcagtgagcagtgagcagtgagcagctagcgcagtggcagcaccaccactgcaggtctgcagcagatagcagagattgtgatcttttctgctggtctgctagccactctggcagaaatgagacgggacactattgctacttgcttcctctgtcagttgccggtaacttgctacatggtcctgtgcatcatgtcctgcctctaggtgccacttccggcgattgagaagaattgcaagggtcaacccctttactttaaatttgttgccgattggggtatatgtgagtgagaggcagagatatttctgctgcagtacgtaccaagtacaccctcatcccaaaataagttctttttggttgttttgtctaacacaacagataaattatcaacaatgtcttatttaaaaaatttatgaaaaaaataaaaaaataagtcacacgtaaagtaatattcatatttaatcatctaatagcaataaaaatataatcataacagttttttaaataagatgaatggtcacacgttagaaaaaaaattctataaatagacttattttggaacggaaggtatactactctctgaagcacatcttggtccagattttgaaacagattgttgagtagattattgctaccgattatctatttaattatatggataaattgaatattttgataaataaatttaacaaataacttaaaaaagtcgtttaaataatacaatagaaatttttttcttataatatatattttaaacatggagcaaataatctgtaaaacaattccgtaaataattaagtaaacctcagcttgcaaattcctctaaaattaaaccctgaacctatctcactctcaccggttctcatccactggtttcttgaacagcagaagattatactctttttttttttggttaagcacagtaaaagtgcagcaagtcagaaccgaagaaatgtctactacactgatcagttaggccggtacaatcattcaatcatgtaatggtccattgtggtacagggatagcacagttggtgtgcagtgcctcaaatattaacatgcactccaaaacggatgatcgagaggcatttgttgtcaacactagctagttgatagaagccactatatatatcctaacatcattagattcaagcggctgcgcattagcactcagtgatgctcctactggtaggcttttcgctgaattttccttctttctttctttattttttgcatatatataatatgctcatttggttacatttatagcgacagcaaaagcctggccagagaagaaaaaatcctaagaaatgcattgcttcatttaaaaaattccatggtaaaaacacgcaaaaatttccccaaacctaggcaagaacgccgccaaatgttttttttgaataacccgccaaatgtatccactacggccttgtttggtttgaagaagattgagagtaaataattctacaccataataggtataaaataaatctcctccaatctctcctcttagcaattaatcaaacatggcctataagaaaatgtgctatatatggagcaccacaggggaggatcaggagaatatttctggtgccctggaagcacaaaagcaatactctctccatctacttttgataaacatatttcaaatctgaaaaaattacttttgataggtatatttcaatccaaccacctatcctcttaatgactttctcggatttaatgagtgactctccattcttcaacataagattggctacatgggcattgagaaatgcaaatattaatgaatcacttgtttacgaagaataactaggatcatgtttaaatggatgataagtagaattacttatccttggtcattgtgccaaataaaatataactatgaaaagtagatggaaggagtaccaagtaccgtaaaaatgttcgaattaaaaaaaaagaaacattagtgtctaacccatgtattatacttcctccgtttcaaaatgtaagactttctagcattgctcatattcatttagatattaataaatctagacatatgtgtatgtttagattcattaatatttatatgtatgtgggcaatgctagaaagtcttacactgtaaaacggagggagtatatgctattgatattgatattataaatattaaattttagtcatgttgactttacgaagtttaatgacttgtaccaaatgaagagtacggtacggcaacctatttaattttaatttcaaatttcggaactaaattaataatatactaagctgagagtaaggtacggcaacatatttattaattccaaactagaaaacctagtgcatgatattcggtataatctaggttataccgagattaataggagtgtaattaggatgtactctatccataaaatgagttaaatgagtttagacaggttcatgcctcactcaagataataactctgcgttttgttgcatgtgattggaaaaatacaaatacatatgtgtgttacacgggtctacaaatatgaatccttccctgagagaatagttttggaagagtgcatgtcttattagttaaagttgtaataatattagttaaaattaaatgaaaatggagggagtatatgtatacagaaatgctaagggacagggtcccatctctgcatccacaagcgatatccttaattccggatgctagcgtcatggtggtggcaagacggcgggtgcacgatggacaagcggatttgagcgagtccttgatggcaccggagatgttagggatgtattgtaggataagggtgtggaggtggataaggttggcctcctggaagacggcgagggagatgacgcagactgagtcttgatcttttcggcgtcataacagattattagtcactgtagacatttcacgtgtctaggaagtaggaagcaaagtggtagggactacctagtgcggcgccaacggagagaaggatcaccttcaccttgttgtcatcgtggcattacagttatttcttggcaaccgtcgctgcaccggaatagggacagggactgcaaggaagaggcggaaggaggaggcagtggaaaagcaggagaaggaggttgaggaggaggcacaatggcagtggtgagttagtgacaatagtattgcgctgacaataatgatctcatttagatccagctccatcatgaagcaagtatggtacctcatagatatcaggttgatacttgagcatcatgcctaatgtcgtagggcattgatggggtaccacatttgctactaggggtgggcattcggtctaaccgaaaatttcggtctcgatcttcggtctttcggtctttgacaagtgaagaccgaatttcagcgaaaaaatatcaggaccgacaaattcagtctcggtctcggtcctgaccaaaatttaacaatattttcatatatgcaaagaaataatggaaattttcaacacaaaaatcacaaaaaaaattcgtaagcacttatgagtaaagactcttattaggttgcatgcctagaagaagtagggatgtgaaaattagagtttaatcctattaaacatagtggattgtaggttgtatttagacattttttgataattcaatctttttggtctattcggttatccgaggagaccaaccgaattgaccgaacaaaattcggtttttcactacctagggccgaattgatgaccaaatttctcggtctcgattttttcggtcttggtctcggtctttcggttcggtctttttctgcccacccatatctgctactcagctggtatgtccaaaatgggacaccgtgtaatgacagcccccatacgtataacgcatattagtttggacccgtagtatcagcaatacgtacgatgcaataccttggagggggagagttgactaccaaattaagtgacgaggccaataccagatttgacacgttttagcaaccactagactcaaccactacgagcctacgaccagtaggagcaactaacagcgagaacaagtgcgtttcccacaaccccggtgctctggaatgctggaaggtaacgattactggcttgctgtttcaaatgattctagcgcatttggttgcataggtatagctactacgtatagcaaaatcagaaggacctttctttttgttgttgttgtcagtcgcctgatcatgtaggtcatcaggaaagatgggttaagaagctccactttgttgaacatgtagctacatcataataggggatatatccggtgaaaacgagttaagtgttgaaaactcgtaaaaatcatatctaaaagttttataaattcatgaaaaaaatactacatataagtgtagatatgaaatacattctcaccaaatttcaagttcaaactcaactttatttaggagtaacaaaaaagataaattttgggtgaatagaacatgacactattcactcgaaatttgtctttttttttctcttaaacgaaattgagtttggagttgagatttgatgagaatgtatttcatatctacacctatatctagtattttttttcatgaatttacgaagcttctaggtatgattttcacgaatttgcaacacttagctcgttttcaccagatatgtcctctttctaatatactcccttcgtcttaaaaaagccaacctcatattaggatacgacacatttatttttttttatggatggagtatctctcagttttagtccgtgactttatgttgatggaagctactcccttcgctccaaaatataaaaaattttaggtggatgtgacatattatagtatgaatatgaacaaagagttagaacatataatatccaaaaaaatctcttatattttgaaatagagggagtatcaagtagtagcaacctacttggactgacagctaagaggtcaattatgatgctgatttcttgaaatttatctgcacccagagatgtgaatcgatgtagtactatctgccattcctgaaaccaaagcaactaacaataaacaaaagaactgaagaaaaaaaaaggaccaggcgtagagaaatgtgaccagaacgaacggaatcaggggaggcattaaccaaggaaatgttaaagcgtgatcttctcttagagaaaaaaaatccctgtttcatcgccgagggatctccactctccagagcttctgcttgacggattccagcaatgtcggaagaggagagcaacgacgatgccggcgagcagatgccgcagcagggcggcatcaagaccatgccgttcattctcggtgaggtgttcttcttgcaatgttgctacccattttgttcttgtggatgaatgctgaggtgagatctcagattaatttgtgcggtgcagcgaacgatttctgcgaccggttcgcgacgatcgggttcaatgccaacctgatcacgtacctgacggcggagatgcacctgccgctggtggaggcgtccaacacgctcaccaacttccacggcgcgtccaacctcacaccgatcgtcggcggcctcatcgccgactccttcgccggcaggttctggaccatcgccgcgggctcggtggcgtaccagctcggcatggtcggcctcaccgtgtcggcgctcgtgccatcgctgcgcccgccgccgtgccgcggcgaggccgtggccgtggcaggggaagcttgccagcgcgcgaccccgtggcagctgctcgtcctctacctgtctctgctctgcacgtccgtcggcaccggcggcacgcggccgtgcgtcatggcgttcggcgccgaccagttcgagctgggcaagccaccgcggcggcgacccggcgaggccggcgcgccgaggtggagcttcttcaacctctacttcttcggcgttgagctcgccaagctggtggccgtgacggcggtggtgtacatccaggagaacgtggggtgggggtgggggctcggcgtcccgaccatcgccatgctcgccgcggttaccgcgttcgtggcgggctacccgctctacgtcaagatggctcccggtggcagcccgctgacgcggctggcccaggtcgccgtcgcggctttccggaagagaaacgtggccgtgccggacgatcctggcctccttcacgacgacaaggagctcgacgccggcgtctccaccaccggccggctgctccacaccaaccagctcacgtaggtccccgtgtttcacatcaactctccaactctaaattatctatgcatgtgtgtgatttatctttttaagattttttgaccgggctgcggttgtcactgacggcgacatggagggaggcggcggcgcacggccgtggcggctgtcgacggtgcaccgggtggaggagctcaagtcgatcatccgcatgctgcccatctgggccgcggggatcctgctggtcacgtcggcctcgcacaaccacagcttcgccatccagcaggcgcgcaccatggaccggcgcgtcacggcgagcctggagataccgccggcgtccatgctgatcttctccaacgtcgccatgctcgctaccctggcgctctacgaccgcgcgctggtgccccggctgcgccgcctcacggggcaccccgccgggatcacgcacctccagcgcacgggcgtcggcctcgccatcagcgccgtgagcaacgccgtggcggcggccgtcgaggggaggaggcggcgcgccgcggcgagccacggcctcctcgacgagcccggcgccaccgtgccgatgagcgtgctctggatggcgccgcagtacgccatccacggcgcggccgacgcgttcatggacgtcggccgcatggagttcctgtacgaccaggcgcccgagggcatgcggagcacggcggcggcgctgtactggctgaccatgtcggcggggagctacatgagcacgctgctggtgacggcggtgcacgagaggaccagaggcgaaggggagtggctccaggacaacctcaaccgggggaggctggaccgctactactggctcgtggtgacgctgcaggtgatcaacgtcgtctacttcgtcatctgcgccaagctgtacacctacaagaagctagaaacagtcgatggagtgagcacaggggagagaaatgacatagttgatgatcaggagaatgcaggggagagagatgagaaaggaagcgatgtaaaagatgtagagcttcagcctctgctactatcggatgtaacgctcccatagagatgtttttagagattttgggggtgtgttttttttcactgggaggcaactgttagtgccgagctccccctctctcagccgtcgtgctccatgttaggtttaatgaaactaatttaatattttaggtgtcgctaaatttttctataaacatagtcaaatttaacaaagtttcaaacgacttataatattaaacaaagggagtacattataagatgaagatggttgcaattagttctccgtagaaaatcaaatggggaaaacaagtacccactaggtttagcgggggcagcaatgaccgtctcctggtaacccacgaagacccatgtccaaatacaaattattaaattcttgaggtccaatcgacctatgattagtggataaatgataatcttgtgttcttgtcacgtggattatatatattgatatgtcgatttaatgtgtggatggtatgtattgcatcatatatgcgatttgagatgtagatattgttttaagtggagaactggagatgatggatcacgggatcaattcccgcacgggatggtgatagaaaaattgttccccgttataattggcagggacggaatgggaatgtatttccggaagagatcatctgtagttgatgcaccgtgcctttgtcactgacatgtggaaggatcctgatccgccacgacacctttgtctcgctgttgacactggccatcgctagccggccgtctttgtcaacactatcacatacaccctccgtcaaaagagagagagagagagtaatttctgacgaatatggaaacaacctatgtctagatttgtaactagaaattttttttttcatgagatggagaaagtagatgcaagtatgtactattttcaccttctcataaagaaaagtttattttctactccataccagtaaaaatatatgcataaaaacaagtatatcctcttatgttggaggtcctttgcttacccaatagtatatcactacactcgtttccttccattaaataataggggctttcagcgccagtttttatatattgaagacagaattctggtcaatcaaaatgcagtaaaattcggaacttactcatcaatgtaaatatgtaataagatgatgactgacaattattaaacaaaaactgaacgatcgaagcctacctcggatgggaacggcccaggatagtcaagatatatcaggttgatgcctacctcagataaaaccatgtacactattgccagcattatattagaagtccggatgatcacaggttattttttaataatatgaaccagatcctgctaactatataaaaatatgttagcaatcatttctcattgtagatacagaggtttgcattagtatagctgagttccaaaagggcgcgtattgttaatttctaaccatatatatctacctcgcgaaaatataaagaagactgcagatgaaactgggggatgaggtatctgtaaagtgcaatcgaactggctgagaaatgtagaagatcaagaaaaatatttattcgtaaagaagcactcgagacattcacataaaatttgtgggcagcattattgaataatctacaagattaaaatgccgtcctctaagttaattattatattgttattcctagcctagaaatttcactagtttattacatagcgacatggtatagactcctattatcctatagcacctttgatgtcatttacatagtacatactcgctcaatattttctatgactgcactcattacaacttctctacataaggagttttcctaggcaatttgctaccacggtgaatttatctttcaatatctgatacctacaatcaactaattacgcatccatactcaatattttacgaagcctttttggttttgtgctttgccaagagttgactctatatcgccatggaatagagaaagctgtttggctaaagcaaaaccacaatacataccatccacagaagcacttaatataccccctgcatagccagcaccttccccaataggatacagccctgcagtgatgtgctctcatatgtaccggtatttcgtgaaatttgcaatggggagcttgttcttgtctggaaacaggtagaaaattgcaataaataaaataaaagtaaatcgtagttgaaaagatagaattatagttaaaaggtaggtgacatgaatagaagtccaaagaaacggtgaaggattggagtgctttctaagaaattatcttgtgcattgaacagttcaacaggtcatcagggtgtgaagggcgacaacacagtagaagagactcggtataattaatttctcatgcagcagatactgcacaacttaggaaagaaaaggggaaccctacatgactatggtttacacaaaacagtgaacatggaaagaaactgaatgtactccatacaggaaatgttttccgtttaaggggttattaattctaagagcaatgtagcaacaggaaaagaaaaacgtaggtacagtcatagcgaatatggagaagaaatgataactgataaggacatcaatgttaaatatagctcagggatagagataaatgcgataactgaagtcacaagagaaggttcagtggaaggtggatgcagctcaataagaggtatctttacaatggcaataagtataggtcagggatttaggggtgaattcagtaggttaaagcctagaaccctgggaaaggttgttaggtcaaaaaaaatgggtgattatttcaaagtagagaaatcagagcatccagggagacccacgaaccagcattgacctctttagggaaagttggaagctaaaaaaatcaatgttcccaatctcataaagtgtggattttattgccttgccttgccaggcttttttccatttcataaactatgatataatggctttaccgccttaagtttgcccaaataaattaactaagaagaaggattcagtgtgtaggctagatccaaagagattggctgtaaatcataagcgacaaatttgtanacatatgggcacgttgctttgagattaagtaatgctaccgtccaatgctcaggcattggtgggattggagtcattggactaacactagactctttgatgttaaacaattggtttcaggatttaatgaatgaaccacaataaattctatggaaatagactgatgaaaaatttcgagcttgcatatgaatttgcatacctcgacaccatgaagtaatcctcactagatacaaatcctggcatctgaaaatattgggttgcaatgtcagagagatggtatttaaaaccacagaagaagaaaaaatagtgtgtgtcaaacctcttcctcaatcattattattgattgttgtagaacttcagttatgtgcgaagggaatagctcatggagtttggatggccgaactcccagcctatagcttgatggtgggagagttgtaactggaacagataataaagttaattaataagaagaaaagtatatactccgtatctttaccacctaataaaatcttagtacctgacaatctgttactgagaaaatctgtgacacactgtgcaggaacaacgaaattccctccccccatggtagctgctcttctttcaaattctctctgtttccatgaacatatacttgttaaatttgcatttttggaattgaacactaaagcaaggaaggaagaacatgagggaaatactacttaaaatggaattttatcttacatacaagaggagtattgtctttgcccattaacaaaagaggtttaggcaaaaggcagcacatggcatcccacattcatgagcaaatggattgcaggcacatgtgcacacagcatagtgatgactgacgcaagcgacaatctctaccatgctgcgtatccaatctatttgtcatactccctccgtcccaaaatgtatgatatcgttgacttttcgcataaagtttgaccatttgtcttattcaaaaaattatataaatatcatttattttgttgtgacttgttttatcatcaaagaaactataatcttaacttatactttttcac

SEQ ID NO: 74799 - DNA, 18651 bp, Oryza sativa
ctggccctagggataaaattttctttttttatatattttctctatatttgaatttgaaataatcaaataatggttatgatcttcaacatcaatttaccgcagtgccacaatttcgggatatcctataacaaattccacaaaatttaagcattttgtagcaaattttatcaatatatagtgttgtaaactttaattaagatcttttatgctttgatttgctttataattcttacatgaatccgtttagtagaccgtatttattgtacgtgagttcgatggtagattcgatgttgattcgctttataacttcgtttgattgaaattggaacgatgcgacggaaaagttaaagtttgtatgtgtatgaaattttgatgtgatgaaaaagttaaaagtttaaagaaaaagttggtaactaaaccagcccttgatcaatatgatgaaaacattcaggaactttgaccagcattaactcgagctgacgagaatatacattccggaattctcaccattggttttgcccgcgtgaattgtcttcactgctcagtaattgcgctgctcgagcgcgaccaatggcctcacgaaaactccaggtggttcggccacggaaccagagtatggaactgattgcgtccttggcacgaaggcgaattttcaccgcgattttctccatttgtctgactcgtacaacctttcacctcctctttttcaccctttacccaagcaagaagttggtaaaaagaagggcaggtcacaaaagaatgaggagagcaagaaaacaaaaaaagagttcccatctcatctgcaccactactgtgtgacagcagcagcagccagccaagaagagagaagagcacattgcattattgcttttcctgcaacaactggggcaacaaaaagccacttggtactttgcttatttttatccacccaatctacttttgctccttttctcgcaaaaagcccccttgcacctctcccctcccctctctgtccggctccttgtgctctgcagaaaggccagttccgctgctagttctgggatgcggaaaaggcgaccgcatccagccgcagcatggacagatagctgtaggatctcatgcgccgcggcggcagcggcagcggcagctcgccgttgcgattgcgctgagctcaacgatccctcaacacgccggccggtgcgcttggcgcagggggaatgtgcagctgctgttgctgccgaaaagctagcgatccgatgcttttgtgtgtgtgtgtgtgttatccgacggacgaggacaaaagacaccgggcatctcggcggcgacggacgggctcagctcggcatctgatgcctcttctgatgttgatggggggttttcaggtaagctggtgggtttggttttcctttttttagttcttatgcaagtgggattttgatcgaattgcttttctggtgccttttgtgacaggaattttgtactctggtagttacattcaagaagcatacgcgcttcaccgcacacgtgcaacacacaagcacatccgtgagggtgaccttaacacattattactcaaaaacaatggagagaccgatagttgatcaaacattcgcacactcacatctccccgctcatccacgcgcaggtgacacggggaaaaaccctagccgccggccaccccctctcctctccgccgcaccgccgccggagcacgccactacaaaagctaagcgatatgctgggaagacagcggcatggctaaaacctggcgaggctaggtctccagcgtaggggagacaaagtgaaactggccacgacgtgcccccgataagggtggccgcgaatccaatgccggctccaccggatctagtctcctcgcagctgaatctaccccccgtgcgagattctaggtttagggtcccctccctaaattatggtttagggtcctaggttgggtgggggtggaaggaaggggaagagatggggacatcgctgaccttagaggggtagtcatgggaggcggtggccttatagtaggtggtagacacgggaggatggtgaggtgccaacacggcgttagagccatggggatgaaggatgatggtgggccagtgttgacggcaaggcaaagcgaagcttgtggttagtagacagcggccgacaatggaagatccggcaatagtgagaaaccgaagatgaggaagacgacaggaggtgggctcctcaccatcggtggcttcaggatgaggagagggaggaagggggtcttctctggtgctgttcgtgccttctagccaactggcaagaccgggcaatggggcggcagcagcgtagggcacgagaggagagagcgtcgtgcaatgggggtgggtatgaaggagggaggagaagagcgagggggttaccgggggagaggagtgtgcacgaaggcggcggggaaaacacgtcgacagcagagcttctcctcggcatgggaggcaaagcggcgtacgcacggcgggagacagcggccgaagcggacagcgggtagatccgcccacgccggaggctgatccggcctctcggtggtggatctagcccccagcggctagatcgggataggccgagctcgcggtggcggtggcgctactcgagctcgtggcagcggcggcgcgactcgaagctcgcggcggcagaggcgcagcccgggaggcatgggccagcggaggatgctctggcagcggcggagctcgtggcgatggtggcgacagcgggcagccggcgggccggtcggcgacgatggagaccggtgaggcgcaaggaggcgcgaccgatggtggtggaagccgacacggtacggccggtggcggtggaggcggccgtggtggaggctcgggcgaggcgtgtgccggtgcggtatgatgaggctggtcggcgtggtgcgaggaagtgcagccggcgacggcggtggccgacgcagcgggaggcgaggccggtattggcgaagcccgatgaggcgcggccggtggcagcacacaaaggctggccggggggggagggcgtcgatgcagtggcgcccacgcaccggcggaggtttaaatggcggtggagcaatgatacatcagtggtagataggcaggtggtggacggcgggtgaacccagcccggccttggctgggccgacaacgatggtgttcgagtgtcactcccctcctgagagcgttgttgtgccgtctcaccccctctaacgtggctatcgggtgaaaactcagtctcggttgtccttgagaccttgacgaacggcggcatcgatgctttcatcgcttctctccttggagacgtcgtctagacatcccattgccagaacctcccaagcaattggtgcaagctcgctctagattcatatcctcttgtgttagcgtcctagcttctgtaagttagccacgttggaaggcctaggggggacagcagtgtcattctactctctcaccctctctccctctatcccaaagatttggatagagtgggattttgtgtcggttgtaagggtcgggttttgggaaatctcggttgtgtttttttgttggcctagcggcggtcggtcacacttagtggcggccagtccggtgctagctttctactgggtcggtgtgtggatggtggtatactttttttttcccttataacctctcagggttataatcttgtaatttttttctgctctataaatagaacttcgttaaaaaaaagatttggccaggtgttttatatccattgtcaaatagacagtcctgaagactaatgcctattgtcgagtgtatgtagcaatttcgtgtttgcaccacacttttccttatagcaatttcgaggggagtataaggtatgagtagcgtggttggtaggaggtgaattcggtgctttgggaggattgtacattcaaccacaaccaggattacatgcttgggtaaattaagcctgggaagttaacacctgaacccttttaggctacaacagatgaactgattaggacttaggagtatacgaaattgctgaattgagacctgatcaacttgtcagtaccgaaattagagatgaggcccgtctttcccggcgatctttattccgagagctccatgtttggccaaaagtggcaaaatcacccaaggaagaaaattagttttgggacctaacaagtggcactatatcaacctaattgcactaggtttggtaatgacacaatccaattgcaaagccatgtggtgaaaatatcttattcggcaaattgtcatctggtctttattagtaacagcagcaaccaaatttatttctccttaattattttccatctaacgcatcagagggtaaattaatcagtgatcttcgtggttgtgtttcgctgatctaatactacatccgttttgtccgtaatgaatataaaaccttcattagcttttttttagtgataaaacacgtgtctgtcaaggtccactactagctgccactactattctattgtgctgtcaccgctattcacacgttaaacttctgtacttaacgtgtttgaactgattttgttgcgaagaaacttctctatcagggaaacttcagcagaaataaatttgttcggtatagattgcttctacttgcgagctaagataatggagttaaacatggttgaaacataccaagcaatttcattttaaggcagaatttaatattggtcctgttggaatcgtgagtcagaatgagccatttatattactgtataaatattctgatcctttttctcattggactcatgaaagacttcgtaatatgtggagcatcaaaatggtgccttccttggaagccatagctttcccagaattaaattaaatatatttctgaaagttagtattcctacaagtttgggctggtcagctgcactttacaacaaaaacggtcagaaaaatgtttatatcattcccgtttttcctctaaaatagatttttttttgagaaacacagtaaaaacgcagacgctcacaacgtgcgcacactcacccctataaacgcacacacgcacaccctacccctataagcacctccggaagactgggctggcatatcttgagattgacgaagtcaccacaggcgtctcgctgtcgacgggtatgtcgcctatcactgaaagaataattagccgtaaatgcgagcacctgtgtcaaatctaggatttgaatccgggtatcggtactattgggttattagaaaatattgaaaataaaattatcgaaatagagcctcagaaacaatatcgtaggagtaaggagtattagtgaatattccaagcagtttgatttgcatacttaataacggtactgtagcatcaacgatgacaacacctattttttaaccaatggttatgtttttcatattttgatgggtaatcagtaatttgttccaacatttcacatgaagacgatataccaattaaatggcccgaaaaatcagtatatcattttcggaccaagtaaaatcagaacggaattgcgacagaacttgcgacagtaatcagaataaaacgaccggtacaaaacggaagcgatattcatatcgttttcatcccaagtgcagcagttcagagctcctttggctcggtaagcggcgccggtgcagccaaacggccccactcatagtacttaattacgcttaagtaggcttaagtacgaattattgtaggtaaatcaggcttattaagcaggcctgtactacagaaagatggtttactaaagcgcaaataatgagtgagcatttaattgcggaaaatccaggcaggcgagagcgagaggattcatggatctcccgaccaatgtaccctgattctcctctgatgatagccagcccagccagccagcgagccagccggatctcgcaacccccagaactagacgcaagtacacgagcgagatatcaccaacagcatgtgccactgccaagtgccagccaccatcatcacacacccaaataaaaaaaaactaaaaataaaaaaaataaaaagggaaatcgcatttatcgcctctgcagataaacattgccggttgtcccagcacagggggagaaggggagagagagggggagagaacgtcaggcatgtgggccccacacctcggggggtggtgggcccggatcagtgacgccgggcgtggtggggccagcggcagatgagatcagaatctgggtttgtccttttctcggctcttcgctgcgggcctgacgcgcgcgcgtgggagtagtatctgcttggatcggagccccccaagccgttagctgtcaaggtggggtgtggggtagtggagagaggagaaaagcgggggaggggatctgatcgtcgcaggagcgcagggtgcagcggcagcgccactcaaccagcgggagcggctgctgctgctgggcttttgctcctcgcttgagcatggttggggggaggaggaccacaccatggtgtgccatcgtcgccctgtgcggcctgtgtagtgtgtgtactactgtagtactgtcttcctcgcactattttgtgtgtgggggcctgtggggaggggttgatgatatcgaatgtcctgacgtgtcccccctccctccctgtccatatcgtggctacccttcatatcccaaaataaatcaatttaaataaaaataagatattatacggtataatgaatttatacatactcttatctagatttatggtaatatgttacgttatatcccaagtaagattagcttagaacgaaagaagtagatctttttttcccgtgtttgtgttagacactcttcatcataaaataaaccaacatgatgtgatattgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccttagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggattgattttcggatccagaaggatcagagagggagagagtaagagctctctggttctccagctcttttgtagcttcttcatacatagatccacaaaaacacaggagtagggtattacgcttctcagcggcctgaacctgtatacatcgcccgtgtcttgtgtgcttccattctcgcgaaccttccacacacagactaggagcttagaatctcacccagggcccccggccgaaccggcaaaggggggcctgcgcggtctcccggtgaggagccccacgctccgtcatctggcgcgccaagtagggggctctgcgagtgatcttctgagctctcgcactctttcgtgtgcgccaagcttttcctgttcagcccaatggccgaacaagcaaaggcgcacaacctctcttcgagcgttagtggtgacgaaggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgtgctcctacgtcacccgcccattgtccctgacccggagtctccagcccaacgttggctggacgacgtggccaacttggtcatgacggcacggcagcgcctaggtgctggtgggcggtcctccgccaccaagacccctggcgctgctaccaccggctccgtgttgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcagacagggcggcgtgacaggaggaggaagaagaggtcagcctataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccctggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacatccgcccccgccgccccgaggcagcggatagtcacatacgacgaggtcccggtcaaggaggttgccctaggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggaaccttaccccctgcctcgcatagatcagattgtcgactccatagcggggtgcgacctcttgtgttttctagatgcatactctggttaccatcagattcgcatggctagggaggatgaggaaaaaactgcattcattaccccgataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagctgaacggtggcccaaggcccccgacgaccggagcaggccctctgcccgcttgtcagacggtgccaggtgcccccgacccccaggacggccccgaggccactgcgggaaggccgcacctatcgccctctgaccccgaggctaaccctgtgccgattcgacccaggagagagcagggagaagaagcccccgagccgaacgatggcctaaggcccctgacgaccggagttggccctttgcccgcttgtccgacgacgccaggagcccccgacccccaggacggccccgaggccactgtgggaaggccgcccctgtcgtcctccgatcccgaggtcgtcggcacagaagacgagtgcgccccgcaaggccgcttgggtgaagagcgccccagggatgcggcccctagcgaagaggatcggccccaccgaaaggtgcagcggcccgtctactttgttagtgaggccctccgggatgcaaagacccgataccctcaggcccagaaaatgctttacgctattctgatggcctcgaggaaactgcgccattatttccaggcgcatcgggttacggtggttacgtcttaccccctcggccaaatcttgcataatcgagagagtactggacgggtggtgaaatgggcaatcgaactttctgagttcgatttgcactttcaaccacgccacgctatcaagagccaggccctcgccgactttgtggcagagtggaccccggctcccgagcccgtctcagtccccgaagccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgacttccagctggtcgttaaccaggtctgtaaggagtaccggtgctctgacccgcagatggacgcttacgttcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgacccgataggggagacggacgcgcctgacagacccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcggggacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccgtgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccacacttaaattcattaagggcatcacaacccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagacgccttaaaaccaagaccttcaatatcctcaagaagcacggcgattcgtggattgaggagttgccagcggtgctctgggcgaaccgaaccacgccaagccgagcaaccggggaaacgcctttcttcctcgtctacggcgcggaagcggttctcccatccgagatcaccctgaggtcccctcgggccaccatgtactgcgaggctgatcaagatcagcttcgcagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggcccggggcaaccccgcacccccctcgggtgtgcagggttggccgggggctaccacatatgcatattcttatttctcttatatctgtatttcaataaaagcattttcgatttcctaaaggctgtatctgtgctgttgtttccttttaaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaagaaccgcggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccaggtcgccagcctcgtcgccactatcgcccactccgtcgtcatcgtcctcctcgtcggagttgagggcgaacgcgagccgaggggccgaaccctcgaagctgtggacgatatggtcggcggcatcccaaacctgcgcgcgcgcgccatcctcggtctcgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctacagatcagcgatggtgtgttcggcagctgcgaggcgggcgattaagtcgctttcgcccgcggccgccccgccgctgcgcgccctcgcgtccagctccttctcccgcgcctcgagctcagcggcccgctggttcagcgcggccctctcagcgcgggcaccttccagattacggcgcgcttgttcctcttgcgcagcctcgcggagggacaggctgtccgccagccgttgcgccgcggcctcggcctcatcaagagctcgctcccgctcggtgagcgcgtcctcgcggaggcggagcgcggactcttcttcggcacaggcggcttcgtgcaccgccagtgtgacctcccgaatagcaacggcggccttgcgatccgccaggtccctctccacggcgctggcacgctcttccagcgccatggcacgggcctcaagggtttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcaagctccgcccgctctgcttgcaaggcctccacctgggcacttaacccgtccaacaccgtggtgtttgcaacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggccttctcggcttcccgaaggcgatccgcggcttctcgccggtcagattcccgcctctgggcctctgtggtcgccgggtcctcggcctcagactgaccggacttggaatggcgggagggacgcgacgggatctcgcagaaaacagaagaaagaccagaagacaaacaagatggatgagtgaaaactcgcgttgagggaatgaatacggccacgatgggcgtgggacgaacctgcgagggggtcggttaaccgaccaccttggaggggaaatgaggtttccccgggatggttctgtccctcccatcttgcggagccgtttcttcttccgctccccctcgggctgcgacgtcggcgtggccccctccgggcgcctgctgccggcacgcgccgccccgccccctcggggaggagatgggggaggggttccttcctgcttcctcttctcccgggcgtcggcagggtggccgctccccgggcccccgtcgcggggcccagaagcacgaccccctcccggggtagattgttcccccctgcggctcccgcccgcgccatcatggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatttgaccccccggtgggtcctcatacagtcctcggacccggtgtactcccaggcaccccgggcgcgccgctggagtggcgcgatccggcgacgaagatagtcaccgtacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggcccccgcggctggaagtagcagccaccaaccaccgacggcggcgacaccgactgtattgtgaagaaccaccggaacagccgaagggatgggcgcaccccgatgaacatctcgcacaggtgcgcgaagatggccaatgtcattaccgcgttgggggtgaggtgcgccatctggagatcgtaaaacttcagaacatccatgaagaaagaagaaaatggcggaaccagccctgccattgcaaaagggaggaagaagacggaccgccccgggtagcatggcgccgggtgtccctcgcccagcgtaactatctcccggccggtggcagattccggcatgaagcggcgcggcagcccgccctgcctctcgctcacgatgcgggaaggcggcagcacgctaccatcaagcaaagcggagccccgtgccatgacgccggaggaagagatgtttaagagcgagcacgtgtggcgaaggtagggcacaggaaacaaggagttagggcgcaagcggcgaagacaaggggaataatggcgagaggaaggaagcaaatctcttcctcggcgactttatacccttgccaacgctgtgcccagctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgtccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcgg

SEQ ID NO: 74800 - DNA, 13835 bp, Oryza sativa
gattttcggatccagaaggatcagagagggagagagtaagagctctctggttctccagctcttttgtagcttcttcatacatagatccataaaaacacaggagtagggtattacgcttctcagcggcccgaacctgtatacatcgcccgtgtcttgtgtgcttccattctcgcgaaccttccacacacagactaggagcttagaatctcacccagggcccccggccgaaccggtaaaggggggcctgcgtggtctcccggtgaggagccccacgctccgtcagatatctattcagattttattttaccgctagtatgtgtcacattttatgctaggtttgtttatggctcgaatcttttcgtattcgtgaaaatcgagcatctttttaagtttcagcagttttgtaaaccccaattgtatgatgcttaattttgcctatgcatatccttttcttagccatgacataagaatttgtttttctatctaacaaaacggtagtcacatatagcttggacaaaattaaccaagaaatcgagcatttggtatgcggcatcgtactaatagaggaaaggggagtgaattcgatctgaagtcaagtctgaaccgcgcgattgtgacagcatcatgccacagtatccgcatcaagtacagtacaccaatcaaggctcctatcggatggcctaatcagccaaagaaaaagccaaattttaaattttcaaacttaattttaagattgattttaagatattttcaacgtagtttcttttacaacattggcttttaaatcaccaagaacacatttataaaagtttcatctacaaatttatttttatttactaataagccggcttattaggaaataagccaaacaatgggacccaattgaaaccgagccccctccgcgatcacgccttgtcggcgccgaaagaatcatttacgactggccctgcaggccccagctgcagtagtagctgcgactttgatccgtgcgaaacatgtgaccgaatactgatgtgtcgcgcaccggatgctcgctcggtcaccctccgggagccaagccagcaactcggacatggacacgggcacacggcgctggtggattggttgaaagcgagagttggggtcgtgctatgtgcgtacgcgtgtgatgcgtcgtaggggaggcgctgcttgtcgaatcggcggtcggtcggtcgaatcggcgtatacgtgtttatcgtctcacgcgcatgcgtcgtcgatcggtccgatggtcggaacagtggtgatgcatcgctttctgctgggatatcgaaaagagggttccgtagagccgtatagccaggtaggtggccggcgatccggaaagggattgcgtacctgagatcgagtgtctaacgctcggagggcaaaatgagtagttgcatacttgcattggctcgagtatatactgctttctccattctaaattgatttatatataattttttttaagattatttctaaatgatctacatatttatttttatttattagagtctattcgttatttgtgcattggagtaaataaacattgattcatacatccatacacataagtatttataacccacatgcaatatcttgatttgctattgactagaaaatattgggatgatgcattcattgagtttgttgctagagtaaatatagtatgagagttattagcttttcttggtattggtgtacttatgaaatatgtagatcaatttggaatggatggagtatatagcataaaacgacactggaggtagtaaatagtgacagacgtacaggttctgattttttttttttgaagactacaggttcggaattggattggctgtgttcgtttcaacccactcccaacccctctctctcgttttccgagcgcacacttttcaaagtgcgaaatggtgtgtttttttaaaaaagtttctatacgaaagttacttaaaaatttaaattaatctatttttgaaaaaatagataatacttaattaatcacgcgctaatgaaccgctccgttttccgtgcgaggagatgagttcccaaccccaggaagcgcgcactctgcggctctccgctgtctggtccagtagctaagcccaacctgatcaatttttggtgggcattggcccagcatgagtccaaaaacagcccaaggttggggagaggaatcgtaaataaactctaaattctataaactgtaacccttgtcagctcatctgaacatcgaagtttagataaagatggcatacgatgaattgaaagaacgaaatgtcgaattatgcagtgatttttgtggcaggatgaattttctctgaacagcatcctgagcgattctcttttcttctaaaataacagtaggatcttgcagctttttcaaaaacaaatcctggcaatagtttattgtggggaagcaaatcaattaccctggcaaattttaaaacgtcaggtcgtttacggtttcggtccactaccgtctaccgtgcttggaagctgaatcagtgcatatgttcgaactgatacgcagactagtactattgtttgtaaattagtgcacaataacgtctcatcgaaataggaattcttatacagctatcttttgacgctacacggaagttcgacgctgggaaagtttgactacaaatggactcaacatatgacaacacaacatagcaagttttaacaaacttggcgcattccagcaagtaggatctctcagccatggttgaaggactggtaaaccggaacctgcaaaagtaacatcacatccagcgcttagcaactccaaaaatatattaccaagtcccgtaaggaaccaactaaatgacccactattggcataaccacagtaaaatcatagtgtacgatttgtatgcaaaaataagtaaataaccaaatcagacctaaacaacggaaaaccttacatcaggctaacttcattgaaaatatcacgactcattcatattcttttggggtctatgcaagcaatggaccatacccaggtactaaccaccgagaatggcaatagtagaaatgatcatgtattgatttctaaccttttgtatattgtatagctggaaacatcttttaactatacaaaaggttagcctaccgaatttgggccactaatgctagattttaaaaactctaatccacatagactagatacaacacacgctataatgtgtacaataattgcacaaatgtactgactttatgatatgaaaggtcaaaacccagtgaatggctcacctgagaaatcatatgcccaagattgtcatagcaatgggggtatatcattgctggagttggccactgtgggtagacagcagttccagaagaggagcccatagataaatcgggttggccaaagtacacagaaggttggtttcttgacatattagcagactgcataaaaccaacaccatactgcataaactgtggcacaacaaaattgaagccaccaggactcacattgaagtcgtgcactgggcccctaacatacctgcaaaaagtttacatgttacttcttagtaatctcatcattgaaatccagtagttgaagcagaatttgaaaggtgcaactaacctcttgtagttacgatcatagtcaggatcactacgatccttttcagtgtccttaaaaacagcaactctggaacggctgttcattgtgttcaccttattctcatcaacaggaggctcaacattaattggttcatctctcgcaacagataaagctcccaaatcacttgtgccttcaatatcagaaatggaaccgttgaaaatgcgtgctcgtgctttgttgtattcctctatcctctcttcaacagttcttgctgcattgttcttggcaccggcatcacctgcaccattttggaaagccttgggccttggacaaataacaaacttaagcttctctgcagcttcatgctcatttcttgcttgtttgctgggaacttctgacaatgcaataactggaagtttgctttcagatgttttctttgcaactatcttgctaactgaaccatctactaagctatctgctactgtagtctctaaaccatagtgttgtgcaacacgatgagcagcacagcggagataagaagttggaaaatgctggaattcgaattcatgcagttgaggattctgcataaatttctgtatatccattgccatacgcaaaactgcagttaagtagaatatgatagtgagttatgtaatcagaaagaaaattcaaataaaaatacattattgatgaactggatcacaaaaaagaggcttaattcaggtgaaagattcacaattcaaagtcgtggaggttttttgagtttagtgcatagagaaataatatgacagcactagcacaaaatgtagttcgatgcagaaaaaataaacagcactgaaagatgcaaagacaggatgtgtcgcctaggcaacataatccagggtttgctttaatccatcatccataagaacttgaaaagaaaggaaaaaagaagataaaaaagaaaaatagctgcaagtgaaaggagctcagctcatactcatcctctcatggagatactgaaatgagactcaccaatcaccatcctccctcactgtagctttgttcttatgtgtaccattcatatcaacaagaatggctctatcggtgtcatatcaacaagaatggctctatcggtgtcagctatagactaagcagattaatccaaacaaaaatgttcacaatgcattgagctcaactactcaacatacagtattttcatccagctctagctgttatttcaacatagtagttttgagaatagaggacagaaaccacatggaaattcctccaagaaataaacatattgttctggtataaccttacaagttaatagcatggcactaaaaagttatgatgcctataattgattcatgttccccaatcaatttctcaagaactttaacaggttcaaatagtatgtgactaaaattcgacatggagtttccagcacagtgagatgttcaatatcaacttcaatatgttacctaatttctaaaaacaataacctaagttcaacatcagtccattatttattgataagtccattcccctaccacaaacaattagcaataacatccacacgtttacaaatatatcagcgacaatgaagctaactccttacatggctctgtcaccaaacaaagttatagcaagctgcaacaaggaatgtgctgcaagcttaagaggtagacagattgctggaatccaacccaatttcgcacggatttttagcaaatcaactgtaccaccgccctctcctagctacctcgaaccagagggaaacctagtccccaaattgcacacctagaatacgccgggaccaaaactctagcgacagccggcacaaatccgagcctaatccgaccgcgaccaaacgaattcgccgcacgagcacacccaaaccctagccgcgggcagagagctaagatgagaggcagcggttacgtacccatgaggcggtggcgagggttgtcgagcgcctcgacgaggaagggatccacgtgcgaggtgaccctcccgtcctccgcggcggcgggcggcggcggcgggggcgaggcggcgccggagctcatcgtgcggcggcggcgggtggtggtggtggtaggggggagggggggcggcggacagagagagagagagggagggggggaagctgggcggccgggtcgcctgcctctctcccttccttcccctctcctccgcttcccgatcccgaagcggctgcggcctcctgcggacggagagagaggaagaggcgtagcccgagggaaaacgagagagaaaaaaaaaaagataggtccgcagcggcagcacggctcctgatttttgacgcccgcgaggtgccgtttgattcaggatcggtgtcggggtcgcgtggaacggctgtgaccgttcgagtcggatccgacgatcggaaataaggtttggggccttgggttgggggttcgatttttatgcgcacgatattgtagatttgtagtacttggggtcctattcagtctgaacaggattaggattgtgctacgctgtttttatctacttctggagagctctcaatgccacatttttattgtaacttgtagtagttgctacgtggagaattcgtatacaatcaaaacaggattacattgtttatctacctttagaaagctctcaaggtaaaactttttaattgtaacttggatcattgctacatggagtactcgcatatcgttttaaagtcacgaatttcaaatggtaccaagagaagaaatacgtatataatgtgacatatgtaagttcttcacgaattacaaattctacataagttcttcacataaactttcaactacatattgcaaaagactagtataaagtgacatatgtaatattacaattatatgtatatacgctattagtctagaagcctgcgcctctgtaatatttgtaatttatagagtagaggcttatgcatatatgcgaacatgtatttcgtttttgtgtgaggcgtagtgtgtgatgtgtcctttccattttaaataaagctagcgagaaaaaaaatattaagctagaaaattcgtatgttatgtcgtggaagattatgtgtatccgtaaaacataatgtttatcaggatatatcgatctctgtcggtcgctctgagaaaatgtgagaaatgatccaaatatataaaatcgaaatggccctatcgcgcgatgtgtctcaaagccgttcgatcatgcgccgtgccgtggcatccatccgtgtggggcttcgcaggtgtggctttgttgtgaaggatctacaccaccactctgaccacaccttgcaatctcgcacgagatccccgttcactgtttgaaatcgagagtcgcacaagagagcgagatgcggaggctgcagtttctccccaaatccattgatagcaacaacaaccactgatttcaagaaaattataaatgatccccttttggtccgtgatttcaactggtttcagctccacatttagagattttcggacagattttaagattttatcatatgacctaaataaatcgactgaaaccctaacccgccgtcggccaaaaccctagctccccaaggtgccatcatcagcatcgtcatcctcgcagccatcaactagggttgagggcagcggatccgcccctcccgaggacaacgttgctggatccgccgccattgagctccaccgtcaccacccgctattgtcgtcctcacccctcccggtgccaagggcgacaccaccagatctgccgtcctcaagctctgccgtcattatcaccccctcggagctgagggcggcaaatccgcccctcccgaacctagagggagctgctcccgagcccactactgttggcctctctcgagcattccgttgtcactcccggccgcgaccggcctctcctgagctcaccgtcgttgctcccgcccacggccaaccgctctcgagtctactaccgttgctcaggagaggagtgcccggatatatgagggagatggaggggaggataaggagagagaatgagggaggagtggataaaaatgagggagtgggacatttttttaggtggagagaggttgactggacttttcaccacgcgagcgcccaggaaaatacattttttcatgttgatttttttaaggagctatatgtgaaaatgctgactgatttttacagggacgaccagtggtggtcagtatgcaatctataggataacctcgtcaaaaaaatcattttttttaatagtgccatgatgaaggtaaccagtaacgcgtgtccttaacccattgccaggacatatagagatgagataggcagatagctcgtagtagctccctttatcggtagcgctatccgtcgagttaaacagttccgcaacaaggagtggaggccgaggatgacacgcacgccggaaagcgaaaccaatggcgcggcctgccggccaggacggctccgccgcgggtagcccagcgaaaaatttcggcaattttgcttggtccaacgcgcaggctcctcggcgtcggcatcacggcgggggaagcaaccgcgtgcgtccacatgaaaacgtttgttttctcggcaggcggccgatgtttgatgggttgccgacttgccgtcgttttttttgcgcgttagcacaagcccagtcacgatggcacattggcacccgtacggccgtacggtccatcacgtgtaggaaattgtggtgggtgtgtgatcgcttttgctgatgacccgtggttttttttggtttactgttaggatgcttcttacgggatgaaaacagctggaaactatcggaatcggcagcgtctctttgaaacggatattcgattgtaatgtttatcatttaaattactcaatttttgacgttaatacaataaagaggatattagaaaaaacaaaatttgtatatagcaaaaaaggtaacggtcgaaaacggtatccattgtatggaaaatgacactcggtcgatcgggaatttatgtgatcattttcaccccttcatatcttggcatgtgaattgtgaaatagaagctccaactcctcggaaaaaaagacccctttgaatcgtataaatggaaaaaggaaggaatagaaaaaaacatatgattatgataggaattcaatgcaaaataggggattgcaaaaaaaacacacacacaagaatgatcttctgattgattggattgtagaaaaacatagaaatcagatgggataaatatactcgaagacaattttccaaaatttagtacaagacatccaaaaatgtgtaattagctgggagacaccgtaagaatgcgtatttgctataggacaccacgaaaaactggtaattagctgctggacaccagcaagttatttcgttatatcttgaggaattggagagagaaacaacaatgtaagtacaattctacccttttgattttttttttctttttctctattcttctctactccttccttattcttttctacctctcattctttctatctctactctttcttcaagcgagcccgaggggaagggagagcgtcggcgacggcaccgcgaggcgtgggccggtacgacgcctcggctggggcggcgttgcatggtcgcccgcagggggccggggccagcacaacgcagcgaaggtggcgccagagcaagaggggaggtggtgccgacacggttgggcggtgtcgactcgtagtcgtaggtaagggcagccgggctcggcaagcgtgatcaggccaggagcgtggtggctccgagccggctttgggtagctcgaccggatggcgtcaggtgcttcagtcgggctcgggaaagaagagcgtgaagacgacgttgggcccattgatgcgatagcagtggcccggtaaaggaagggagtggctgagtggggaggccggccgccgcttcgtcctatgccatcggcggcctccccaggcttgctaaagaagagatcacccccatacccgagatccccatccaacctaactctattgggcggctgcaacaccaccgcctaactcccgccggccgaaggaactccttgtccacccactcgcttcgtcggctccggcgagtcgtcgctccaccgcccaatctggaaagaaagagtgagatagagaaaggggggcttacatgtgaggtccacattggattcatttgagccaagggcaaacttgcctttaatatttttctctctcctattcattaaaaataataaaataatatcgcaggtatccaacagctaattaccagtttttttgatgccctaaagcaaatgtgttcttacagtgtctcctaactaattacatgtttttttgaggttctgtagcaaattttgcattctccaaaatatttacaatattcttcattccataggaatttgagaggatacagtaagatttaattctttgtattaaagctctcatataaaatttttctatatgataaaaattctttaaaatttatatatttttcatgtgaatcaaaggaccccgagaagccgccaatttcctgcggtgatgaggaagataaatatgttaggtcccacaatttaccgccaattgcctatggctgcagttgcctttcgttagcaatagcgagcggaccacacatctcgtgagaacaggccagcatatccacgtttgccttgtgaacgtatggtactgaaaaacaaactaaagagaagctatgaactttcaaaaggaaaaacgaacaccaaaaggaaaaagagcccgaattaccccctacatcgcaaataaagtcattttacacgttaaactttttaaaccggacagaaaatccccctaacccaatctgaagcgttttttttaaattattacacagtacaacgcagacactcacaacgtacacaaactcacccctataaacgcacacacgtaaatcctacctctatgagcatctttgaagactggaacggcaaatccatcctggagattgacgaagccgatcaccatagacgcctcgccggttttgattgtagatgacgcacgagtggtagtctagtttaggggggaaaacggttttattaaaattgcgatgacatatttttaatgtcaaatcacagtcgattctttttgcattgggtttaggcggatactcctgcttgtttgtgcattgtgacccagcgtgttaggtctggaccgcgtgagaagtaaacatggttgaatacagtgcaaacgatgagtaacgaagggcatacccctacacgctaagctaaatagccatgcagcgctttattacgcattcgtataaaaattactctacactgtaagtattacaagttatatagggcaagttttaaaacatagtacattgtaattaggaaaaagtaccgatcaccctcttaaactatagcagttgactaaattaccccttaaactcaaaaaccagacatcgttcaccctcaactattcataccgaatgaataatcccctaagcatcgtcttggatggttttaacttgagcttacgtacgtggccgccaacatggcatccaatcagcaaaaaaaattttaaaaaatatctaggcccacatgtcacctcttttctcaagcaaggcgtccctaatccccattccccctacttcctgctctctctctttcatgatgtcattgactggagaaggacgacagagagggacctcactcgaggagacgacaatgacggaggtgaatcgacatgagctcagccaggcgcgcggaggtcctcctcgtagtccttctcagcctcctcatcatactcgtacatctcggcatctgagtgcggcagcggaggtgacatgacctccacggcaaccactacctcgctgccaccatctccggcgaccaccacctcgtcgacggcagtggtggatacaatagcgcttgcttcaccctatttgtcagcgcgctgtctagccccgcccgtgatgccctcttcccagcggcgaaggtgcaacggtagaggcagccatgtgtggaacggggagtgggagcggctccagtagtgcacggaccaacaccggaggtggccaccacgcttgtcctccccaacgatgtcccacgccgacgagctcatccccaacagccagatccgaccaatgcggctcccgtgccatcgtcgcctccgcggtcaccgccctcgccgccggtcacgctgctctcgcctctgcctccatgctgggaacgctcgtgcccctcctctagggcgagcgtgtgcgggagagcgggccagtcgctgctaccacacgcttcagaaggggagggaggagagagaaatgggggtggggactctaacaagtgagccctagttttttttaaaaaaaatgtttgctgtgactggacggccacaagtgctattcgaaccctaaaccattctcaacagtgctgtggggggagggggttgttcggtattaaaaattcagagtgaacgatgtctggttttcgagtttagggggtaatttggtcgaccgctatagttcagggtaattcgtatctttttcttgtaattataatgtaagttttaaaaattacattgtaactgcagtgtaagttttgaaaaatatagcgtaaacccttgtattacattgtaagaaaaatcttattatattttgttaaaaatatgacgccataaaaatatatagtaccaaaaattaacataaaaactgataactgttcacctttttaagttgagtttttttatcatcaattatcgatgtggcactgaaacaaataaaatatgtgtatatatatgttagtataaatttaacacgggaactggtaattctcaaaatagacggtttcatgattattctcatatattgaacatgacgattgtaccttgtccggccaaaaagagtagatagaaaaaccaaactagatcatttccatctggtctgggcctttatacctctttcggttgatctttgtcttgcttctacgcaagggaaagctcacggcgcccaaaatgatgaaagccacgtcacacgcaaaacgccggcatcgatcgcatagattgggaaagctccatgcatatatgtactgttcgaagcttagaaaattccatcccgtcagcacggccacgaaaaggagaagtggagtgagagtggtgcatattccgaatgagaccctctctaagccactaattttagaggtgcatttctctcaaaaaaaaaattagaggtgcatttgcatctcaactttttcaactcgaagattctttatgtgttatgattttcattgtcctgatcaaagagttatataagaacattttcacaatatgctaactcgtgttttcaatgtagcatatgtacaaaaagaattacaatgcacactttcacaaaattggaactggcctatgcttgcattctttatggtcccatctgatctcccggaacaagataataatgaatttaggatcgatgacgtaggattttctcattatatttgtgaaatatctcttctctactacttaaaaaataagaggtgcttccatcgtccgtaaaaaagaccgggcaaaaaaccggcgaaaaaaacaaaatttatccaataaaaaaccgggtaaagaaaaacgtgtgcgaaaaaagaaaagaaaaaccgatccaaagaaaaagcggtaaaaggaatccgatccaaaaaaggggcaaaaaaaatggacgaaaaaacaaatctgtctgatccaaaaaaagggaaaaaaggaaaaaaaattgaaacgaatccgactttgttgacgcggtaaaaaaagggcaaaaagataattaaaaaaccgtccaattcaaaagaaaaaggaactatatatgacacggtaaaaaaattcgaccgggcaaaaaaaaactagcgaaaaaactgggcaaaaaaacaggaaaaaaaaagtccgataaaaaaaacagggagaaaaaaaaccgggtggaaaaaaaaatctgtccgataaaaaaaagggcaaaaaaggaaaaaaaaagtgcttctgtcatccgtcaaaaaacagggtgaaaaaaaccgagcgaaaaaaagtccgatcaaaaaagggcgaaaaaaacaaatctgtccgataaaaaaaacaaggtgaaaaagggaaaaaatcgaaacaatccgactccaatgcagtaaaaaaagggcgaaaaaaattaataaaaaaactgtccgattccaaattatatatgatacggtaaaaaaaatcgaccgggcgaaaaaaaccaggtgaaaaaaagaaaaaaatttctgataaaaaaacggggcgaaaaaaaatctgtactatccaaaaaaaggaaaaaaatcgaaacgaat

SEQ ID NO: 74801 - DNA, 8504 bp, Oryza sativa
aaattacgagtttagattttaatcgtgtagattggttgcaaacatatctagcataggaactatctagcatgggaactattatataagaaacaaaaaaaatgtagtttttctaaaaatgttatatcacatcgctaaaaaaaaattgcgtggaaaaatcggttttgcactacaagaggtttaagtgaacatgtacatgaaaacccctttcagagtgaaggtgaaaataagcagattcaagagggcgtatatggaaaattcaataaaatacgcacaacaaacttatcccgaatagtcacagttcctgcaccacccaccagaaccttcccgatcaaaaacctcgtaacaccattcttacctttctcgtctttacccacctcacctacacctaaccaccgtgggcccgagaccccaccataccagcgcacacagttccaggcgccttaagttgtgcgttactcgcgtcgtcctagcacttttcagccactctccaccaacggcaatgctagatctagccattcacccccacccccccccccaacacacacagtcacccactcacctcgacaaatatggcaatgacttgtgggcccagatctacgtgggccccacgtgtcacgggggtaaacccagccagcgtctggaaaacatacaggtaggggggaaagagccggatcaccacgcctcgagcacgagctcgtcaacgactccgtcgtctcgtccacctccgaattccaaattttccatacccttcctcccagtccttacacctctcgatgcaaaaaccctagcgggggaagcaccacctgcgcagccgcagcggccatggcggagccggccctgctggaccccaccgccgccttcgacctccgcctctacccggcccacctcttcgaccacgaactccctctcgccggcggcggcggcggcgacgacgacgacgacctcccgctcgacgggctcgagttcgacctgcccggcgatttctccgtggaggacttcctcctccggtctccggagcgggacgactccggcgagggctctgctgccggatccgggcccaccgcctccccgtcgtcgtccccgaccacctcggcgtccaactccgccgtcgccaacggcagcggcggcgaggtcaagcacgaggagtcggatgaggggaggagcggtgggggtgaccccaagtggagcctgaagcggaagcaggcgagccccggcccgagctcggacgcggccaagtgccgccgatccggggacggcgacgtttctccgtcggcgtcggcgtcgcggaccgctgtggattccgacgagggggggacggtgtgcgaggaggaggaggacgagcggcgggcggcgcggctgatgcggaaccgcgagagcgcgcagctgtctcggcagaggaagaagcggtacgtggaggagctggaggagaaggtgaaatcgatgcactcggtgattaatgacctcaattctaggatctcctttgtcgtggccgagaacgcaacactgcggcagcagcttagtggcggcagtgtgaattgcccaccacctggggtgtatccgccggcgccaattcccggcatgcatttcccatggatgcctgggtatgcaatgagaccccctggttcccatgtacctcttgtgccaatcccccggttgaagccgcaacagccagtgccttcatccaaagtagtgaagaaaccagagagcaagaagactgtggagaacaagagtaagagcaagaccaagaccaagaaggtggctagtgttagccttcttggtttgctgcttattatgcttgtctttggtgctttcattccagggtttaatcataactttggaatgtgtgggcagagtgataatgctatgtttaggaattttggtcagtctcatgctagggtgttgagtgtcagtagccaggataaaagtagtttgaacaatagcgacatgattggtgttgatgttggaaagatgacggggaatactgatgggccagggaagaaacatcagcctgcacacaactcaagtgagatcctccctgctttgttgtatgtgccgaggaatggaaagcatgttaagatcaacggcaacctgattattcattctgtgcttgcaagcgagaaagcagtggcacataaggcctcaaaagatgatagtgatcagtcagctagagatcacaaagagactagtgttgccatagctcgttatctttcgctgcctggaaaggatgtgaatcgacaggagacatcctcggcagatggaccattgccacaatggtttcgtgaaggaatggaaggtaagcagattaatatgtttgccaatcttctattcttgttttctgcgaatttgtgatagttcaatttttaattttgtatttcgaccagagccatggtttgtttgtcgaatacaaatattcttgtgtatgctactgaagctgtgaagtttattgcctttattatttactcagatatgtaatatgtaaatataaatactaacactatatagtggtccatgtaatttcttttaatacacggccattgcatccaatatggtttggaatgcagtcatgaatgcaagtttgaaatacaagttaaaaaaagaatgaagtgacttcctgtaggtcatagagaaagcatgaagttaatatggttagacagggatttgcgttatgtttacatgccaacaataggacacaattgttattatctaggaaatgaaacccacatttaaggttgtgaagtaataatcagacactgcaagtctgcaactaatttggaaattggaatattatttattgaaggtcccctattaggcaacattttatacacgtcactctgacatatgggttttgagatcacccagttttgtgaaactgaaaaatatgccacccgagtttcttgttgctctgaattatgtcatcatatctcattttcagttcttcccttgtgttttcttctcatctcatctcttattttcttttcaactgaactaccaatcttccctttaccacttgggcgattaaattggcacgggataaatttgtgctgatccaaaccagtgaatagttgacccctaagcagaaaggtactgcagcatcccaaccattcgttcttcgctgctccatccactggcttgctactgctcttactcattgccttccacgcgagctctcttcattgctgctcactcttttttgcctgagcgcatggaagcatggatggatcttacagtggcggaggagaaagatacagctggggacagagacggaggaaggtggttggctggcggcggttaagttgaacactaatggctatattaataaaatctttgtagtcaatgtgataaccatgtgtcatagactacaaagaacctatgtgttgttaatcctttatcccataaatttctttgtgaacttaacataacagcatggcgttctagatctcaagtttctgtaacaaaataaataaatacaaatttcaacttgtattggttattttgtagtgatccctgcttttgctcttgtgacttaagtgggaactcactctttgctgaaattgtggcaaattggccagtgctaaagctagttcaaactaatttacatcctattataccacaatcctagaattatgttttttagggcaatcatagaattatgctgtgttgtttaaagcatactccttggagttcctttcgcttttctttctaaactttaagctcaactgaaaggtttactgtactggtcaaatatatattcagcggatccctaaatgttcacaagcttgtagttgcacaaaatcaacaagttggagtcttaaggacgtatatactttgtgttgtttagagtgttagaccgatttccaaattgttgctatcaggtatttcttttgaaaagctcaattgtttattcctactctgaattctgattgttatgtaacacagttcctaactctatgttgctatgcaacaacttttgcaggacctatattaaattctggaatgtgcagtgaggtatttcagtttgacatttcgacggcttctagcaatcctggtggcattatacctgcatctcctgttgtgaactcgtcaagtgtcaatgctaccgagaaaatcccagcacattctgctgcttatcatggcaagctgaaaaacagaagagtcatgtacaatgaagcgattccactcaccgggaagacggcgaacaacacagagccttttaacagaacctctgaaagcagcagcaagttacctgatagcaagccagcatcatcagttgttgtctcggtgctagccgatccaagggaggctggtaatggggatggcgatccgagagtatctccgaaacccctgtccaagatatttgttgttgttcttgttgacggtgtgagatatgtcacttactcctgcacgcttcctttcaagagctccagcccacatcttgtgaactaagcggctgggttgttcgccaaaaactgacagatgaatagatttatacaatgatctgatgctgtttcctaaccaaggactaaacttcctatgcactcaggctgaggtaattcaagtttgtcgaaggttcggagtgatgagtgcgagtttagttaatgtatgcagtttttgcagtgctgtgataatcgggttcgtttgctgtacctctagctgtaacggtgatgtaatcatgtaatactgtttgatcgttgagatataagtgcaactagtaatatgggtagtcgagaacacgtgcagaatatacatgcctttttttaccttagtttcaatgaatatcataaacaaagctacagtacatcaggttgctgaaaggtattttttatgctttgatctggatactatttagattatgtttaggctgaatttgttaggaattttgtttgtaatgaattcaggaactagctagaaagaattgagtctggtcaacatatctatgagaatatctgttgttaacagctgtgcgttgagcttgctagtctatcttttacagcactatctaatctagtatctactcgtcttgttattcacaaggtctattctaaaaaaaggatatttaaaatttccaacttacaagcctttgcctcataatttgaatcgtgaataaagaaaatagccgttattagttaggagtgtttttacacttcttccagaactgctaaccgatgcaatttttttaaataattctatacgaaagttgatttaaaatattgtagtaatatatttttaagctttttagctaatatttaactaattatgtgttaattcatcttttcatttacgtgtcagtgaaaaagttcacaaaccctccaaccgaactatttggaggagctaaatattctgaaaaacaactatttaatagcagcttctaaaaatctaaaaaactgtattttttctagtttctggtttattttctgaattttataattaaaatatggatgaacaattgaactttgtagggagttactaattcttgaaaaaaaactgccgttacagaaaaactcaaaagagatccttaaaatgaccctgaagaaaccgtcacgcactggctaaaacccacattatcctcaggcgcaaccgcgctctccgttcttccttccaccccaactcgccatggcgctcgccgccgcctccgtctcagttctccatctcccggccatctccctcccgctcccttgccttcagggctcaaaccctagccgtcccagcctcggcttgaccaatgccctcccgtggcgccgacgcggtgggcgcggggcgggggcggtggcgggggcggtgcgctgcgcgaagcgcacgggcaagcggcggtacccgtcggagaagaagcggctggataggcgacacaaggagctgctccggaaggccgcgccagaggagggctcggcggggcgggaggcgggttactggcggctctccaagctcgccgtccctgcccgcgacgaccccggcaaggacttcgctggtgtctccccgccgctcctccaagccatcgccaaagcactgaaattcccggtacgataatgcattgcatttttgtagtagctggtgaaatgcagtaaaaaattgcgaggttttagaatagctacaccgttgatgatacagaggattttgggggcgtggattcccatgagtcgctgctctggatgtgtggaactgtaggaaatattgccctagttccttgtgcggatagctcaattcttgatttgagcagcaggttgctaatttcctctttcaagttatgaaattaagccgcggtttgcaacttactaaacatgcgtacggctctgtctctcgagcatgtttgaacgttgttcgtaaccgtctatcgaattatgcatatggttcgtgcattatctggcagggctgagtgttagctgcttgcaacctgttatacaagtttccgattgcgtcctgctggagtaatctcaatatttaaactacaacgtttagtgatacgcctttcccttgaacattgtgactatggctgcttttgcatcttttgtccatattgctgagctcatattttatgcttagacttattctaaagttatgggcttctaaaatctattctgttctactgtaggtttcttctatgctccctgaagaggccttcaccgttattcgcaagtcgtttgatgcacggaaggttctttatggaatgattccatctatatcttatttagtatttgttatcctgcaaagagacgagattgcggcttggttgttaactgtaacacagatgcttgatgttgaagctgctaaatagtgcacccaaatcggattaacattaacacaaccgggaagaaacccaatgtagtaaccttcatttcagatctccattaacatgtcatccttctgttgatgtgtccgtcctaacacacagggtaacctttatttgcatcccaagtttgcaatagttccagatggccctgtaatggctcatctgagggtttaaggaagaaaacatgaagtagtgaagaatttgactatttttgtgctacctggtattttgcttagaatactggtcttctttactagatccttttgtcttgatgtcttgcagcaaagtatattattgttttgtttcctttgcttggttgttcttcattccgagagtgttatttcaggttttgcagactaggatgaagtcatgatgctctgcatctacttgtggatttgtagtcaacactaatttatgcattttggtttacatctttcatctctgtttctgactttgcactatttttttttttgttctgtaggcatttttctgaattaaacacatctttgtttatgtggactttaccttatttcagtgactggttttttagcgtgattatacaattgtagttatgccatataaaagttaattgtaatacttttcctttctacaaggctctgtgttataccgattgcaatttgcttcacctgtgttgcattcatgtgtcagtgttggttctactgcgttgataattgtttatatcatttatatgctgattagtttatcacttgcacaatttctttgtgactaaagaaatcatgtttaacatggcagattttgaaagaacctcaatttgtttataccgttgatgtggctgttaagagacttctggatttggagccgagaacgtgggattttattgctagattggaaccaaagcttggaacaatagaatacatgcctgatgagaaagtagcatctgatctggtcagtatgcttaatgtttataagcaaggttctgatggtgaactgggaatcaatgatactgtcaataatggctctatctgtagtccgcgaaagaaaccaagggtggcagttgtaggaagtgggccatcaggcttgtttgcctcccttgttctaggtgaacttggtgcagaagttaccttaatagagcgtggtcaacctgttgaacaaagggggcgtgatattggtgccttagtagttagacgaattctccattcagaaagcaacttttgctttggagaggtatactactcgttcctattttgcttacaggacttcaccaaatacatgtcagaattgtcttgagatatgttcgaataggtattttgttgacaatggattgaggcatttaacagctcgacatatatcttttgataaacatataaagtagctatatgtccatttggctactattatggccaggtggccacatgaagtgatttcatactatggcagttggtgcatttataccaattacttgacctgaaagaagcatacatgtctagacgttatatgcatctgaaataatgtaaggatgctttaaatctattgaatgatcatgctattttgaaaactgttgtgccataatcttcatatattatcaccattttgtccatctgttttcatatcatttaccatgtataaattaacaatttaaaattgaacttatacactgtacagtatgctcaagtcgtgaactccctactcgattactcccacccagtcacaaatatctggcgtttaggataagatttggtca

SEQ ID NO: 74802 - DNA, 698 bp, Oryza sativa
cctcataattcagttataaaatgcatggcactgagctttgcttgcagggccagggcttgtatccaaaagtgatctatgacatagacaccataaaaattaccatttactgtgtggtaacaacgatatgttgtagtatgtgtaaaaacttatgtagagacctgtgcagctactgataccaggctcctttgatatatgtatctatcgatagtttaaccaaccatgtaagcacttgaatagttgccagtttggtacagctacaacatactgtatttcattttgtatattatatggtatgtgttatttgcattcaactgcagtactctgaattggctgctgaagtacataaagggcgtgggcggatacctgtagcagattacaagatagtgaaatcttttggtgaaggagatgcagagctaccagaacaaaatcgcagttgttactcattttgcatgtgtcctggtggacaggtcagttgctcttttgttgtttcactcactccctcttctaatataggagtactactagttactgcaatcctatttctactgaattctaataataacgtgtgttctgattttttaaaaaaaaactcttgcaggttgttctaactagcacaaacccatcagaattgtgcatcaatggtatgtcattctcaaggcgtgcatccaagtgggcaaactcagcttttgtggccactg

SEQ ID NO: 74803 - DNA, 3009 bp, Oryza sativa
aaaataatattagcgtgtagacaaagcaagtgcttccatttttgctcatgacatatatattcaataatagatcaggcatatgctccatgcatacatgagctgcacacatataattttgtcatagaacgtgcaacatataatacatgctggtgacatgtaatgagaggttgctagttagatcatgtctgtttgtgtgtgtgtctattccactttttaggtaattgtgtttcttaattactgacggttgcgtgttttaacctgcagttcgattaccaattaaactagaggaatcaaagcattccaaggagatactcccaatacatgttcattgatctgtgatctaatcattctggttacataaaaagtcacaagcttcaaatcaattataatatataaatggaagatcctctccatgcatgagctatatatcaaattaattaaatgctgacagtaacgttacatgatgcattatatttgcatgaccaacaaggcttagcatcacacaattaatcaaaactaaagttcacattgtggggataaatcagatgaaaattcaaggcatatatttgatgcattctttgatccttaacaattaaattagtactatattccgaggaggcaagggtggccatgcccatggctccttgttttactctcaagttagttattgcgtctgcatgtggccccaatataatcgatcaacatatatatatgtttttatgacacggttgtatgttgggctcagtgttcatggggtcactgataggtaaggctctccgacaccatcaatcatatttccacatcgatttgatcatgcatctcatcttctttttccagtttccactaatatcaatgtaagaccaggaagaaatctattcccttcgtttcattttatcgagtcaaattttttcatgtttgactaagtttgtaaaattaaaatttagtatcatttactgaaaaaaaaatataatattatattaaaatgtattcaatgctagatttaataaaaacttatttggtgttgtagttgcttctatattttctctaaacttgatcaataaattgcacttaggacaaactcaaacatcttataatatgaaacatgggaagtgctagctagataattaaggttagtttcacttacatggtctatacttttttatttgttatcattccaaagttaattagtaattaaatttgtctggttttcagttttctttcagaaaagttttcataatttttctatcatcatctactgctttccttcacatattaatatatgtagctagattgcacgccatatataccatacatgaaacaaaactcagggtcctcaactagctctgatgattcttaagaactagctaagctagctagcttcttcattctaatatatatgtcttgttcttcttggtaattttcagattagtcagtacgtgggtatatattccagtgctgttatgatcattgctcaaacggacaacgaagaggtagagaattattgcctattagtggccacatgcacaatctatggtctaagattcagcattgaagcgtatatacagtatgttcgacccaattccgacagaaacctgaaagaggctgatcaacatgtacatgacgatggcatgaatgctcggtaattcatcagtgaaaagaaagaactctacatgcccttgacaatgtgttcaatccaaatggcttgaatttttcatgcattttgcaaatcagtgagtaataatatatactccctttagatgcatgcatgcctacattatttcccttgtacatgattgaacttggtgtgtatgaaattaacaaattaatatccaacatgtacagatcgccaatgcatgtgaataattcagagatatgtacttaattatatgttcatgatcagtactactggcagtgcaggtaaagctagccagctgcagtgatactgtgcaacaccaaacgatccagctgaccggggaacagtagctatagcttagagtcttttgccacaccacaaagaaatctttccatgcaaaaccaaatcaagggctagctggaatatgtgtttcaggaaagaaaccaagagagatggagatggagatgcagatggtgatccatctcctgtagttttcagctctggccctctctctctccatcttatattagcttgccaccagtatatgtttttgctgtgactgtagttgttgaggtggttggatcaatcagtccttgaaaagggaacagaggaaagaaagattaaaaaaagtgaaattataggtaagttgtgtgtgattcatacaagtgtggagaaagagagaaattaaagtatttccatttttctctttgagagagagagagagagtgatgctgatgagagttgagacttccttcatatgtaatgagtagctctagcttgttttaacttttaaggtttagggtcactggccggcacactgcctccatccataggaaaaagtttgctctctgctagtactcctctaaactatttcgacggaacacataattaaccctgacctttttggctcacttgaccaaacacactgtttaaaacgaaccactttactttgtaccgacatttcttttgtttctcacaattaacacacgacccatagttctatcactagtgagtgaagttgggtaattttttattatagtttaacggctaaaacactttaacgtaatagtttcaagtactagaataaacttttcggttcacaaatattatttactagtatttatttccttaagaaattttacgactattaattaaggagaaaccgagaggtagtaggagatataaaatttacatttaaaagattactctaaaggatgttaacatagtcaagactagttcatcaactcaaaacaatatcccatctctcacctctcctctccatcccctccaccatggcaggcgctacctccatgtcaacattgtcgttgctgactcaaagtcaagagctagctagccttgctgcggcgcaccactcg

SEQ ID NO: 74804 - DNA, 5744 bp, Oryza sativa
ttctctacacactttaaatcttctataacattattgagaataacatttttatttgaaggaatcacacctagattattaagggaagcagaaatttgatcatttgtaaattgtaaaaaagaaacattaacatccatattacctttagcatggggtttctccaagttcttttccgccttcaacctttcagctctttcaaggacaagctgatcactatcagaagctctccttttgcttttcctggatggagaaattaacgcctcgggaatagcagagatttttccaaccagtttttcttgctcaaccaacacggtctcctcatccaacccgtcaaaatcttcgtcagacgcagtcaaaccttctgactccggtatcaaactcaactgagaagaggtaaaagaaggaccacccctctcagtaagattactatcagtagccatactcacatcagagacacccagtccagacttctttcccatgtccttgtcattttccccatcgtcatttctcttcccatcaccatccccaaaattatccatatccaaaggaacaggatccccagcaccaatatctgactccactttaaaagacagctcatacaaatgatcaccaatggccacatcaacaacatcagggattagagatgggtcaaggaccaaaacttgtaaacgagctatctcataccttctagtaaataacatatcaacagctttagtaatcccaagaatagaaccaactgcccaaataattaaatattccctcaacccagaaggaagccccttacactgaacccaaacttttggaatgacatatttcacctcattcccaacacctctttctatgatctccatctgagcctcaccaactttagtgtgcacctttccccattccaccatgcgattcagctcagcagcagaaggaaagatggtatgaaaagtgttatcaccattgtcatgtaccacccacctccatttaccaggaattaacctctccaattcagatacaacagctttaactgtcatctgaccattagatattttaaccaaggccgccctagggtcatgcctaatcctttgtccagctgggagggggatatgaaaaaatcccaaaccatcacccccataaccacataactgagcagtaggtttcacagctgatctaaaaacaggacaccgggtagcaatgtgatccacactttcacaaatttcacaataaaattttgatgaacactcctgaagagtatgccccttagtcaaacacctatagcagtaaggtttacccaatcccttagtgtctgcctttgatttacctttctctgaatcagtggcgcaaacaagcaacccttgttgtacgggttcagcacccaccgccggggtaacagatgcgatgacatcacccgttttagcagcagcaacaagagtaccacccacagcaaccgatccactaactgacccagaggtatttgcagctaaacccgtagaaccactagccgaagttcttccaaaactcggtatcacaccaactgaattaactgcagaagtcccaacaatcttacccacatgtccactcggcgtcaaacctgcaggtagcactagcgatgctgacacagaggtagcagtggctccctgaccaccaccacccagcggaagaccagctgcaggaactccacccgggtataaaccacccggcggcccaaaagcacctgccggcggcgccataccacctgccggcacaccactagatccacccgtcgctgcaaattgaccaccaaacgacggcacaccgaagaactgtgacccagatgcatcacttgccggccggccaaaagagcccaaagggaaccctaaaccggaattgaagccagttggcccagcattctgtccaaacccaccgttccaaccttgtcctcctccaaagttgccatgccatctaccactgttgccgtgagagaagtcatggcgattgttgtgaccgccaaactttccacgaccccgtccccttcctcctctaccatctctgccttgctgtggaaaaccacctccggaacccggatgaaaaccccgagcaaagccaccgccatgcccgccagcaccgaaaccctagcgattgtttctctccattggcgaagaactagcgacagcggcgtaggagcgagcgcgagaaggagatcgatctcccaccaaacacctgcgcctcacggtaccagttttcgcaaaaagagcaactaacccgggtatgggcctataggggatagcgggctttggataaggggtacattgtggacttacgttaattgattcagattttgtaacctccggaagtttgggaaattccaaattcgtcaccgtcggatgaagtggaaacctcaccgaatcggaagacttcaccggagaaaaatcggacttttgaaaccgcatcttccccaccagaggagattgaaatctcgccggggtagaaccagaaacggtcgccgggaaaacggatgataccttcccttgcagcgctgaatagatagcctcaccaacagttctcggcggagacttcctcggcgacggcagcggcccactccatggctttgatgcgcactccagagaagatgacaccaacggccaagactcctcaccatgcaaagcctgcaaaactgaaaaacgagaaccagaagactcaccgattccattttcctgatgatcaacagcagcaactgagacatgcacaggcttcggcctcaacgccgaggccgccgcgacctcagccacatggcgtagccgaagacgatacttgcaaatacctcctttgttccaaaataggtgacatttaagaatatatgtagctgaatctctaaatcttaacttggtaataaatacacaatgttgaaatttggagtacatcagttgatcagtagtacacatgtgatgaaaaatatatgagaaagcttccatatggctgaatttttaaaactactactcacatcgttccaaaataagatcatctttgcctccttttaattgtcaaaaataaattcatctttgagcaattattacattgaaatatgtaaaaggggaaaataattgtattgggatttcataaaatgaagcgttttttttcttttgtgatagtatgggcgtgatgggtgaaaaagaaagttattttatgattaggcgagcgtttgaaagggtgataaaatttcctcgttttccacgtgcatgtttcctagactactaaacgatgtgttttgtttcaaaagaaattctattggaaagctcctttaaaaatcatattaatccatttttgaagtttaaaatcatacaatagtgggtcactgggtcaccacattttatgtatcttcttgtttcccctcctctaaggcaacagaggagattcactggtggagaaaccatctttggtcggtcaacccaaatccacaatagtcccggttccattaaaaaccgggactaaaaacgatttttagtcccggtttataagcgtaacaggactagatcatctttattcccggttggggttaccaaccgggactaaagatcatctttagtcctctttagtcccggttggtaacaccaactgggaataaagatgatctttagtcccggttgtctataagtcagaccatgtcaggcggctaggatctttagtcccggttggtaacaccaaccgggactaaagatctaactttattcccggttggagttactaaccgggaataaaaatcaacacgtactatataatccctattacttatcctcttttcccgtccacacaacgaactctttctctatctcttttttcctctctaactccctatccttattatttcttctaccttcttccttagttcttcttcttccttagcccgcttggatcggagcgagagaggccagccacttggagcgagagcaggccgagcggcagccggcgcggcggcgcggagggacgggcggcggtggccggccggcgcggaggggaagccggcgcgcagcagcgcggagggccgcggcggcggcgcgggggccggccggcgctgaggggaggcggcatggaggcgggcagcgccgcggcggcggcgcggcgtcgggcagcgccgcgggggccagccggcgcggaggggaggcggcacggcggcgcggcagcaggcgggcggcgcgatggcaggcgggcggcgcggcggtggccggccggccggcgtggaggctaggcggcagcggccggccggctcctctgttgtttttttttttaagaatttgtgatttattgcagcatcatgtgatgaatttgatttgtatgtgatgtgaacttgtgatgtatttgtgatgaattttgtagaaacttgtgatgtaatttgatttgtgtgtaattttttttaggatttgtgatgtatttgatttgtgatgtaattttttagaactttaaaatttgtaatgtggacttaggatcttacttcgatttgggatatgcataccacctatattagggagaaaataaataaaggatatgcataccacccagattcggaagaaaataaaaaaggaaaaaaaaacctggctatcctctttagtcccggttggtaacaacaaccgggactaaagataccctatctttagtcctggttggtgttacgaaccgggactaaagataccccatctttagtctccgattgctactcctggttgaaaacccgggactaaagggggttcccaaccgggagtaaaaagggtttttctacctgtgattgtccgtatgaaaaaaaaagaagcttcaaaagaaagaaaggaaggaagacaacaagatcaggaaggtagaactgtactacagctagcaaatggatttctgaaggaggtcacacgcaacaaaggtcttgttaaaatcagtttgattttaagaaatagcttgtcagaagtcggtttctaataatttggagaagttgatattcagttcattttatgatttctgtaactaaagcttctcaaaatctgaacgaacaacataatcgtttaatttgaggagaagttgtagctatctatgagaatctcgtcaaacatacgcagggtaccatcggtaagactacaacatttagggcatctacaatgcaagacacccatatagtgtcctcactaactgaatacacccatatggacattcgtctcacaatggaggccacaactagatgggtttctcaaaatctatgggtatccctaccaaaaagtcaccgcattaaatttcctcatctaccctcctcggcaactcctccctctctctcgtcgctcccctttctcccaatctcacgcgtcgagcccctccccaaccgccgccgcgcctccctcctcgccctccccagcaaccgccgctgcgcctccctcctctcccttcccagctgctaccaccgctgccgctttctcccgcgagatttggatgtggggagccacggtgctgcctcctactcccagcccagcgcgtcggcggctcggcgagcaacgcgcggatccgtcgtcgccgccggcatcgtctccaggtcatcgccggcttcgtctccctctccctctcgccgccaactctcacctctctctccctccctctctctctctctccctcgccgccgccgctggcctctctctcccgtcaccggcggccgtgagggcgatgagtgagaggggcgaggggtggaaggggaaattttttgtgggaacggtgtccacaagccacgctcgcgtccaacgtgccccctcggctgcgtt

SEQ ID NO: 74805 - DNA, 5039 bp, Oryza sativa
  unsure (1)..(5039): unsure at all n locations
gggggggggcggacggaaaggctaacgaacgttgctaggggcacggatcgaagctacgcattggtgatggccttatcggttttgtttagggaaaccataaccctactgttttagtaagatgacaaagaatcagttggtctacttctctactactagtggagagtggagtgtaggcagctgcggcgtggtgggggcggtgtgtttgggggtagtggtgggcgcccgccactggtggtgtgtgcctccggcaagccggcagtcacgtgaacgtcaattccatccactcactgccccaccccaccctccctcacatgcgttgccacgctcatctctattgctactactgctaccaacattgttcgacagaaaacgaaatattttcaagtagtaatatcttttggaacaaaaggaatttcgcaaaaacgatagagaaatcaaaccaatctctactagtactcacaaacactggcgtgtatatgtagttgctgctggtcgttgcatgcacgtacgagctcgttcgttttgacttgggatgcatgattggtagcactagtacggtgtactccaaaaatagccgttgcattgcatgtccggattcgttatccagatctatacgattataactacttatcgatctcacttatatcacttggactttagctactaagtaggagtatcagtgtatcactcactctctcccggtcggataacacaaaaacctctctgttttctccgacacgtacgcccaatcatcaacacagctacaactatatctagctatccaaggaatctttcatgcatcctcttcttgtgtagctctagtccaactacagatcacaatgtcaagagaaaccaatcttaacttaacattataccctacccgtatctatctaaccacataccaccaaaaaaaacacctaaattctattccaatgatttcatactagacatttccaaaaactatcagccgctgactacctaatatttataactatactagtaataatttattttttgcagcagcaacagcgctagtactagtgcagtagggttgttaaaccactctcactcatggtggaagacggcaaaagtgaaaaggcgccttcactgcccaacgcacgtaaaagcaaatgtagcctttcccgaactccaacccaattccaactaaccacctacgctttccagttactctccagcctttccctacgtcaccgacacgtgggccccacccacgctctctccctcagttctgacaccaaaaaagccatggatgaattacgaggtcgtggtaaaaaaaaaaacattacagcgaacacctcacgggcattacatcgaacacctcgccgacgccggcggcggattaacgaagccagcggcggaggtcggtggtggatgacggagagaccacgtccccgccgaggctctccgcgcaggacgacgacacgttcgaccgctgctccgacgagaacctccccgccgcgctcttgaagctcgggctccgcaggctctgcgcgtacgcgccgtacgggtcgatggggacggggaacgacagccgcttcttcgctccgccgccgccgccgccgccgccgaatgacatcctgtcgcgctccggcgtcgccgggcgctgccgcggcgcgctctgggaacgcacccgcgccttggcggactccgtcgccgccatgtagttcggcaccgccgccgcgccgcccgacgacgcgtggtggcggtgcgagtgaaggctcggggtgtagctccctcccccgccgccgccgcgctccacgcgcgggcttgccgaccgcacctggatcggcggccgcgccttggatggcgacggcgtgaccggcgagtggtggtgcgcgcggtgcatcggcgacgacgacgcgtggtacgacgcgttgccgtgccggcgtggcgtggagtaggagaagggccgcgcggtgtcgatctccagcgtcttgacctggtcgcggtggtcggtggacgcgcgcccaggcgccgccgctgcggaggcgcggacggtgctcctgctggtgtcgaacgacgcgcgcgacgccatccacctctccgcccacctcggctgcccatcgacgtccatctcctccaccgacggcgccgggttcctccaaatctaccacattacaccaccaccaatgaaatcgaccacgaacaccactcgtttgcggaaatgacaggaagagaaactgtcatattacttgatgggagaaggcgtaggagagcgccctctcacgcttgagcgcggcgtccttcctcgtctgcagcatcgcctggatctcctctatcgtccgcggccggtcgtcccagtcgtcgccggcggcgaagctgctgccgtctcgcgaccgctcctgcaaacaaacaaaccaatgagaagcttgcaatgtgaggacgaggacggggcaaagaaagtgggaggagaagtggaactgacgatggagcggcggtcggcagcggcgaagtcgtgggtgtacttggaatcccagaaggtggaggtgtcgacgctgtaggaggacttgctgctgccgcatggcgcggcggaggcggcggcggcggacaaggagatggagtcctgggagaggcgcatccgctggtcgcggacgcgggcctggacgcgcaccagcgcctgcatgcagcggagcgtcatgttggcctgcttccgcacgttgtggccgcgcaccagcgcctgcagcttcacgagccccttgagcgcccggagcgcgcgccgcgccaggtacccgcggaacgcggtctggaccacgatggcggcgtagtgctcgcggacgaagctggagctcggacgcgtcagccggaccacctccgccgccgcctgcgccgtcgccaccgccgcctccgcggtcgccgccgtcgccacggcgagcgcgatggcgtgccgctgctcctccgtcacggccgccgccctcgattgctgctgctgctgctgtggcggcggcggtgtcggaggcgcgggagacggcgacgaggacttcctgaagagccatctgcggcgctccctcttgccctggacagagagaagaggagagaagtgagcgaagagaaggtgttcgacgaaatgcgagtaggcgggtggtggcggaccttgtcgtcgtcggtgtcgtcgcggaggcgggcggccttgttgggggagtcgtccttagagggggagcggaaggcgcgcttgacggcggtgagccaggaggaggtggtgccggccttcttccccatcaatggcggccacgggcattgacgtacgggaggtgtcgcaacgggcggcacgaggtgaggtgtatgagtattattgcagctggggtagcagtgacagtggctctcatggctcacgcgctgctgccgcgccttttatgtggtggaggagccattaaagtaaggttngntggggggnagggtggagaaagtnagagngagagagtgggggagggagaagaagaaagggtaaagggggggngggaggggggggccanggttgtaaaaacaatnnnnnnnnnggggggggggagtgagtgggtgaacgttgcgttgccttccattattccgttcgtccggtatgatgattcatgaaccgctgcgcacctgcaatctctgcatctcatcctgatgatgtgatttcaagtttcaatcgctttctctcatttatgtttggttcacatcaaaattaatagtttggtattaaaaatttacgtgtgtagaaaaattttgatgcgatagaaaagttaaaagtttaaataattaagccctaggacactaggaagctggctagggctgcctagggatggagaagtggaaggcccgtgaagtggtgaaccctcagaccgttcacaatgcaggtactcgtagtgatacctaaggtagtgtttggttgcaaggatgggatgggacgaacccacttttaaaggtgttcggtttaagggtggatgggatgggttggtccctggaaaggaataatcctctcagatccgggaccaaccgatccgccaaaaactggcggacaaactcgtcccacctgggacgagagacggggtcaccgcgccatccaccaccttcgcgagctccgccgggcgcccacgagcgtcgccgcttggtccacacccgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccgcggccgccgcagccgcctccacgagctccgccgctcgtccgcgaccactacctctgcgagcaccgccgccacctccgcgcgtccacgagcgccgcctcgcctccacggccgccgccgccgcctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgcgaccgccatctccacaaactccgccacctctgcctcgtctacgaccgtcgccgccaccttcgcaagcgccgccgccggtcctctcagatccgggcgccgccgagtgcctccgcccctagacggcactaacggtgagtacaaatccatccatcccatcccacctcaatctcttctaccaaacaaaaaactataaccatcccataccataaaccaaacagacaactggaaccatcccatcccacaaaactaggataggtctgacccatcccacttcgtccccaaaccaaacactacctaagagaaacggtgagccggatcccaagttaatcgctcgaaccttcacgtgaggacgcgcgcgcacgccctacctgcgcgagacactcctccgtgcctatgttggctaggtcgcctcctcacgtttaattacatctggtcgtcccctcatgtttcatctggtccggctagccctattcagatgttgccatgatcgagtttgatactagggtt

SEQ ID NO: 74806 - DNA, 4560 bp, Oryza sativa
atatacccttttttaaaaattgtcttcataaaactgcccacgcatctgcgcgggctttctttctagttaattaaataagtatattaattacaaattaattgagcttgtaattgattagtttttagttagctggccaaaatacagtgatatatataaatgggttaggtcatgtgcttagtctcgggtgtgtggcatatatttatgcaaacgacgtctttttgatcaaaactactaacgaccctatcgtttggctgattataagcataagcgaaataatatatttacaaattacaaataacttgtgattaaaatttttatatacgtgtaattaacgatattaaagcaaaggctgaaaaataaaatacgacgaaaaaaaatctcaaaataaacgtaactccaaattaaatttaaagttaaaaatttaaattttggctgataagcataatctaagcgaaaagatgggggccgtaagaccatagaagaggacctgcgagctagagcacaagaaatattaaacaaacaagagacaacacttcctctcttttctcttttctgatcatctcttttcaactttttcgatccaattccatcattcaaacagaaaggaatggctcacaaaggacgccttttatgaccgagatcgaaggaaaaagtgcttttaatttctatctgacgcttatatgttaaaaagaacaaataatgtcaccattatagtcagtgaggtgtgacttagaacatatataaaaggccagcatgttttcctcgagggcacatacatacgacagcgccagttaagtgcactaacgattaattatgcgctctaaattaaattaattaatcttgagaatatttttattttgcccttcttttatgaggcgatccatatatatatatcacagatctatagatggatgtgaatcgatgttcattgtgtctttcttttttgtgataatttttagtttattacctatagtgtcatcagggatatttcattatactagttattgccctgaaactcttgtgcaacagttgcaggttaactatgggccagtagccagcatttgaatttcttttttggaatgcgcaaaaggtttgcgaatccgtatattatatctgagttacacaacgcaaaaggctatacatgctcttgtcgggtacatggtagagatcttaggaagagtaagcggaaaaaaaaaagaaaaaaaaagctaaatagtccgtccacaaagaaatggttgatgttatcacctttttggctttttcacggtcttctgggtatgatttcgcccacaattttatattcaaataagtttataaaatctaataagtttatgagattaaaagggcattttccaagaaaaatatatacacatcaatttttttgaagtttaaatctaaatatctgaaaagtaattggtagtaaaagttttaaagtttacctgaagacaggcacccggatttaaagttaatcatatccgttagatttaagtgcctcaaaatttgtaaattttaatttatctaaaatgcacctttctaagcctaaaattacattgttatgtgatgtacaattttagtccatgttaactgtaattttgctttcatatctcatctatggttttactttgtgttataagattaatttttttgcatgtgacgccagtctctcctcacgtctcacgtcgcttgctcttccccatgtttttagccgacgttactttctccatctcaaaaaaaaaaaaaactcaacctcatactatgatgtgatacatcttattacaatgaatctagacatactttacgtctagatttattgtcctagtactatgttgtctttttttataaaaagcgttgttatgcaaaacttttttcaattccatctcttctctctcctgcatatcaccaaattggcttaaatggcaataaaggtacccggataataatacccatggtatatctaataggatctatccacaccctacataattaaaaagactagcttaatacatcatcagtacgctctaccttttaagttatgatccgcataatcaattatcactatcagattaaatccaccaatgacatcatcaaaccacgtcatccttattacataaattgcatcattaattgcatctcctagagaaagaaatgtaaagaaagagcttcaaagaaggaaccgcctggggtgtttttcatgttttagtattttatttttactagaaaaaatacccgtgcattgcacggataatgattttttaagtgatatattaaaagaataagagctaagcaataaatagaaatattaggatcactatacattataattgaaaaggataatgaaaattgtaacactgggatcgctatacatagattataattaaaaaaaagttaatgaaaatattttccgggttttgggccgaaagctttcctttcttttcagccctaggccagtccactacctctctctgtttggcatgcttcccttcgagccagggacaagtagagccgtaagccccgctcgcaccgtccaataccatcttcaaccttccgaagatagtcccgtacccgtacagttgccagagcaaatcttctcatcaaattcgatcgaatctttctcgatcacttaaaattggttgaggattttttatccactcgttctgctctttcctttttcccaataaggatgaagcaaacgatgatcaattagtaattaatatacaagaaacaaacgatgatcagtctcctctctctcccctcccccattaattcttcctatccatggcagccggggtggccggtctcagagcatctataatgtttgaactagaagatgcaaaaaaaaaaaaagtcatcttctgtagcaaagattaaggtctcaactcttaatccccaaacatagcaaaattagggcttttcccttgagagacttgagcggagtgatggagcggcagcactaggcggatctggcacgtactggtaaatctcgagcaaagcgctggccatgaattctcctcccaaacacatgatttgttaaaaatgttttatttttcacgaacacgtaaaagaattgcacgttaatacattagaggaaatattaaaaatgttcggattttcatgcatcggaattattctcctcccaaacacattatttgttaaaattgttcggatttccgtgcattgaaaatcagcgcatgcactatatacaatttaaatatagatatacgtacatttaaaaatggagagagtagtataaatttctactcccatatttcaatataattgtcgttttaggattggtgagctattagctgaagatgaaaattactaagttatcctcaaattattactagtaccagttgcatgtggtcatttcaacaagagaattaacacaaacagcactagccacacaagaaatattttaagcatagaattaagtagtgtcacatagaacagtcccaacccatagtgtccataagtagtgtctatatagtgccatgtcaataagacatcataatagaaactacactcgacagcccatgatttcttaaagtgggccattaataaatacatcatctctcttctctaccaatcatatttattcttcatctattatgaagacattattctatcctaatgtaaaacttgatagtatctagtgcataggttctcatgttgaagctgtgtcttgcatgagacccagtttcttcttggcttcactctctcttaattaatatagtaccacattagcttaaagttctattttggcatggtattaatggcattaaaccctattctaaatgaagggtgggaactgccttattccaagtaatactagtgctactttactgtcaaaacgtacaaaacgtcaagtgctcagagacaaatgttaggggggtacgtaaaacgtcgaagtaatctgggacagtatgtgccctccatggcactattgcatatgcatgcatctgttgggactttatgatcgaactgcaattaatctatcagttgctatttgattctgcgttgcagggtgtgaatttaattaattaaggtgcagatcgagacgacagtgtggtcatctctgttcgatctgatgcgatgcgatgcgatgcatgggcatcaggagcaacatgccacatgtactgctattgcaactctgccaacggtagctggcggtgaaccgatcaatgcatgccaggtacatagtactccctccatcctataatatagtaatctagtaccggatgtgatattttatagtataataaatctggacacctttctgtccagattcgttatactataaaatgtctcatccggtactaagttactatattatgagacggagggagtacgtcctttaattttggttgtcaactcaacgtagtactagctatgatcatttcagatcgatcgatgcagatggagtgccagttatcgatcgatatcacttaattatgctaatcacaatgcataatatatagtactttctagctgatagcattttctctcttgcttgttgcatcgcttgcaagtgttgcttaataataattagtttttgataat

SEQ ID NO: 74807 - DNA, 30408 bp, Oryza sativa
gtatgctttcaacactctaactgtgccttctctaacggtacaaggcctccgtaagaacggagaaatttcagagtaatttcagagatatcatacatcgatcgagcaaataattgatcgataacttggctggccgattaattagcagcacctttaagctcaagagagagaaagagagtcaagactataccatatactccctccgtcccatgatataaaggattttgagtctttgttatcctatttgaccactcttcttattcaaaaaattttggaattattatttttttttgatttactttattatccaaagtactttaaagtacaacttttcattttttatatttgcataaattttttgaataagacgagtgatcaaacactacaatcaaaaactcaaaatcccttatattatgggacagatggagtattgtactactacctccatcccaaaatgtttgacgccgttgacttttaaaaaaatatttgaccgttcgtcttattcaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacatctagagaaggagggagtatatgcttcaacgctctaattgcctctccaacgggacaaggcctcctttagaacggaaaaatttccaagtaatttcggagatactgatcatataaattcaatggaaaatttatctgtaagatgcagagaaatgacaggttatatttctctaacaccaaagacacaaaagcacttctgaaaggctctgatcagttaagctacgatcataaagtgaggtaaacaaaacagagcaaaacaacttagaaatactccctccgtctctaaatacaagatattttggttagatgtgacacattctagtacaacgaatctgaatataaagtctatctaaattcgttgtactgggataagtcacatctaaccaaaatcccttatatttagagaagagagagtaatttgtaaaagcaaaggctgaatcatagacatgattaaaatagaccctaaaattaatctaccatgaagttttaaaatttaaattttgcaatgacacaagcggatgaaagaaagaaaaaacagagatattaaatactgtgcaatatggagcaacacgtgtggcagataggcgatcacgtcggcggatcgtcggagcacccaaccaacacaaatccgtggtgcaccccacagtgggggcacaaagaaattaacctaccactcgtaggatttgctcctaaaagccatggaaacacacacataatataatcagattaaaattaattaaccaactactagaaaaactagctatatatagctaggtgactatatcatcatcattatcatcagcttctgtttctcaatcgatatcgaaatgtgacaacctagatgacagtacatatatgcatccatccattagccatgcatgcatcatcctcttgagtttctcctttgtgcattgacttgggagagacagagctaaaaagtctaactaaaaagctatctattgatctatagatgcagatagagggtgtcacctgatcattttccctgctcctccctgtcccagcactgcagtatcagcctatttaggcagttaagaaggtcaaatcagatatcctgcaagtcgtaataaattggcaccaaatccccttaattcaatgtgggttagttcaaatagtggtaataagttatccatcaatttttagaccagtatggaacttttacctctttgtgcaaaatttactcctgtatgagaagccaatgtgaagccagttttttttttcctttttggctcctgtatgagaagccaaagtatatatagtcatctgtagctaattgatgttaaatttactcaaccaaactgtagaaataatcaatgtggctatatattgtagcagtgcatatatggggtgttggtgtgtatgaattaattagtagggtatctattaaataaaagataaaggttttatgatatggtgtgggtgagaggggcatgaatcatgccagcaaaggtattgtattactgtgcagtatagtagtgttactgtatgtgtacaggtgaagccgctgtacatggaagaagccagcagacatgccatgctcaagctatgcaggctagtgacacgcatgctactactatatagtgtacttacctgcttttgatctgcttttgactcctgctatagtgctgtgaaggctatcccatctataaagcatttcatactgtcaccagaagcaacatgtttttctcacatgggaattttccttgttttatactccctccgtcaaaaaaaaaaagacaaaccctggtttccgtgcctaatgtttgaccgcccgtcttatttgaaaaaattatgaaaaaaattaaaaagataagtcacgcacaaagtattaatcatgttttatcatctaacaacaataaaaatacgaattataaaaaaatttcatataagacggacagtcaaagttggacacggaaacacagggttcgccttttttgggacagagggagtactctccttcacagatacttgttcaaacactatttatattgaactttgaccatttgtctttttctataaattttcttttataatacttagaaaattcagtattaccaaaatgttaatcctaaatataagtattaaactttcattcatgtatctttgtttaacaagctaactagaaactgtaggtttggtaatctactaaatttaaatcataatgtgctaagaatatagatcacccttatgcaggatttggggatcaccgaccgtctcttctagaaccggattggaagtagaatacaaagtccatcgaactgctccggtgatcatcggtgtagggaaagtagtcatggtagtggtgcggacgaagtggttgccgacttgatcccgaaggggtcactggcgatgaactgcaggatagcgtcgtgccatcgtccttcgaggcgccacctacactaacttagtcctttgaataccctccaacgcttaggtcaattttcccatccgaaactaaacaatgccaatcaaatcatcagtgacaagtattttgaaacggagaaagtattttatatgtctgtaaatatttttacaacattgacataaggtagcagagagtgaggaaaggagtcataaacagtgagaccatggacttattggaagtgccatacatgtgtggtggtacgtatgactacgaaagaaaaggaaagaaacaaaggaccggccagcctcatggtgaagcccaatctgagagtaacaatttttatttcaagtggattagagcagtttgtgtagatgggcttgcctagatttgcaggcaggcagccatacatatatgagtaaatttcactaaactacatatactctggtcaaattatcacaaaactacagatttaaggagatgtatcacaaaactacagatttagcactaaatttctcaaagaactacagatttaagatggagtatcacaaaactacagatttagtaacaaaattatcacaaaactacaggtttagtgtcaattcaatcacaaaacttatgcatttataactcaaatataacactagtgctaaggatttaaattccaatatatgtagttttgtgataactttgttattaaatctgtagttttgcgatactccaccttaaatctgtagttctctgagaaatttagtgttaaatctgtagttttgtgatacatctccttaaatctgtagttttgtgagaatttgactaaagtatttgtagttttgtgaaatttactctacatatattgattgggtcatagattttcagcccaaataatgaatgcttatcttggcaatttcattagtagtttggccagacaggttgggcttaagtttcagaaaacagaaagctgcttgggcttgcagcatctgggaatttttttagtgcagataaaggaaaaggtacaccgaaggtccctcaacttgtcatccagataaaaaaacgtcctcgaaccacaaaaccagatatgcggggtcccttaactatacaaaaccggtcacccgagatcctccagtggttttgaccctggttttagcctatgtggggtgtgggacccatgtgggccccacatgtcagcgtgccacgtcatcaccatccctctctttccctttgtcctctcaggcgacgcgatggtagcgacgacgcgggagcagggaaagaggaggccggcggggggacctcccatcccgacagccaacgcctcgctcttctttacctacgacgaggccacgcacctgctcacgccgccgacctcctctatttgtgtttggcgagtggtgtttgatcgacgtcggtgtttggtggatgccgtgcaggccgagcggatgcgcgcggggctggaggaagcgcagcgacggcacgtccgggcgttggtggcggctgtggcgtgcgccacgatggggagggtgcgtgcggcggaggccaagctggatcgcgcacgctgccacaactcggagctggaggagaagctccgccagattagtgcggaggggcaggcgtggatgggcgtcgccaagagccatgaggccgtcgccgctggcctccgcgccacgctcgactagctcctccagtccccctgtgccgtgactgccgtcgccgccgccacgaggaagggcgacgccaaggacgcgcagtcgtgctgcttcaagaccccaggcggcgccgccgccgccactgccgccgacgcggtgtccggggcgacgtcgtgcaaggcctgccatgtcacggaggcatccgtgccgctgctcccatgcctatgcgacgcctgcgaggccgccgccgccgcttgccccgtctgcaccgccaccaagaacgcctctgtccatgtcctcctctcctgaagtcactcacacgtgctacaccagccagccactgcatggagtaggagattttgatagcgcaacagctatggccagaccgaaaccgggcatccgtcagccaactccggtgtcaagcaaaaagctaacaacaatcatcctgtcccaagttacatggaaattcatgctagggaagccacggttctgtgcatctgtgcatcagtgatctccgggccatgcgagttttgtcagtggaaacaacagttttcggtgcggtggattgaatggttgattgccaatctcatctgccgcaggtaccattgcttcaaatatttggcagcccaggtcggcacgtatgccgccccgtctccccgccggccgctgctcgtcagttgtcctccccatcggctgccgcccgtcccggcacccgttctccccgccggtccccacctgttgacgatgtcccagcgccactccccatccgctggccaccgcgcgctcacccgcctgccgccactaccgctccgcgcctccgccgtccgccgctcagcctccctcgccgcccggtcgtctgctccctacccgtcggccggcctgcaagagaagagtgcgagagagagaggggggagagagagagagaggggaccaggggaggaagggagagaagaataggggaaaggggagttgacgtggaacgctgacatgtggagcccacgtgggtcccacgcgccatgtaggctaaaactgagtcaaaaccaccgaaagatcttgggtgactggttttgtatagttaaggaacctcgcatatctgtttttgcggtttgaggatgttttttatcccgatggcaagttgagggaccttcggtgtactttttccgcagataaacaacaggggatttacatgatgggcctccatttgcaagcccacaaaaatctagtctcaaattaattgctctcactcacacagagagacagtgaggcctcagacctcagttttactcactccgtactaaaataagttaatctcgtacaagagaatgtgtcacatacactagattcaaaacatacattggtaaatgagcagaagcaaaagggtactttaaataaaattgcctggataagaattgggctaagctcaaggaaaaacacgatcgtcatatgctagctctctcctcaactgcatacatatattgacatttactccctccatcccaaaatgtttgacgccgttgacttttttaaaaatatttgaccgttcgtcttattcaaaaaatttaagtaattattaattcttttcctatcatttgatttattgttaaatatacttttatgtatacatatagttttacacatttcacaaaagttttgaataagacgaacggtcaaatatgttttagaaagtcaacggcatcaaacatttagggaaggagtgagtactagataatttgtttgtatgtgttgtagattaatatgccaagtaattgtagtgattaaatactagccagcatcactacgaccaagaggattgtatcaaaataaatgtgaaagatatgcagcaaatcttcaataatttcaggacttatcaaataaaaaatccaccatttatcaggtcattctactaaaatctacgattgcaaaaaatcgtaagacttcattacttgtatttatttgccactccatacatagttcacactacagcttcagcattgaattctcacgtcatatacagcagtgaaatttgaaaatatcgatctgaaccgatgtttaatacaaggttttgagaaaaataaacaagcggaataagtttgttgccggctgattccctcatgaaagtccacctgaaatttaggaaaacaccaaaagtgtggcgatatatatagtcatgggtaatgtgtttgaaaatttcatccaccaggaatttgcactcgaccttcgtatctttgattatgtgtcttacatgtgttccgcaggtgtgtgagtgtcatacatgtttattttcttgtaatgaaaaaataagacaatgtaggattcaatttccaacaaaaaggtaacattattcatagatttgccaaattcaagtgtttttctttttttttaaaaaaaaaggcagatgtgctactaccaaacggatacgcatatgcacgataagcttgcccggtagtacgactcactaattcaatggtaattttgtcgccaactaagctgcaaccctgtacattgctcatttgtcctatctatctttacacacaaatcgcttactataactacaaattaattatatttgcaattgagcatcggttgcaaccctttacctaactcatttcccctacgccggcaaggcccacggcgtccacttcgagatgaagggaaatggacaattttaaattcaaatatagtacacaattgcaaatgtaaatatttcaaacgaaaactcatatttgaaaatgcgatcgattggtataactaaaacaaaatgcatgtccccgtttacaattccaaaactgcccaacaacttggaccgaattattcaacaaaaattattaaacaaaaatgtttagaccgatcgagctttttttttcccacaagtttgaataaattatgagagagaatttggcgaaatcaggctaaccaaacatgtttagcgtgacagacttctcctccctccggttcatgatcaacgagccgagcgcgatgagatggcttgcaaacttgatcccttgctcaagcggtgccaccatggctactggggcgcggaacaaagagcctacacgagccaactccggcagcagctccgccgaggtggccatccttactgccttggaccacctgagcacagcgagcctgactgctctgacgcggaacatgagcttcttgacatcggcgagcctcatggcaccaccaaactcctcgcttagcatctggagagtcacctcaccgagccgccccttgagacggaggtacctcctcacgacacgggcagtgaagtggtcctcattcggtgcagaaacatcgccgtcgctagtgctatcgacggtgacctcatggcgctcgcctgtgatggggtggacggcaagcacgttaactatgcagccatgtcgttggtggacgtcccgagcatccttgagcagttgctcatagtcctctttgaatggcttgatgctcttgacaatcttcaccatggcgtcctttttcccggactatttcatctcaaaaaacaaataaataaattagctaaaaaaggttattatgagatgcacattagttgcaactgaaataagtgtttttgctcattacttacgtttctaactagtgacatgtacacatatattctctcaataaaaaaatggacacatatattttgcataagtgttctactcattacttactttgctaactagtggcatgtacacatctgttctctcaataaaaaaaattggactcatatatttcataaggatgcaaatggattggccgtactttaccaattgtcatgtcaatcactacattagtaataatattataataaagaccttggtatagtgaccagcaatttagcagtttttctacttgctattattattctagaataaaatcatagatctgcggattgcatccaagaatcgatcaacttctcactagccatgaaaagaatattttaactcgtaacgactccacagtgcctcttgccagctttgtttcaaaattaggtaaagctatatatatatatatatatatatatatatatatatatatatagacacacacacaattgcatgaatgatgttcaaggaagcgccagtaccaatctacgctattgatgcactgacaaatgtttagagacaattgagaaactacattacgataaaagtttgagggcgaacatacctagcgatgtgaggagagatggaggagccgtaggtcgaagattttacaaggcaagatcaataaaaaagaattgacaatgcaatgagttgtgaggagagtggaagagaatttatagcgagggagaatagaaaagggttgacgcaccaccgaaaaagacaaaactagttaattgaatttaaaatcaaatctaattcgaaaaaaaatcaaaaccatttaatatgatttaaaatcaaatccgattcaaatctgatatttaaatatacaatatggaatagttttaattttcatacatatagataatgtgatatcctgagcaccgcggtaccacacaagggttggggtaagatggagaaaaggctaaacgacttcataatatcatatctacttctcatagcaatggacggtggatgaacatgttacagaaatggtccagagctagagaaacataatagaaaactaattctatgacattcgtgccacgatagtcaatggctcccgtgacatgaagtggatgtggaaatggagccagatctagaacaatacgtccggctcaaatgccaagggttgtccttcctcggcacaaccagcgacggtcgtgccatcgtctttggcaacatcgtgccaccaacatggaccatgggagataccttccaaggcaatggccaattacatattacagtacagccagtacacaattacaaatgtaatcattccaataaatttcatagttgaaaatgtgatcaattatttgtaataactaagatgtaatcactgtctccgcttgcaattctaaaaccgtccattaacttggaccgaattattcaacaaaaatttattaaaacaaaaatgtttcacccaatcgagcattagagctatgatgaatttccctcaagttcgacgaaacaatgcgataaaattttgtgaaatcaggctaaccaaacatggttagcataacattcttctcctccctccagtattcatgattgacaagccaagtgtgccaagatggcttgaaaacatgaccccttgctcacgtggcgcctccatggccgccagaactcggaagaaagagcctaggcaagccaactcaggcacagcttccgccacggtggccatctttgactgccctgacacatagcttcttgatatcagtgagcctcatggtacttcgtcgagctcctcacttagcaactggagagtcacctcaccaagctgcgccttgaggaagaggaacctcctcactatatgggtggtgaagtggtcatctctattggcgctgacacataatagttgttggtgttgtcgacgataacctcgtggcacttgccggtgatggggtggatggcaagcgcgttgactatgcagccggttcgctggggaatgtcttgggcatccttgagcagctgctcatagtcctctttgaatgacttactgctctaaacggtcttatgtgcgcattaaatgtaacagagcactaacaattttactcattattattcttactaatcatgtatgtatgtatgtatgcatctcatgtataacacataatccatcatctaaaaaaatgtatagcacataaattggtacttttattctgattgcgaaaaaatagactaccaattcgattcaccaataactatactagaagggagtgtataacacattatttattatcttaaaaaaatgtatagcacataaagagatactttttattttgattaaaaaggaatgtatgacacataatccactatatttaaaaaaaatgtgtagcacataaagaaatatcttttattctaacaagaaaaaataatagattgccaattcaattcaccaataattatcctcagtatgacaactagagatatagtaggctttcttgttgtagtcatttttttcaagctatttttttctcattgctctgcccgattgcatggaaataatcattgttgaattgattgactaatttggccggtaattaccatgaaccaataataaatagcacggcggtgcgtgcttggccaacgtatttctgaaaatgggtcatgttataactcgttcttcattacttggaataaataagttttagttttaggtattctctaattaatccgaagtatcccctaaaatgctatatatggtcctggatatgaatggtaaatttgcaaacgactttcgaatggtatttagcttggcgatctgactgtcgaatgatttttacacttccgttggctaattaatccgaattatctcacctatgaatggaaatttgctaaacgtttaaattttaaaattgacaatttaaccatgtttatgccattagtgaacataaagatgcacgggctactgatggattaacggaaccaaaggttgtcaactctcatttcctttactagtaacaaaaaggcatgttaatttggattggtgctaatatgtgccatatcaatattttgctagtttcaatagtaatttattggcatttggattgaagccatttttttaccaagctataggtctatagctagtagcaaatctacactcctaggtagtgccaaaacttctgcttttggcactaccaatattttggtgggggcctcaaaccaacaagcccaaatagccaaataattttgctaaaaacataccaccatattttcaatagttgattttagtaaattatgttctttgtcattattgctatcttctcttatatgtatgtaaatatgtttatatctctgatatcttttctttcaaatatgtaatgaattatttttatcctaattctcccttgcatagtgtgtattggaatatgtagtgcgcattgcaaatgtttgctatatatttacattgtaaaagaaatataacagctttgtaatgcaaaatgcaacgtagctacaaatatagttagtccccaagctacctcaacaacaacaaaaagggatttccacgcttgaatatacttatatactaaaacgttgaactgggctttaaataatttgggtgaaactacttatgcatcccaccctcttcaaactgcagcgcaggacaacgatatacatagaccgagttgaaacaaaacaggttgaacacttagtaaatttgcagaagaagtggaatttgttttgaaacaaaacaggttgaacgctttgtaaatttgcacaagaagtggaattcgttttttctgcagcagagctagctttgcatgcataatggaacgtactgtaggcgcaatgcaatcatggattagctctttgtgtgtcttcgtcgaattttggccgaagcttgtagtacagttttaaggctcccactaataaggtctgatcctggacatagttaaatttatagactgtaaattttaaaattgacataaatatttgagaaagattatttttttagaactacacagtgctttttttttcaattgcggtagaccatgctaaaattttccaatatatattatcgaacgttgtcgttcactacagacctacaagagaatatataagggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctagtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcaatatataatgggccaacgaaatcgagggctctagtttcctctgacaaataggacgcgtacttagctaaactaggaaggtagcccgcgcagttgcgcgtgcactttatttgatattgcttgaacttttattacgtactttttataattgattgtttaagggttctacttttttctttaaaaaaatctccaaagccaatattgtttaataaacatgctctatttgcacaataaagctagtgccctctaattggttaggcttttgttgcatacttatcgcagtgtaatcatctaagaactcaaaaatgatgcaatgctcttatgctaatggttgttgtagtttaagtgaaagataagaacctatttcttctatgaattttataaggtttttatataattagttctctttactccctattaagttttgtattttctattttattttatataatattattttcagctcaaattttgtgagatgataggatagtgacagagcatgataccttatatgtcaacctattttaaaaatatgaatcaacttttgtgtaaacatctaatactaaaataggttatcgtagtttatttattcatggattgaggggatccaaaactatgttaaatacatattcttgtagagtccaattctattgtgcagtgttggagacaacccatatgggataatttcatgcaagtgtgcgaggctagcgagaacacaattggatggcaaaatataacaacgaacatatcattatttttggaatgccattttttatgattgttcccatgatttcattttttataaaatttatagttaaatattaggaattatgtaataaaaagtaactaacccacaaatattatgttttgctagcctgcattgggcatgaattaagtacaattagattttataatcgtttatctgaaacctataatgtctatccacttgtcataattatcacatattctataaagttgtaaaagaccctagaaaatatgtgtttaaagatcagataaattatttgaaagctttttgcatttctagcatggaatttgtttggttactatacaattcacttgcaccttctaccgaatatgccatatgatgacaaaaagtaaggcctagctggacttaataggactcctcttatccttttttgatgcattattcttatctcattaagactggtctatcactctctccatggttggctttctctctaattatagtccgcgcaagaaaatttttgggttccaaagtctaaacaaatacagtgtaaaattcgtctatgtctagtagacgacaattgtttggtgataatggttttcttgcacctccaagtcatcatgttacatggttgtaaaacttgtatagatgttgagacatggaggttgccatatgatccattgcagtggtgtttacagtttcgatcaagtttagttaatctttcttttcatgtctcggtgtatcgtaacatataaatggattccaaacttaattcttcaagttaatatatgaacagcgacatgtttatagcaagttaatgtccatatatagggatgacaagatatttttaatggtttgtgcacagagaaaacatacatttgttttcttacccggaaggtatggaatagaagcacatagccaccggccgtatatctatgtaccatatactaaaagaccgttaaataccttctaataaagtcatttaaatggtaccatagaatatattatagagcacttacgtggaagatcgtttggcactcttagattatttattatttgagcacattttagaaaattcacgaagtaattggattgtttcctctaactgttagcgcttcatttttcaatcaatcacaaataaagagatagaattataattgttgtggtagctagagccaaaagctgacctaacccaaatatatcattctggatatgtattggcagtgaaaacataaattaaaccaaatatgttattctggatatgtattggtagtgaaaacatatattaaacaacgattgtgccaatataaagcccaaggactattgaatgtatgtacatacgtacaccatcgccaaaccatccaccccctccgccctcattcacgccctccccctcctattgtctctcatgttttcatcatcttttagttaggagcaataattttattataatcgtttaaaataaatagctattttttatcgccttatgtcgttggacccacattaacaatatttcaacttctaaaataaatatgttattttaggtttatattcttgtcgacatttgatgtcgcaattctggtatttgcatagtatgaggatcgtcggtgctaggatatacgtgagactgaggtaaaagagatggggacgaggatttttatacaggttcgggcccctaaattatcaggtaataaccctacatcctgttggccggagccgaagttgcttttattcaccataatcacaccagtacaatatgtggggtagcctatctaactgttgtcgatatggcggtctgacgatctgactcgtagtcgacaacagggtagccttcctcctcgagctcgcacccgacgaaattagagacagtgctagatccctgcggccggcctctgaaggtaccggatagggtcgatccaggcgtatctctgatgtcaatatccggcggcttgtcttgtcgtatgtaggcttctatgttgattgtgttgggagttgattgtctcgtggtgggtgtgtgtccccctgtccttctaggggagcttgtatttatacccataggtgtccccttgtccaagtagaactagggaaaccaatatggatacaatccgagtagttcttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacaattctgacttttttcatatcatgtaaacaattattaaaaaatgtgaaaaaaaaaccaatgatatatattttactggttgaaaatatttttggtgaattttcttcccacctatgtataatgtaggctttattactattgaaataccaaccaaatagcttcaaaaaattccaaaatgatttgagaatgttaatctcacacgaattaaaataaattggatctacttttaaaaaacacaactaaattacgtggtttgaatttttacatagttcaaattacctttgttaattgttaagtaatatttgataacataaagtatacagactgatgtgattatttttgaaaaattgttatggaattaattaatgcatgtcgtttgataacataaagtatatagactgagaaagtatatagactgaggtgattatttttgaaaaattgttatgaaattaattaatgcatgtcgatgtcatctgccacaatgtattttgtgctaaaatatagccaacataattacgtatttttattagtaagatgaataaagtcaatagcaaaaaatattaatataaaaatactgtaggggtatcctaggtaaagaaaataaaagtgaataggaagtgaaaaggggggtggggtacgtactacctacctacacacgtacgtgtgtgagggagggaggagtaggtacgtgtacctaggaagggaggagtatgtacgtgcagggagaggagaggaattataaacggttgttttcaatctaatctagtggtgtaaaataatggacccaccagtgtaaatgaaaatcgagggttggatgtttcccgtctattaaaaggacacgtggcggtttaagaacgtttgtaagggtgccacgtggcagtttaaaagcgtttgtaagggtgccacgtggcggcttaagaatgtttgtaggaagtttaatggacttttaatttataatagatagatagatagattgatagatagattaggccgtgccatcacagcaaaacagatggattttcgcacttgaatacaatgcaaaaactctgacctgttttgtgctttaacgaaagaaaaaaaaactgtacgtgcaattcaatgtatagccaagcccaacaaaacaaagttcccgtgaataataacatggagaaaattagcagcacttgtactacgttcgtggcagagagtattcatgcgtgcttcatgccaagctagctgctgcatccaactaacctatgtatatatctctcctcttatatatgtcgaatcagttcaggtaatgtttcaggaaataatctgctagtctcaaatcatcaatcgccgtctggctgaaagtagggtagaactattatactggtaaatcgtgaaggaaaatgcagctaagccaatctgcgaaggtgagtgagatttttggagaaaaacaaactaattatgccgtgcagggacggcctagtggatgttggtggcgcttcacggtggaggttccgcgacaaccctaatgccaggatctcgacgaccctaatgccagggtctgagaaaccgtcaatgtaatatagtaattgattagattagattagattagagtgtttcttgtccaatttctgctgacgctatagcctttccttatcgaacatctcctcgtgatgacaatatgctcactagtgaaaattcgcatgctttactagtgcgccttgaacattcgcatgctttattagtgcgcatttgtcctcaacatagattaactaacaaagtgtattaactaattggtgcgctacgagcatggtatcaccaacataccaaaatggtgtgagctaatgtatttattaattaattggattgataaaccatgtgataaattgtcctatgttttgatactgagggtaaatttcaaacattttaaattgacaaaaatttctctattttttctgaggactcagttacaaaaacaacggtaactacaccgactgggcttgccgatagtacgaaacagccaaggcaatccactctcgactaatctttactgtcgaaccaacttcagttgtcaccgaccaatcttctgatccttatgattgatagtcaccacccgcgtagcatagcagccatcatctaatcgccaatggctaagaccaaaagcaaaacaaaagagctagcatccatagttggtgaagcactaatcacatctattcgacagatcgacgctggagttttaatttgacaggaacattagaagagacttgaatttgttttgttagagagtttgcatgcatgaaaagataccgaacatgcagtgttgtgtgctagtactactagctaatatctatatagtggactggaaactatgtatgcagccatgccatgcccagcaaaaacaaagttcccgtgaataataacatggagaaagcaacactcgtactgtacatgatcagaagtattctcatgcaaatgcaattgcaaatttgaaatgcatcaatctgcatgaaactaattagcctatatatatcttctcgtatcttatcttctcttctctaatcgatcttctgtcgaatcagttcaggtcaggtcttgaaatctaccatctcacggcccgcatcccgctcgccgtctggctgaaatagattagcactgttaggtctgctgaagaaaccgagtgagatttttgaaagaaaatgagtgagattttttaagggccgcaaaatggttaggcaacgtggtcagtgtgctcattgaaagaaaatgatttttggagatgaacgaaccacttacaagcataaacttcttttatcgaccatctccttgactacggcgtcagtgtgctaattggtgaagactcgcatactgtgttagtataactttgtttggaactccacgaacgtggcattgccaacactctaaaatggtgttagctaatgtatttattaattaattggattaaaacattgttctttctcgctcgctaaataatttcgtatgtaacatgcatatatttacaaatagctaggtcttgatatagagtataaatttgaaacaatttaaaattggcaactatttgagcaaaatttatcggtttttctaaggactccatttaccaataaaccggcactaaaccgggctccaaacgtaacatatttcctgaatacacactgttgttcacaaccttaactagggaatccacactgttggatttgatgaatgaggaatgtaacatgtaagactgtgttggtgaactcaatacaaaccacatatgtactggaaactaccgttaaatccaaaaatgaacatctaagatttgttcacgtcacccagagtaaaattttacttctggtaaaagttttactaatggttgaacctgagagtttttttttttttactctgcatgacatggatccaacaatatgtgatttgcattccagattttcattccatatgtaatttgcactgtatattttccccccttaactaggccactagagtataatgggccgggatactgcacgaaggacttgctattgatgggctaacgtaatcgatagctctcttgtttcctccgacaaactagccaaatatttcatgccaatacagtaggggattgtctatatatttatcgataaattttcttctaaaagtttgtcagatgtaaatatagtataattacattgtatcttacatataattataatgtaattggtatgtaactttcgtgtaatttttaaactgttagatttactttcatgtaatttcatgcaaaaggggaagaaaaaagtcacaactcacacaaaagtgaggggatttggtctcgtgacctccgcttcatgaaaatagcatcttatcgtaagatttttcaaagttacatataagttgtattatagttacatgcaagttacgatgtaattacactacgattacactatatttatatctgtcaaatttatttttgagaaaaaatttgtcgacaaatgtatagcaaaactggcacagtagaaggattaattttcacacttgagtatactaaatcgctgatcactatgtcttaaagaattttggtgaaattcacgcgagcgtcaaccctgttcaacgtggtgcagtgcaggaagatgtacatatataggctgagatgtaacggaataggttgatgctagagttaatttgacaggaacagtagaagagactagaatttgttttgtttctattctatgcgacagagtttgcaagcataaaagagacgtgcctagtggaaactatgtatgcggccatgccatgcccaacaaaacaaagttctcgtgaataacatggagagagcaacactcgtaccatagcagaagtattctcatgcaaatgcaatgcatcgatctgcatacaactaattagctagcctagctatatatatcttctctgctcgatcttttatctaatcagttgagatctcacgaaatctacgatccaaggcaggccgcccaattgtagtttggctgaaatagtgtagtgttgttagttactggcttacccgttgggatagtgagtgagatttttggagggaaacgaaatggttaagcagaccggtggcagtgttgatgtgggtgtcatggtgctcggcagtgtaagagcaacccaataactctctgtttggctcttcaaattaaaatttaactaacacagagaaaaagggagttccaacagcctctccatccgaatgaccgagccatccggatggccaaattgtttctccggttggccaaatgtagccagcctcctccactggccaaaggtgtgtcccaccaccactcccatccccatccactctctttgccggtgacgaaccgaaccgagggcacgccggccacgagcgcctgttaagattaagaattgactacaaaacggcatcggcagtcgctcaaatcggctacggtgatatcgactactgcatatctgttgagcgctggcctactgcatatctgctgagcgctggccatctcgaggaaggtggaccctcaatcgtcgccgggtcagattaaggccttcatagctattgccacataaggattggagttcggcaattgtacctattaattagggcattttctaatttccttagagatatattagagatatattggtaaaggcccacctgaaagggtcattcgtattttaagttatgttaagagataagagtcgtgtccagcaaggatataccatgtacttcgggtataaatatggcccgaccccatgtaatcaaacaacgtcagtttaatacacctcggcgcatcgccacccttttacttctcattgttctcgacgagtttttcttttgagttgggctgcatcaggttcgatctccgacgaaatggtaaatcttgtcatggcggcttgcgctctcgggattagcgcttacatctttatgacactctaatcctgtcttcgcaagcctccgagttatcatatgtatcgcataatctagatcgatctcgtcatctgagcttcatcgtctagcctctaccatctcgaatgagctttcaacggtttgactagatctcttgcctctcttcacgcttaatgctgcattggttaggttcgatctattaagtattgtcctgaggcttttcatctaatcttttctttgacggctaatagagatagtatctgggtttcagccgatcttaccagatttagtcgttttacattcctttttggttataaatcatctagatctgccccttatatcaagatcccatcctcttgaagtagatcaagctcttgttgatgcgaaaaacatacactggcctggaagatctgcttaacttcagtgcaggtccaaaatcttgcttttaggttcgtgagcgtgccagttgatttgatcctgcaatcaacaagaaataaagacaggaaaacagcggttaaatctataaacgatagccgatcggccagtcgccgatgacgtaacatttatctttgagccgatgtcatatttaagtcgatcggcagtcataaataaataagaaagaactaaatctattcgatcggctgcaggtattaacggtatataatctttatgtcgatatatatttaaatcaagtgattgggatagatcggtcgtcatgccaagacagtataaaccacttagattgaaatatatattaacgagaggattataaacattcataacatagacaatcagatagatctagcatttaccgactaatactctgataccactctatattaagatattaaagcaggcaaaatatatcaaacaggaagcctaacatacctagatgcaacaagatcttaatataaagggtagatctagcatgtcaattaagcatataagatataaggctaaattaggtaagattggctgaaaccctgatactaccctaatcggcaaccaaagacaggctagagattaagattctaatcacgacttataaggtcaaacttaactgatgcagctataagtatgaaaagaagaacaatatctagataataaagtcgttggatgtttcatagggtagtggatatcctatataatctaaatcaacgttgatatttaacctaatcagttgccttccaacgatagatgttagccgattgaaggttaagcagcaatattgtcgaagattatataagatatatggtaactcgacgaattacataaacaagattagagtatcataaagatggaagcactaatcccgagaacgcaagccgtcataacaagttttacctctgattgaagatcgaaaccgatgcagctcaacccgaaagcaagaactcgtcgaaagtaaatgaaaataaaagggtggcgatgcgccgagattgtattgaacgtgtgttgtttgattacatgggttcgggccatatttatacccgagatacaaaatatgtccttgtcggacacgactcttatctctaacaaactctaagataccaaaagtctttgtggtagacttttgcccaaacgtatctctaaggaaattacataaaatatcctaattaatagatacaattgccttttcaggactcaatccgtgcgtggcaatccaattgaagcacattaatgcaacccaacaacgtgtaccgagtcacattatcgggatcggcttaatcggctaaccttgtccgactcgaactctgccaatcctggtcgcagctgattcggactttagccgattcttgcactgtttccggaacgatctctatcttggattccgcttcggctttatctctatctccaatacttgaattaccaaatttggttgttaacagctccctagtctctagattatattgggccaggattcctatatttcatctgtgcttatctcggtataaggtggtatcggagtattagccgatacaggttgggttcgctccatcggctatgctgtgagcgtgcataatcccttcgttggagcatgtttagatatggagcgatttatactgtctcgatgccaccaccgatctatctcagtcgctcgatctaagcatgtcccgtctaatggattacgtgtcgctgatatctacagccgattgagtacaccgaacaatctacaagtttttacttgcccccgccgatgcgatccgacttgagttgcatcggcgtggcccccaacgatatgtcatcggcaattatgccgatcggctatcgttgacagatttaactctttgttgtttccagtcttgttggttgcaggatcaaaccatctggcacgctcagaacctgaaggcaagtttcctggacctgcactggagttaagcatatctcctagggcgctgcgtgttgatttttcgagtcaacagcgccccaccaatgtcgtcgtctaggccaccgtctgccgtcgcagtcatcgttgtcgccgtcgcgccacggtcacgcacgagctgttgccgccgcggggagccgtcaccatctgcatcgccactgccgcgcggggagccaccgctaccgtcgcctccgccgctgtcgccgcccgcctcgcgcgctggagccaccgccaccaccgctagatcgatgggccaatgcggccatgcgggagaaaagaaagggcaagagaaagagaaagaagaggaagaagaagggaatggagatgggaggatgacatgtggatccctttgtgattttggagatgtaaatagagagactgttggagtgcacacctagtttgacttcccaaatcagttggagagttggttaaataggtattcggagagtttaatttggagatgctctaagctaactaagctatgactcaacttacctgtggattgaaccagaaaacgagcctaactacatgtgcttcttaaattatcgcgcatatgcatcttagctactcatcatctctttgacgtgctatttatgtgattttttatggtgcagagttagtttgtaatggagatgcctcttgctatacagagccctttatgtgattttttttgggcagagttagtttctaatgaggatgacctcttgccatagagagctagtcaaaccaagaattgctaaatagtattgtatagggttaattcaaaaacgaaaagtccatgttttaattcgttttttatactcaatgtaatttactccagccatattttctattcaatatgagatgttcccattgataaggctatgctatagctcctgcacattgttaaattaacaaaccgtgtaaattttaaaattgacataaatatttgaatgtttgagaaagattgttttctccattttttggagaactcagtgctaatttaaaacctacaaaatccgtccccatcgaaagctgttgttctgtaacagacttgcaaatataaagaatataatgggctgatattagcttggtattgggctaacgaaatcaaagtgctatcttaattatgaatatacgaaaacgcgcttaaattatgaagacaaagtccgagacctaatgttacaggtttgacacttagtttgacaggaaccgcagaaacatagtagaatttgttattgtgcggcggaacttgcactatgtcttgatattgctccgataaaaaaaaaaacagtgcactgatattaactactgagggagccaatatatctggttttaccggtaagggaaacaaattagattcggtgtataattcaaggagccaaaatggactttttgcatggactggctgctacagaatataatgggccagaattgacttgttattgggctaccaatgaaacaaaatcaaggtagtcctctgacaaatactagctaataattatatagttatagtactcctagctaaataaccaaataggccgtgccatcacagcaaaacagatggatttttcacacttgaatactacctccgtcccaaaataagtgcagccatgagtttacgcgctcaactttgatcgtccatcttatttgaaattttttataattagcatttttgttgttatgagatgataaaatatgaatagtactttactcgtgacttatgtttttaatttttttcaaaaaaatttaaataagacgaatggtcaaagttgggcgcggaaaaccatagctacacttcttttgtgacagagggtgtactatatacgaaaacggtggaccacatcaactaaagtgatttaacgaaagaagaatttgggtgaaactcatgcgtacgtccagtccaaatttaactcctaaaatcatgcacagtttggtttgcccccttgtacctgcatctgcatgcactacactacaggagatcgagggtagacaaaggccgacatggaaaggaacagctagttgacatgacttaatttgacaggaaccaacagaaagagagtggaatttgtttttgttcgacagaagagagagctctcacgcattgcataaaagagaggccgtacgtactgtatgtatacgtgtagtagtgtagtgtactcccttagtagtatttcctccgtttcacaatacaagtcgttctaacattttctatatttatattaatgttaataaatctatatagatatatgtctagattcattaacattaatatgaacgtgaaaaatgttagaatgatttacattatgaaacgagggagtactactgtatgcttttggcatggcatgtgcaacaaagctaagttcccgtgagtggcatgcatggaatggatgcagtggcacggtcacatcatcacttcacgccaaccatgcatctgctagccgctggctgctgcatgaaatgcaactaacctttgaatcatcagttggggtcaggtctcacaaaagctaccccttggctcgccgcccaaacgcctcgccggccggcttagctaaaatagtacctactcctgctggaatgtacactaaccatatatcctaagggtgagttttcctaagggtgagtttgagaggagaggaaaagagaaaattgaaaagatacgtaaaacaaggtgagccattagtacatgattaattaagtataaactattttaaatttcaaaaatagattgatatgattttttaaagcaactttcatatagaaaatttttgcaaaaaatacaccgtttaatagttcgggaagcgtgcgcgcagaaaacgaaacaaactaactcacaaacttctcccgccgaacgctccctaatactataaatataaacaaaagacttagggatttggttcatggttacactttatcacactactcttttacctaccacaatgttttcttaggtatgtgtttgttttattgtcacagtagtggcttattaccatgtttttttcaataatatgtttgtcacgtcatagttttaattttctcgtcaactttgttacaccctgtggctcgtaatttataacttatctattcttagttgtgatttataatactacgatatactatcaaattctatattagattagtagtcctgtactaatggtaaaacaaatggtggaggcacatggagctgagtgacctcgtggtgctggcagcagagcagctgcatgcatctgctggtggtggtgcagaaagtgagagattttttaatttgggagggaaacaaaatggttaggtttgaccggacagaccggccggcagatcaaggttggagcgtgcctgggtgttggagccaacaaattaagcagaaaatggagtccccaacaacggaatcaatcggaatcccaacgcaagtgatggagcaacagtggcagtgtgcattgtctgtctctgctgcaggctgcacgatgacaccaatgccatcaagcgatatccaatccacgattttgtgtgatttaatatcgtgccaacacagagggaccagcttactgtggagtagttttctttttctttttaagccagcaaatacaactctactcgtattcttatagttgtcacgtgtactctctccgtcgcaaaaaaaataatttaagtgagaatttgacgcaatctaaaacaacgttagacaggttgtcttttttcagacagatggaatacttcatccgtactaaaataaaaataaattagtaatttatctaagaatagaaataatcaaaaccaggatatgagtgtgttttgattgaaattttgcaggcgtaatgagctgtagatggtgactagagtttatattactggttgaccactaaatttcgaatcccatcagtatcacggttttcaataaatttcgaccaaatctactgtttaagtgtctgtttggtacagctccaactcctaaatttagctccagtagttgagtttaaagtggagttgtggagctgtctaaacccagctcacaactctagtacattttgtgagagagctccatccaactccactccgagttttagtggagctgaaactgtttggctgagctccagctgaaactttagctgtgacaaatagtctctaacttttaaaattccaatcgaacaaaacttcgaaatttcgcagaatttgaccggttcaccggaatcgtgaaccctgaggagagtagtagtactccgatagcggtgaatacagtgggatgattgaggtggttggattggacgagacaatgacaatgagacggacggccacgtcagacgcgtgatcgagtctggctgcaaccacaatgccaagttggcggcagtcaggcggtcggctaccgtacgtcgtcgtcgtcgtcgatccccgcgccgccatcaatcttttgcctcgtttgccgcgtcgccaacgcatgctattgctacggagtactccctccctccgtagtaaaaaaataaataaataaactctagtttccgtttccaacgtttgaccgtccgttttatttggaaaaaatatgaaaaaaaaattaaaaagacaagtcacgcataaaatattaatcatgttttatcatctaacaacaataaaaatataaattataaaaagttttcatataagacggacagtcaaagttggacacataaacccagagtttgtcttttattggaacggagggaggagtagtagagtaattgagtttaattttttcgcgaatacgcaaaagaattgtcacgagtacgtttaattaagtgatcactactgtattatcgagcatatatgcaccagctggtgagtcaactgtcaacgtgtagggggccaaataaagcagtctctccctttttgcatgctttgtttgtttcagctagcctaatgacaatggataggagacatactaggatttggattgattagtttttgttggattactccctactctgtagcgagagtgtgagtggagtactagtgtactccctccatatgacacactatccgtatgacacccacttttctttgctcaaaactggactggagcaagttccccacatgatcgatctactgcatcatccatatccatatccatcattaaactcccagccggccccatcgtatcattaaccacgctagctgtagtacaaatgccacgtgagtcgctgcaaaacatgcgacactacccacagccgtccggccgggccaccactggtctggccacacactctgcatcgatcgatcgcccatgcttgatgcttcaattcccagctaagttacccagatacggggatacgcgatacatcggtacagagatacggtattttcctaaaaacaaggatacagggatacgcttatatatatatatattaaaaacacacaaaaaattaaggaaattgtatttatatatattaaaaatacaaaaaaatcaaggaacttttgtaaagaaatagcgatataatactagtattagtgtagccgattccatatcaatattctgcaattttctcttctataagcaattcaaattaagaagcgattaagatccccaaaaccaaagattaatagtatatttcttgatgactttgcatcaacattagcagccgcactaaccagtaaccactaggattgctagatgcactaccacttgtatctaacaaaaacggtagtactttgtcctaaggaaaacaagaaaggcacagcagattcaagcatgaaacttttgaagagaatggattacccagccaggcggtcaagcgaagaaagaaaaagttttgccgtcgaggttggcggcgaaagaggtgcgccgccgcccagcagtggcggctctgccgtctcgcggaggggacgttgtggccccacgcgcggctgcagccggcgtccggcggcaacgccgggcacgcacgagagacatcagccatcaggttgggccggatctcgtgcggcggcgcatcccagatgtgagcgaagacggaggaaggtcgtgggtgtatcgctggcgtatctcgatttatttatttttttggaaatcgcaaaaatatggggatacgtatgggatacgtatcagagcgtatccgatacgtatccgtaaccgttgccgtatccgatacggatacgcaactatgcaggcgtatcagggtaacccagattcccagtggcatatgcatgtgctgatatgaccataataatatccatctcctgtccttttttctctcttcaagcgggcgggacgtacatatcaccaccaaacattgctacgcgctactcttttcatatgaaaagaaatcgaaaataagatttaacgttattatctaatacaataaatctggataaatccatataactgaataactgcatatagtacggtagctgccccaccatctccattcgcctcaaccagtacagtcccatcgatcgtccatccgatgttttctcttgctacggaagatcgatcggctgcgatatatatactcctactagg

SEQ ID NO: 74808 - DNA, 971 bp, Oryza sativa
aacattatcattcattaaagatgattttaacagttgatttatatgagttattatactatatcactagaaaactagtattctgttgtgagtagttataaggtggtaggctggtgaccgttataaaatacccctttcgtttcactatatagcgacctaggatcagattaggacgaatcagtatctgtaccctgcagtaccgtcctattttggatatgtttagttcacgccaaaattagaagtttggttgaagttgaaagtttgtgtataggaaagttctgatatgatgaaaaaattggaagtttgaaaaaaaaatttaaaactaaactcagcctttagtagaatttgatagtggcagctaccacttccacttgtgcgtgccgtttcggacattttgcactgcagctttcaataccaagcccgaacgttgaacggaaacagcggatgtagtactagcaaataaattcgggcagatgagcaccaataaatgggtcatcactcatcaatcttgtggtaatctgtttggccttcattgcactctcaatgctctacagaaaagaactgaaggcgtttggacataacaatacacatcatcaacatctcgcgtacatcctccgtcccaattaaaactaactttatagctacaaatttatagctaaaagttaacttattttaaatagaggagtaagtgttttcacttgaaaaaactcaagcttgtcaagttatcattcttatgtttggcctgttgctttgtggtcaaaatattgggtcgaatcatctattactactagcattaatgtggctccttaaatggtcccttagagagcgattgttgcaggcgagagaatttatatctgtccgtaacttaccgagagtctcctccaaaaaatcaaatctatagtactatctttgttttaaattataagtcgttttaattttgatcaaaataaactgcttcaaattgggctgcagga

SEQ ID NO: 74809 - DNA, 2040 bp, Oryza sativa
ttcctgcagccccgtatcaacacctgaagaaattacgccacatttaagcattcttagcttcagaaatctttgctatcgtgcgtgcaaaattgacaatctaccaacactggatttcgttattctgatggttgctaatccaatagcgcatagaatggttgtgattttccgaattattactgcaaacaatcgaccaacctgcacattgcgatccttccagaacgcagggtcctcatcgagctcgaagtgcggcacctccgcgggcacctcggcggcggcgaggtccctgagatcgaacaccctcctcgacgacgtcccaatcgaggaagtccgatccctaaccccagaccccgcggcgcaggcggcggcccggggcgtgccggccagcgacttgggcgtgaccggcgctgaccgggggttcctacccgggtccgcgatggccgcgagcggcgacctcggcggcagcatgaacggcagcgcggcggggccacccaccactgaggaggaggacggcgccgccgcggcggccaggtcgtcgttctcgttggtctccgcctccacgcggcgggcagcggccctcgaggtggaggctcgccggccgccggcgccgtggccagccatggctgcgcggaaactgagtgaggtggccaggtgggggagccggggggtggtagagtagaggagactagtaatgggcgatctcgctagaattcaaatttgaactgcgcatgcgtgtgggtggccatgagaggaagtggatctgatgactgatgagtctctgactgtgtgaaagcttttcgggctttcggccacccccgctcctgtgattaagaacggtaattagggaagtcgttttctttttgatgtagattaattaatgatggcgatgtccacttgtactatttgggttgcttaaatattcattaacgctgagttataaactggagtggttagacttctaagtgccaactattaagggcctgtttggtacagctccaactcctaaatataactccaggagttgagtctggagtggagttgcggagatgcctaaacccagctccacaactctagtacattttgtgagagagctccacccaactccactctcaattttggtggagctgaaactgtttggctgagctccagctccaggaggggtggagctggagctggagctgtgccaaacaggccctaactctaattcatctttagccaatctaatagctcattcatacaataattatatactacactattaatacttggtcccacctgtcatacacacgttacgtcttggagtccgtgctgcagctggctataaatctgtagcccgctgcccttctgtctcctcatttatgttcttaaaatatgtttgcagcaggtttatagcctgctattgtacctgctctaactcaactttctcgttttccacaggcacgtttttcaaactactaaataatatttttcttttaaaaaaatctaaagttactttaaaatatcatcttaattcatttttcaaaaaaaatcagctaatacttaattaattatacgctaatgaatcgctttgttttgcgtccgtgagagatgagttcctaacacccagcaaagaactcaacctaatagtattaacttatttatatattgatcatgttataaaattatgaggaccctttgaatcataggaacagaaaaacaaagaaataagaaaaatgtaggattctgacagaaatacaagtacaaaatggagaatcgcaaaacgcgagaaaaacacaggaaaagactgtttcagtggatcgtgggaaagaagtagaaatcagataagagagacatacagaaaattttccaaaaggttgaggctcttgctattctcctccaaattctatatagaattgtctattccatagtaatttcaaatgagaggatatgattcaatcctttgtttgaaaaaaactttatgggaaattttccgatatgattgaaatcttccaaagttactatgttttttctaggaatcaagggacttaggaatcaagggaccct

SEQ ID NO: 74810 - DNA, 1698 bp, Oryza sativa
atctcttttggcttacacgaatatggagtagacagaaagggaaacaaccgagcaattccttcactaatcaacccagcatggtttgtgtgggcttgtccttgctctgaccaaaatcagcatcttccgaccagcccagctgtgttcacacctaatcaaccctttaatacaaatatataatgccactctcacaaaacagcaagcgaaatcacccaagtaattaagcaggagttcatcatcattatataatgtttttcaaggcaaaaacataggacagcagagcagagcagagcagctaagtaaaacaaacagcgcacgttcgttaaaagtttcttggtaaacaagctcagaaagaaaaatgcagggactcgactctgcgcattgaccccaaactcgatcgaatctgccagctcactcatgagcttaagagcgttcacacgcagtcgaacacgaacattcccacatttccgcgccaggtgcactccatcatccatgagctgcatgcatgcaattatgcaaattaagcgtggtactcctagattgtttagtagtagaacatcatttgccttgatcagctagccaacacataaaaaacaccatctttaagcccggtcagtgacaggtaggcagggtagtcactttttgccgtgcgaagcaagcactagagttaattaacccctggattaggataacgacaatgaacttttctttccaagatcatccagatggcttcctgatagaaatcgcagatgacactgtgcccaaacgtgatcgatccgtgcacgcacatgcaccacagattccgttcgtcacgcgcccgttcacaccgatggtgtcgagtggagtgacccagcaaccactcaaaaagtcgagtaccatccgaggaattttaactcgttttctaaactctttaaattttgatttaaaaaagacttttaaaattattttgaaatatttattcctttttatcacgttattcgtttgacgtggcaaaacaatactgtcggtctggccaacaaattcgaatttgaatataatttgggatgatatatttttaaattaaaaataaaagttgttaaaaaaaattgccgagtagataaagctcgggcttgggccccacctgacagcgaccggtccaaccgctaacctacaaatacccgcctcgcttcggacaaacacctcactcacctcacaggctcacacacaggcacacacacacttcccgatggagcccaccggcacgatcgtcttcgccaccgtcggcgtcaccaacttcggcttcgacgtcttctccgccgccgtgccactgccgccgatggaggaggacgccgagcgccgccacacggacggcgtatccgtgaacttcaacgcgcagttcgtcgacgatggcggggaggaggtggcgttcgtgtcggagcgaggcggcgcggcggggctgttccggtgccggccggggcccgagcagcgggccgagccgctgccgacggtggaggggagcctgttccatgaccgcccgacggtgaggggcgggaggttgtacttcgtctccgcccacgagcagccgccggcgccgttcaggagctgggcggcggtgtacgcgacggagattgggagcaaggagacggtgcgggtgagtcctccgggcgtcgtggacatgagccccgccgtgtcggactccggggagctcgttgccgtcgcgtc

SEQ ID NO: 74811 - DNA, 4068 bp, Oryza sativa
ctgcagccccttctccccgtccggcgaccgcgtcgggtaccaccgcttccgcggcgccggcgcgcggggggactcggtggggccctacctgcagccggtgcagagcccggtgagctcgctccggatgctgcgcgtgtacggcacgttcccgtcgttctcgccggacgcggcgcacctcgccatgaacggcgacttcttcaagacgccgggcgtcaccatcctccgatccgacggcgccaagcggtgggtgctcacgcgggagcccaacctgttctacacgtcgtggagccccgccgagagcggggtcatcttcacctccatgggccccatcttcgagaccaccaaagcgacggtgaggatcgcgcggctggagttcgacgccggcgagctcaccaccggccgcgacgaggtcgcggccacgctcaaggtgctcacccggccggaggccggcaacgacgcgttcccggcggtgtcgccgtgcgggaagtgggtggtgttccggtcaggccgctccggccacaagaacctctacatcgtcgacgcggcgcacggcgaggacgttggcgccggcgaggggactatccggcggctgaccgacggcgagtggatcgacacgatgccgagctggtcgccgaacgggagcctgatcgcgttctcctccaaccgccacgacccgacgaacgccgccgtgttcagcatctacctggtccggccagacggctccgggctccgccgcgtccacgtcgccgggccggcggggagcgcggcggcggacaggagcggatcaaccacgtgtgcttcagcccggactcgcggtggctgctgttcacggccaacttcggcggcgtgatggcggagcccatctcggcgccgaaccagttccagccgtacggcgacctgtacgtgtgccggctcgacggctcggggttggtcaggctcacctgcaacgcctacgagaacggcacgccggcgtggggcccggcgagctcgccggcggcggggctggagtcgctgtcgctgggcccgggcgccggggacgagtcgctgggcgagtttgatgagccgctctggctcacttgcgacgtctgagctgagggcgacagatgatgatcgatgagctgcacttttaattagaataaaatctgtggtgaatttgatcggttgataataacgggacgagcctgattgtgtgggctagtacgaaccttgttgggaataggttttttatgcatgaaaagggaataaatgaataatgattctgggtacagggtacgtttttgttccgttgcttgataaagctgattgtgattatgtggacattatccatcttcagttgtactactgtcgactgtcgtgtgaagtcacttttgcattatcaaaagtccaaaaacaaaactggacttctaggcttcttccctaatacagagtacagtacaactgccggtccaaagctttacttattccctgtttagttccccgtaaacttttttaaaaaacatcacatcaaatctttaacatatgtatagagtattaaatataaattaaaaaaaatcaattgcacagtttgcaggtaaatcacgagacaaatcttttgagcctaattagttcatgattagcaataagtactacagtaacccaaatgtgttaataacagtttaattatgctcaaaagattcgtctcgcggtttgcaagcgagttacaaaattagttattttatttatgtctaaaaactcctttcaatatctggtcaaacgttcgatataatattaaaaaatttccatttggccgactaaacagacccttactgggcttaactggaatcgttcgtcgaccaaaggggacaggacgaactgactggggtgggacggaaagcagagcagcacgccacggccatttctgagcggaataagttcatctgacattcctcaattatacgccgagtctgtctgagatccctaaccacaatactagaaatgtgtatcccataactatataaaaccatccaaaaaaaagtcccgatacagtatagatgcttggttttgctgacctggcatcctagtaagaaaaaataaaattaaaatgcggggcacacatgtaactgagaagaaaaaattacgcggtcaacaatcctacccagtaatcttcttgtcttttcctttttctcttctctttcatttttatcttcaccgcagagggggagcggtagcaagccagcgccgcggcgacaagcgaatgacgcagcgggtgaaaagagaaaaatcccgccaccgcctctccgcggccgcactcgcccgctcccctccctctgctccgcccgcgcccggagctgctgctcgccagccgccgccggcctccggtcacgcacgccgctgcccgctgccgctccccctcaacagcaaagataaaaacgaaagataagaaaattgctgattagaattgtttttggaggaaaggcgttaaacgcccggttttcattaaaaagcgaaatagttcatacatgaaaacggaagaacaaaaacaaggctggaatgaaaccagcacacataagttaggcactttagctgctggcacatcttaggaacaagccaggaaactagacaagaagaagataaagctacgaacaaactgataggcatagagatcttcagttcttcagcttcaggtgtttgctcctacagtccttcgggtactggcaagcagtgagtcccttgtagcattcaaagaactcttctcctttgctgacgccatttttttctccgctgtaaaagaaataagatagctttatgaggcaagtgagaggcatccgaaatcatcttgtcattgaacacccaatcatttctcatgagccaaatagcccaagcgcccgcagcgaagcaagcaagccaaatagaatgcgacccttctttgtacaagtttagtttatgtaccagttcgcctctagaattgagaatactatcccaacctagagcatctctataacagcaccacataaacctaggaatggcacatctaaacatcatgtggtccacgtcctcgacttccccacaaaatttacaatttggactaccttcccatttcattttcttcagctggctggcagcttgaattcttcccttcaacattaaccagaagaagattttgacttttaagggaatggaggacctccacaggtcctgcaaaaccctatctttaacccctccaaaacatagggcctggtaaagggatttggtagtataagagcctgtcgatgtttgatgtcgcgattccggtatttgcatagtatggggatcgttggtactatgatatacgtgaggctgaggtaaaagagacggagacagggatttttatacaggttcgggcccctgaattgtcaggtaataacccaacatcctgttggccgaagccggtattactcttattcaccataatcacactagtacaatatttgggataacctatcaaactgttgtcgatatggcggtgtgaaggtctgactcgtagtcgataacagtgtagccttcctcctcgaatccgcatccggcgagatcagagacagcgctatatctctcctgctgacagtatccgtaggcaccgtaagggactagccatgcctatctctgaagtcgatatctggcgtcttgtcttggcgtatgtcaacttgtatgttgtggcttctgttgttccatgtatgttgtggtgggtgtcttccatggtgggtgtgtcctctctcctcttagggggtcttgtatttatacccataggtgtccccttgtccaagtagaactagggaaaccaatatgaatacaatctaagtagtccttgtcgtttccatgtaaaactctggttatcttttcttatccggaactcctcctatatctgtaggttgcttccgtataggacatggtatgtagtgggtcctaccgagatttagtcaactactattaggtatgtgatatccataaccctgacagagccagacttatcagcttccaaaacatttgatctttatcacctgaaagatgaatctcccctacaaattatgtagttcttcccattcctccatctcc

SEQ ID NO: 74812 - DNA, 8452 bp, Oryza sativa
caccacacaaaatttttttaaaaaaataaaaagttagaaaaatttatgtatagaaatactatatataaaaaatttgattcaaattcaaatttgaatcgggtatgtaaactttttgacttataaactttgggtatataaactttagatgtatagaaatactatatatagaaaatatttgaattcaaattcaaatttgaatcagatataattcaaattcaaatttgaatcgggtatgtaaacttttgactaataaactttgggtctataaactttaggtgtataaactttaggtgcatagaaatactatatatagaaaatatttgaattcaaattcaaatttgaaacaggtatataaacttttgacttataaactttaggtctataaactaactttaggtgtataaactttagatgtatagaaatactatacataaaaaatatttgaattcaaattcaaatttgaatcggatatataaacttttgacttataaactttgggtctctaaactttagatgtgtaaacttgaggtgtttaaactttaggtgtataaatttactaaaataggaaagtaatgcggcgcccaacagacaggcacgggacgggcggcgggaagggcggcggcggcatgtggttgtagacggagccgaggaagacggcgtcgacgtctcccccagcctcagccaccggggaaggagctgggcacgggtggcaaccgtcgagggcgtcatggcttcggtcctcgagcgctgtcatggcgtcgcagtcgtcgccgcgttcctcccgccttgccgccaccgccaagccgacgccgatgcgttccacctacctcgtcgccaccgcccagccgacgagctcgccggccgcgcgtgtggctccaactcggccgccgcggtcgctgtaacgtcccgcctctcccaggctgggtccgcttacatctggcagctttcataggtcatagactgtcctcacagaccaacacaagtcttttctgcacactttgtcctcactcgtgcgcacccgggaagaatttcccaattggtcacccatcctaaaattactctaggccaagcacgcttaaccctggagttctttggagatcggcttccggaaaagaagttgcaacttgttggaacgtcccctctcggccacgtccgtgtgtccacccatcccaaaattactctaggccaagcacgcttaaccctggagttctttggagatcggcttccggaaaagaagttgcaacttgttggaacatcccctctcggccacgtccgtgtgtccagtgccagcgcatggccacccccggtccacaccagccatgcgcaccatgcctgcgcaactgcgacacacgcgcccgtgaaaccgcgagagtcggctctgataccattttgtaacgtcccacctctcccaggccgggcccgcttacatctggcagctttcataggtcatagactgccctcacagaccaacacaagtcttttctgtacactttgtcctcactcgtgcgcacccgggaagaatttcccaatcggtcacccatccctaaattactttggagatcggctttcggaaaagaagttacaacttgttgatatgagtattctattaatcctattaagccctaggctaggatgtcacagtcggccgccgctcctcctcgtcggcgagcacggagaggaagcagatgccgctgccttgctcccctcaccgccgccaccgccgccttgctcccttgagccaacaccaacgcattcctccaacctgacgccgacgctggtctccccgtgcctccacgccgtcgtcaccgcgttcctcccgccttgccgccggatttggacttgggaggagctcaccggcctccccgcgcctccgccgattctgcctccgccggccgcgcgtgtggctctagctccgccgctgctcctcctctccgccgcttcttcctcgtcggccgcgccgaccctctttcccaccgcgtcggtgacgccgccgccgcatcggccctcctctccgcgtcaattatgatggccacagccgcgcgccgccatcgccgaccgcacgagggggacggggaggccaacgagctcgcaccgccctgagcccgcgcgccgccacccaggagctgccgtcgctggcagcaccaccctttggccacgcgcgccgccgcttgtgcgagagtagagagcgagaggaaggagagaaatagagaaagagagagagggtgctgacgtggcttactgacatgtggggctcacgtgggtcccacgctgagtcagccgccacatgggacaaaatcagggtgaaaactgccgagggatctattgtgaccggttttgtaagttgggggacgccggatgtctggttttgcggttgagggacgattttgtatctggctaacaagttgagggaccttgcgtgtacttttcccttaggaaattacctatttcctgaaacacggcccaataacacagttacacgcattgttttgtccaacaaggcaatcggataaagttcattgatcatagtccagctaaattgctaactagtcaattgggaggttaattggtcaaaaaaattccttttttaaatgaaaatattagaaaacccatatttctgagttttgacccttccaatattccatccctgctgccgcggttttgtaaaattatagtatgcattcagcaacaattaactgctgcaacttgatacttcccctacatttcaacaggaacatgcacatatgctactgcatttttttgaccggcacatatatatattatacatgtgctacatttgaatacaggctacagctagttttgctttattactacgcttaattaattaattatcacaaacatgtgcgttagtttcaatttatttgcagtactatatcatctccaaatttgtctgctagctcacgtgcggttgcttcgctagctagtttaattggttcagacttaatttaattatattagctcgatgaccgaccggctaagtgccttgtcagagatattgaaaatacaacatacatgcagaataatccaccaatcgatatgatcaacgactctcccgcgatcgtgtatcggccggtgagagagagaaaaatggatcccgttttatgttaatctcagctggtcgtgatctgattcgtagacctaattagttgacgagaagatatatattgtgcaagtaatcatgcatatccctttaatttggatattttagcttagcatgcatacataaagtaggttggccgttttcttctaattgtaaggcagcattgcaattgacttctggccgggataagagattagctgtatgtgactggccaaattaagccgtttgtccatatatataacaatttggtaataatgtttagaaaacaattactccctacatttcatattatataagatattctagcgctgcccatatttatatatatatgctaatactgtttagattcattaacatctatataaatataaacaatgctaaaaagtcttataatataaaacggaggaagtagcaattaagtctccgtccgaattggaagagaaacctgcaagctggtggatatacggtgatagcttcatctttgaacaatcgatagatgacaaaagttcaaatagtatactgctacatcgatccatttaaaaataactttatttttcactcatcccatgtatacatataataaaaaaaatacaagaatatatatcctccagtttatcaaatcctaatatagtcgatctccactttaattatctgatcctaatataataattgttttttttcgccttagtagactgtgttttattttatgtttgttctttttcccgtaaaagactttgttgcgttcgtttgggcttggttaccaagctgggtaatgaaagttgactgttgtaaaaaaaaatctttaaagataaagttatttagagataaataagatggcataaaaatgaagttattttaggaacatggatagtactttgtactccctccgtcccaacaaaagacaaaccatgagtttctgtgtccaactttgactgtccgtcttatatgaaatttttttataattcgtatttttattgttgttagatgataaaacatgattaatattttatgtgtgacttgtctttttaatttttttcataatttttttaaataagacggacggtcaaacgttgggcacggaaaccagtgtttgtcttttttttgggacggagggagtaagaggcaacatgaaagtcttgaaaggtaaacgcgcgtatatgacaagtaattcggactaactgccggcggctagttagttctcaagttattcttttctttttctgcgagagagaatatagcttcgaatgtttcctatatgttatttttaaggtaatacagtatgtttatagaagatgaagctctacgcttgctgattgttcggtctatagaaatttagatgataaattaggttccacacacggctaggcctcatgtatttcctttcactataaaaaatgaccgtgcgttgcaacgggtgaagtctattttaatcttattattattacatggtttagttaagatgaaattcactgtgggagtttgcttggatatatatatttttagaaaatcatgagctgcaattagaagttcgatcgtctcaagttagcatgcgagtttttttaaacagatttcttatatgattccttctgtattaccatgggtgaacgatcttaaaaacgactcaaatacggatatgtatttctaaaagcaaacgaacttaaaaaaccgactcatacatgaatgacgtaccaaaatatttaatatcgtcaaaaatatcttcaatgtttataataagtagagaagagatatagattacaaccaaaacataaaattaaaactgactcaaacacggatgatgaaccacggaaacatcttcaatttttataaccgactcaagcacggataacgaatcacgaaaacatcttcaatttttattttatatatatatatatatatatatatatatatatatatatatatatatatatatatatatatatatatataatagtagagatagagatttgtacaaatttgctgcacccctctataaaggcaaaacgtacgtaatgtgttgttcaaagttaccaattaatccttcatgatggatgatgtccctattagtataatttaataagctttccgggtagatcatttttgttgttttagaaaatatacgtgtaacattatttattaaaatccacgcaacaagacacgtccctttgtcacgtattattttggaagtttttttatccattagtgtatttttatgaattaatgtcaataaactctgcatatatgtatgtgatggtttatgcttaacgatgcttctttttagcctacttggttaggacttagtaccttcttctgggaatatgaaggaatctacacactagtagctatcaccatctgggcgacctaccccaattaagacgagtttatgatttgatattatatttttctagtgtaaaatttggcatgttttatcttgcgtatatgatgtgacaatattttgactagaaattttaatttcttctggtactttaaaaaacagtaaaattttgcacgcatattcaattctaattcagataacttagctactgtatgcatatatgacgcgtaggaataaaaaactgaacttaatcattcgtgagatctatctttatatatgcggcgacgttgtgatatacttttcttgagaaagacttgaccaaatgcagaagccattgtccaacgcgattagattgaaattagagatatctatctatctatctatctatctatctatctatctatctatctatctatctatatatatatatatatatatatatatatatatatatatatatatatatatatatatatatatatatatatatatatatcgtttcacagtatagtaattaaccagtacagtatctcacaagatagtaactaaccagtacagtattttagggcctgtttagggagcttctaactgctacagcttctcccataatcagaagctcccttaaacagtctatcttttggtacagattccgagaaactgttattttagaatctataaaatgaactgaaaccagaaactgtgaaaccaaattttttcagattctcataaactggttaccaaccagctgcttcttagaatcttaacctggaattgagaccaagtacgtagtggacacggccggcctggctaaataattatcaaaattaacttgatttgacacaagctactgaaaccgccgtgtttctattaaagaaagttcgtactgtctagcttaattagatgctttcagaatcgctacgttacaatgaaaagaaagccacattcacgtgatcaaattgaatatatcctgacatcgctacatatcgttttccagctcgttgcgtataaacatctgaattaattttgctccaagacagtaatgtatgtctacagatgaacttgactatttagcaatagtagctaccagtagtaattaattttgtggcccggaaaaatggactaggcaataaagagcgaataggtaatcgtcattattatgttttttcattaggtcattaattgtcttatgttgaccaatagtatattatgccggctgagtgatatatcctctctctctctctctctctctctctctctctctctctctctctctctctataaaaatactagtaacttgaattatgcagaatatatatatatatatatatatatatatatatatatatatatatatatatatatatatatgagatactctagggctatttggggagcttctaattgctgcagcttctccagaattagaatctcccccaaacagtacagcttttaatccagattctaagaagctgtagttgtagaatccaggaaataaactagaagccagaagctgggaaacccagcttttctagattctgaggagctggctaccaatcagctgtttcttacaatcttaagctcccctaaataagaaagacaagagagaaaaaaaagatcattaatatttcagcaatcaagatccaactatccagccatacgtgcatgcataaatattactacatctgtcccaaaatataacaacctttcaacaaatgtttagattcgtattattatgatgtgtcccatccgtttaaaggttattatattttgagacggatgaagtaactgatatagtcctcattaagttgcaattttatcttggttagtagacgatgcattaaaacctttttgggtgtatttgtaaatttgccaccggttttttcaattttgtaaggatgccatttgaatgacagttccagtggtatttttgtaattttatagtaacagttttgcaataacgattcaaagtagtggtaaatttgcaattgcctaacctttttcaatagaaagttgctccaactaatatcaaataaatttattttttaagtatataataattaaaactcaattactcgtgtgctaacgattttcttgttctgtgtgttcttactacatcttcattcgccgttatgttgaacgggaccatatatatagtgtcgacacataattaatatatatagtattctttttaatccagactgaaatgtagtctcttgcatacacacacttagcttgcaatcgtgtgcgtgtggtaccaatatatacacgtcatcgatcgagaaatgagaacgagatggatacctccaaattaaatgtcatcatcacattcacatccatagacagatagattattacagtaattaatttgcttctggtgcaactattgatcagtttggtcagttggctgaaaatcttagtagatgactttctctgatcagaagataagaacgcgcgcatacacgcgcagtcatcatccgatgtaggagtagtatataggagtaaatctgaggcgcctctactaactatagtactataattttatggttcaagattagaaccgcatgtccatgagacctggccaaagtcttccataacaattaattacatacaaatgaatgtttaggaaaatgtacatagcgagtaaattaacctagtggaattaatactaggaaggtacgtattaaacttaagttacgaggcagctgacagacaatagtgatctttgaacattgactatgatcactataaagggtactctccctttgtgtcaaaataacttcatttttaccatatattgtttatctaaaaataaattaatattttagaaatcattatattataatttgataaagtgaagagtactctttttttaagacaaaagtgaagagtattctagtctttttcttttgtattggtatgtgtgaaatggatgatgaacattaaaataaatttattttaggattgaggtagtaattcttagtttaagatgtaattatctatca

SEQ ID NO: 74813 - DNA, 27613 bp, Oryza sativa
aaatatagattttttaaaaaaactaattgcacgattagggaggaaatcgcgagacgaatattttgagtctaattagtccataattagccataagtgctacagtaacccacatgtactaatgacggattaattaggctcaaaaaattcgtctcgcggtttctaggtgagttatgaaattagttttttttattcgtgtccgaaaaccctttccgatatccggtcaaacgttcgatgtgacactcaaaaaatattttttcgtgaactaaacaggccctaagttggcgaaattggcccatacgacgaatacagtaacgcatgtttttttatgaagttcaattcggcgatacgtctacgcccaagagttggatcaataccgaaagtcgttgctcaatttcttacgtgcttacaataaatctagctaaacaaatactcaattataatgcggccggggagaagttatgatgctgaattataaagctgatcatgccacatcgtagcagggtcgatttgtctaccctagttggtaggaaaaaagtgtatcttagttgacagcaatgcaaattttatagtcgagataatatcatgcccatgccttagctactcgctggcaataaagaccttagctactcgctagctagcaatcgttttcgcgctcgaataatgcgtttgaacatcgcaattaagatccagttaatctcatttagttactgatgacgccctgttgttcgagatctgttcaaagctctgaaacctcgacctggcgaaaaagttcagaaacatctctagtcaatccaaaccgtgacgaccttagagacagaaaaggggaaaaattagcatacgtacaactgggttagctcaacattatgctagcttagccttgccattcaaacctgattttgacagtacacaaacacaattcaaaacgggccgtgtcttctattgaaaaagaagttgaaaataaatgcatatcgatcgattgatctgtacgtgcgctttcaggttaatttgttcaacgacacatgcagtatacgcacgtcatttcgatggaatatgtggggttgaatttgttttgaaatttccgcatagatgttgagccacattttgacacagcgccgtgaaaactactaattattattaaataattcgcatgtgcatgtcataaattccacttgatcgcacaagaaaattgtggtgctaaggatcgagcaagtcgcgccatggctgatccacgacctaactagctaagctatagcttaatttgatttctatttaagaccttgacattaacgcatggaggtgtgcccaatacaattgtgaccgatcgatcgaggaagaagacgacgaccatgaggacgatgcttcctctcctcgttatcctcgtcgtcgggctccggctcgccggcgcgagccctccgccgcagccggtggcctgcaccaagggcaccaccgactgcacggtgaccaacgtgtacggctccttccccgaccgcaccatctgccgcgccgctgacgcgtcgttcccgcgcacggaggcggagctcgtggcgcccgtgacggcggcggcggcggcggggcggaagccgaaggcggcgacgaggcactcccacagcttccccaagctggcgtgccccggcggccgcgacggcaccatcatcagcacccggttcctcaaccgcacggtggccgtcgacgcggcggcgcggcggatcaccgtcgagagcggcgtcgtgctgcgggacctcatcagggccgccgccgccgccggcctcgcgctgccgcactcgccctactggtacggcctcaccgtcggcggcctcctcgccaccggcgcccatggcagctcgctctggggcaagggtagcgccgtgcacgagtacgtcgtcgggctacgcatcgtcaccccggccccggcgagccaggggttcgccgtcgtcagggagctcgtcgccggcgaccccgacctcgacgccgccaaggtctccctcggcgtcctcggcgtcatctctcaggtaagtacacaaaccacacgtgttctacttcttcgttaattatttcatcatgcatgtgatctgatccgtacgtatataccatggtgcatgcatgcattgcatgcaattacacgtaattgcatatgggggttaattttgtccttgattgtccttcttgctttggatcttatcatgaaatgaatgaatattactactactaactgcttgttgcatcgatccatggagattgattaattactttatccttccttcaagtgaaagatagccctaatcaatcaaccaaccatatttatgaatgaataaaagcatctagaacatgatcaatttgacatgaaattcatttgatgtgattttgcaggtgacattcgagttgcagccgcagttcaagaggtcggtgaggttcgtgacgcgggacgactcggacttcgcggagaaggtggcggtgtggggcggcgcgcacgagttcggcgacatggcgtggctgccgcggcaggggaaggtgatctaccgggaggacgaccgcgtcgacgtggccacgccggggaacggcctcaacgactacctcggcttccgcgcgcagccgacgctgggcctcatcaccgccagggccgccgaggagcggctggagaggaacggcaccgacatcgcccgctgcctcgcggcgcggctgccgccgtcgctgttcgagctccaggcctacggcttcaccaacgacggcgtcttcttcaccggctggccggtggtcgggttccagcaccggatccaggcgtcggggacgtgcatcagctcgccggaggacggcctcctctcctcctgcacctgggacccacggatccgggggcccttcttgtacaactccggcttcagcatcgcgctgcccagggcggcggcgttcgtcgccgacatgatgcggctgcgcgacctcaacccgcgggccttctgcgacatcgacgccaagctcggcatcctcatgcgctacgtcaaggcgagctccgcctacctcggcaagccggaggactgcgtcgacttcgacgtcacctactaccggagctacgacgacggcgagccgcgcccgcactccgacgtgttcgacgagctggagcagatggcgctgcgcaagtacggcgccgtcccgcactgggggaagaaccgtaacttcgccttcgacggcgccgccgccaagtaccccaactccggcgagttcatcaaggtgaaggagagatacgaccccgacggcatcttctccagcgagtggagcgaccaggtgctgggcatcagcgggagccccaacatcgtcgacaagcgctgcgccattgaaggcctctgcgtctgctccgacgactcccactgcgcgccggagctcggctacttctgccgcccggggaagcttttcaaggaggccagggtctgctccaaagacaaatccgccgccgccggtgatgatgatctcctcgatgaattgtgatttattattatttgatcgaatttcgttcaagtcaaataatacatgcatggctagctagctctgcatgaaatgaaatgcaaatttatatttaattaatcaagaaaaagataagcacgtacgaaataatccacctgctacattgggatggcgtatgtggtaggtagtgatactgtaaattggttggcgtgatttgattttgagatgtaatgatgctttaatgtggacagtgtcagtggtttggaaaattgtactccctctatctctaaatatttgacgccattaactttttaaaatatgtttgaccatttgtcttattcaaaactttttatgaaatatgtaacatttatatatacataaaaatatatttaacaatgaatcaaatgataggaaaagaattaataattacttaaatttttttaataagacgaacggttaaatatgttttaaaaaatcaacggcatcaaatatttagagatggagggaatatattaatttaatttgagttggaagaacaagttcaactgtttggaaggagcgcgcgatctgagtcttaatcagctgttgctttcgtctttcaatatgtgactataaacgtgtctctctatgtttttcgtcgttttattcgttgaataggcagagctcctaccgttgaaaaggtaagtgttaaactttggtttttgttggtgttctctctacgtttaatacttctaatttttagtcccatccaaacaccgtttatttgtttcttgcatttttctacacgtaactataattaaacctctttgtgcatttctctgcgtattctttttaactgaatcggcacagctcctgccttgtttctcttttacggttttgtcaaaggtaggaagttaaagattaaggttaatcctattattactatgaagctacatagtttcttaattatgatggtgggttgttttttttttagcaagagcagagagcccccatttccattactagaaatgaatagcaagctacagagtgagagcgagagatggtggccgggttgtaatgattatcatcatgcatgacattatctatcaaaaaaatctattcatggcaacatgtgcggcagcttattgagggttgagagtgagactgtgtcatcttgtcggtcatggcgtcgaatggctacggtcaaggaaattattttgttttgagtagttgaatggaggtctcaatcatttatgaatggggtatgctatgtttaatgcaactcctttttcggtgactaacgcaatgtcttttaaaatgaccactcctaaatactactatattcttatagaaacagggcataaactaaattgggagaatgactaattaatttggccttggccggcctatacttttttttatggttttgtatgaaatggaggtggttttcatatttatattattattgtgtgtatttagctgatgtcacttaattaggtccaccactttaaaacttgcctcatttaagtttgtgttgtaacagaaaatttatcatttgcgtttaggggtgtgtgaatacaatcaaaccatgcatattccatcaaaccaccatgaaatatggtttagggtgtgttatattatgtgtttgattttcaaagtttaaagtgaaaacaaccggttttatattttaggttgaaaaataaattaacttcgagcaattcatagactttacagtacttatatttggtgtcattagtatccatagttccttataggctagatcgatgtagatttaatttgctacggctacagctgtggtgcatttacagtatcgataacaacagattttgatctgcagaaaagctgaactgatcaggcttctgcagttgcatcgatctgttggtgataaccaaagcaagagttgatgacattctaactgcagtttaattaacgaagtgcataacattgaggtcatgcggtgatcacaaattaaactggcccagtacgaccaagccttccatttacagcccagtgcgacaaaatttcagccttaattgtcaagcgagcccattatcagacgaacgtgaaaaatattggcccacctatagcccactaagtgaaatcccagcccagtaatggcctattaaagcaaaattacagcccacgtaatctagtaaaagtaccgtaccactaatggcccagtaatacaaaatcaaggcccgtttatattacagtatgcattacagcccaatgatgatacagtaagtcaaatacggcctattaagaagacagtacggcccagtaaaggcccattaataggaaatcccagcccactaaagtccatttatagacattacttggtacaaagaatacattaaaaaaaagcatggtacaaaaatacattgaaaaggcgtggtacataaaagtaaatgagttagctatcaatttgcatggtacaaaaaatacattaaaaaacaggtgcatattatagaacgcatggaaaattatacatctgaaaccatttcatatggtaatggaggttatatttgaaaattttgttctaaattttggatgtgctgaggatatatattggtattagtggataaaagatgccgataatggaggttatatttgaaaattttggatgtgcggaggatatatattggtattagtggataaaagatgccgataatggaggttatatttgaaaattttgttctaaattttggatgcgctgaggatatatattggtattagtcgataaaagatgtcgatattttctttttagagaagggtatttttacccgatctctatacccaaccggatatatgcagccttttaaattgagaatttagcccctcaaacaactactcaggtcactgcaaccatcagtctacgtgactcaaacttatcagttcattgagacttttgaggctgacatggttatttttacaataggagattcaatgcattcttaataaaagagatggctttctagtggtgtaattatcagtgccattagcccaattatcatgcatcctgagatggaactataggttcaagatttggcatacattactggcacttaaaatccatggatatctctactggcacttaaaatcgacgagaaaattcgaaacccatctatcagattgctagtagtttgttgtggacaaacccgtgtacccgtgattgatatattgcttgagtaacaactatcacatactacagctgtacagcaagcaaatgatagcatttcctaccattttgaaacttgcaatgaaaaattaagcagcaaaatttgagtcactgaagcgcatttcaaactaactacaagtcaaccacacaaatgtcatgcatccttttacattctaaacctaattagaactactgagcatgatgcgtgaatggtttacatttctgaaatggtttcagccacatcagaaaccatttctcgattgattcgccggcggcgaggtggagagagagagtctcgagccgagccacgtttcgtaggggggaagcgagccgagccgagccgagtcaacaagtacaccgtacacggatcccgtatagagacgagacaagcgtacattcgtacgtactccgtgcaaatactgtttgttgcgtcgaatacacgacaaagtcaacgaacgatacagcgtggcgggggagctcatctcactggcctcgcgctcccacactgccacgtcactcacactctcactaatggctacttggtggttccggcgaagtaggcgagcgcgccgacgagcggcgcgttgatgtaggtggccggctccgactgcgcgaagttgccgcggtcgtcggcaaaggcgtcgcggctgtccggcccgccgacgacggcgccgacgagcacgttcgggttgggctcgccggagtggaggtagccgaagccggcgtcgcaggagatccgccccgggtgggcgcgcaccgacggcatggacgcgccgcggtggtgcgcccgcctcgggtacctgcacccgaaccccaccatgtacgacatccccgccgggttcttccccaggatgtagtccacctgccgcttcgccaccgccaccagctccgccgccgacacctcccccctcgctccgccgccgccgtcgccgcacgacgcggtggcgccgctcgaccggaggtacttggcgtacgccagcatcaggaacgtcgccgtcgtcacgtactgcatgttgctggagccttccctgtacaggaggccgccgggggtgtaccgcgactggaagctcgccgtgccgggcaccagcgagcagatgtagctgtcggagtgcgccttgtagagctcgaggccatggaggcggttgcggaggaagcccttggcgaggagcaccttggtgcccacccgcttgtcgtcccagctgaaggagtagtcgtcgtccccggcgccgagctgcatcccgttcgcctccacgtacgacatgaacgacgcgttcctcgacgcgcggtgcagccacgacgccccccacaggagctcgtcgtggtagcccgagtaggagcagtagaacgggcacaccgacgacgccagcgagtcgctgtacgacccgcggtgccggtcggcgaagtcgaacacctgcgtcgcggcgtggaggaggcgcgcggagtaggccgggtcggcgcggcggaacaccatggacgacgcggcgagcgcggcggccgtctcgccggcgacgtcggaacccggcttgtcggcggtgacgcggtagacgctgcggggtgtgtccatgtcctcggggcgctcccagcagcggtggtcctggttggggtcggcgacctggacgtagagcgcgccgggcgtggcggtggcggccttgaggaggtagtcggcgccccagcgcacggcggcgcgggcgttgggcagctcggcgcccatgaacttgccgaagtcgagcacgctccacgccagcatcgtcgtcgagaacgccatgggcaggccgaacttgacgttgtcgccggcgtcgtagtacccgcccaccaaatccacctgaaacacaaacacgccggaatcacaaactcctcctcgccggagacaaggaagaaagggaaagagagagaggcggcgtacgtacattgtactgggcgccgtcggtgaggccggagtcggcgcgccacggcatgcggttgccgggcgggagcttgccggagcgctggccctcgaagaagatgatggacttggcgagcgcgtcggcgtagttgaacgccatggccgagctcggaactaagagcagcaggtggagcacgaccagcagccgcagccgaatgccggcgccgccgcagctgctgctctttggctccattgctgcctgcctcaccggcgaagtgagagtgtggctcgagagtgaccaactgcacattaatatagtgtgaaaagcagtggccgttaagttagttaatttggccggtgctggagtagtatatcaatttgctgcgagaaaccgggaagttggggggacaatttgcaggagttgagaggaaaagaaatcgaaattccaatttccaagtgagcatttcttttttcctttttgactgacaatgtctcatggctttgggatttgtataccaaaaagaatgaatgaaatataccagtagcacttgctaactggaattcaacagagtttgcagaagctatcaatgtgacaagcacacaacaatttgtggttggggctgtttttagctcagcgcaaagtttatatttgggtagaaattaaagatatgggattgaaaagttatgtgtatgacaggttgatgtgatggaaaatgactgaagtttgaatccaaactttagatctaaacatagccaggtatatttctaaaaccaaaattatcgtatttgttcatctgaagatgaacaaaaaaaaaacagctgccttgtgacaatcctgttcctttgagattcacaggagaaaataatttgatgcacacacacacacaaacagtatcatctgaattctcagcaatgaacaccgtgtttagttctattttttttttcaaacttctaatttttttatcacattaaaactttttacacatataaatttttaacttttccgtcatattatttcaatttcaatttcaaccatacttccaatttcggtgtgaactgaacacacccgaaactggaaagccaaagcgtccggtatgttagctactaggccggtgcagagcagaacgtaggctggggaattcggcgactggtcggctttttgcaaagccaaagcaaaagcatgcagcgacatggacgaccgtctctgctcaccttcagctactgctactggtactcctctgcctgtctttctctctttttcctttttctttctttaaaatcttcaagccagccatccatttctccatctattccgatggccttcctttctccattctcatctcatgcgtgtgttcaaccaaggccacactgcaatgatgcctccagttgcatgaatattcatatcaagcctgtgtttagttccaattaaaaatttgaagaaattggaacgatgtgtcggaaaagttagaagtttatatgtgtaggaaagtttgatgtgacagaaaagttagaagtttgaagaaaaaaattaaaaactaaataaggcccaattgcattttgatctccactgatggtatattattaaggatctgtttggatcatttagtccctagactaaaattagtccacgattaaaaagtttagttccctactgtttagatctagggaaggcacgtgaaccgagggacaaaggagagagactgttattttagggcagtcccaacccataacactagacatggtttccataaactccacatcatcaagaaactactaatagacactactcttccaatgcaaacaccactattccatacttcaatttaatgctacttatctcacatgatgtcttggatgttgtgtagaaaccatgtctcatgcaatacatggtttccctctctttcttcatttattcacttgccacatcattttttttttcttaggtggcaacttatttaatgctatggatactatcctagttattgggttgggaatgcccttagtccctacaagtatctccaagagggactaatatattttagtcctaatatgcacttttagtttttttagtcaccctgtttgaattcttaggaactaaaaagtacaaaaatagagggactaatggattattccgatgaaccaaatatggcataagctatgctacttactaattacctgcagtagaatggcattaagaagagcatgcttaactagtggaatgaatgaacgctccactccaagtgcaattggcaatgatgatgttctctccagtctccaccccataatactgaaggactactcctataatctgaagttaattgcagagctcgaggatggcagatgcatttgttgtgttccatccatgggggcaacaagacccctctgcttgatacaagcacatgtgtagctttccttttgtcttactccaatctcaagtgcaatcctactatcacttcagaaaaaaaaaatcatcaaagtaaagcatagataatgtactagtactactactattccaccatcaaggaagaaattactctaccataactgcttttccttctgtcctactgcaatctcaacttctcaagtgcagtcctactacttcagataagatactccattccaaagtgcagtagggacaatgtactagtaccatcaagtaaatttatcaccactaaatttaacagaagctgtagtaaatttgattgttgggcttgacaattgccatgctttgataagactggttaaactcctgaagctgtgaccactgatgtttaccgaactgttcacatgcagcgtgcagaggcctgagaagcaggtgaagaactgtaaaaataaaataaaaaggctggtcaagtctggagagtggtcaaaactgacaaacatgcgttgcgttgcagctaaaagtaagggcttggctttgcatggcaggcactggccttcatcacagagaatcctattcctagggtactgtactatacgtgctatgaccagaacagtttcatcagtgaacaaagttgacagttgaaatacacacagggggacctcgtcctgattctgaatctgctttcgctggggattatgcagtcatgctgcctgaaaaaagtttaagcaaatctagtgggtttaatgcaaagaaggaagtaattcgtgtttatctgttcctttttcaactcccgttcagaaccgagggcaagtggtagtaaatgggagatgttattttgtgcattctaaaattcagaaatgcagctggggggctttttttataaagctggatatttatagatggaaaaattgcaaaaaccaccctagatattatcccgagtttgagacttcctccatgagacaattcgttggaaatacctcttctaattcacattagtttaatattcctcttcaattaccattgttcagtgtttcttactttctttcctcttccctaattattgttactcgtccattctcatggcgcaaagcatcagaattgcatcgagctcatatttcttatcttgaatctgccagagcccaaagaaaccaggcaccggtaaaccctatgtgacaaacgcaacaactcatcttcgacgacccccgcatccaagagcaaagactcgtgatcactatcacccaacgatgtgctgcccgataggtcgccatgagtggggatgccacggtcgtgtcattgggtctagccaacatgagtgacgaccatgtctcctcgcctattagtgtttgtataagcgtgtatgtagttaatagaacgaatattaataattggggaagaaggaaaaaaaacacgtgaacaatgataatggagggaaaataccaaagtattgtagacagattcagcagaaatagctgaagaatatacgtgcttttattcctttgagaaattagctatagcacctgttggttcttcagagttgttggtactgaattctcagtcagtcacagtgtgaagaacgcagtccgctaagttcttcctcatgggttgccaactcacctccctcattttctgcgtgtatgtttttcaaaccactaaacggtacatattttgtaaaaaatttatattagaaagttacttaaaaaatcatattaatccattttttaattttttttatagctaatacttaattaatcacgtgttaatctatcgtcccgttttccgtgcggaggggaggggttcccaacctctccaaaagaacacacacttgtgattcagatcagagttcacacaaaatactacacaatacgggcagttttgctcatgatcgactcggactattggtcaatcaaacagcagcaaattcagaaccatttgcaccaatcaggactatttttacccaattacaactagcatttcaaacgaaatgcatttgtattgagaccaggacctaaccggggaaaaaatcgcaaattatagcaaagcaactccaagggaaacaagaggcgtctcggcctcacctcagacggcgattcaacaagaggtcgaacagcctcgcgccaccgtcgcctcaccccgtcgccgccaccgccgccggcgacgacgatcgccgggctccacctcggtgaacggcccaccatcgcacactattcatgatcgtgggccgtcggatgacgaaaacgggccagtctttttttgtagactttaagggttcgatgacgaaatctctgaacccacttctctgatcgtttaaccgctgaatcactgtaaaaatatttagtcgcgcgtaaccattaaggatttctaattcttatatgccaaataatctcaaactcaatgcaatacctgaaaacggtcaggatttgaactccagcagcagcatgcagcatgctctctctccgtctgaattttgggacaatttggcactgaggccgtcgacatgaggactgaaaaaagcataaacatcgagcaacatgtatctggaacaaaagtgcattgatcttgtatcgagtggatctttgcttcggttactgtacatgaccttttagctcctgaattgtaccaatgcttagtcagtaatcaaacaagcttcattcagcccatcaaaacaaaacaggttttgaagccatcaaagaacattatcatgcagcctgtcaaaacaagactgttttgaagcaaatttaggtaggaaaaaattaaaacatttaaaatcaggaaaaaaaataaagcattcaaatttgatttggatggggtgcaccagccaaggctgtagtgcaacgcctaggcgacacatgagggccctagtggcaagccactatggtggactctcccccacgaaaaataaatttaatatcaaagtagacacatggcccacatatcagatattaaactgataagaacagatactacacttgatcttagccaaaaggccgagaaaggtatgagttgctatcacgttcacctcctgcttttgtagcctctccgtacatctcctcgtcttgatcgcgcgatgtggtactaaactgtgacaatgaacgaacaaacgggagggggatacaatacatcatgcgatgcgggcttgcgtgggccgctggctcggcgaaaccctcaaatgggccggccttttgaaaagtctgtagttaagggggttcggagtcaaaatctccgacctccctttctgactgtttcaccccatcatatcgcagtaaaactatttgagaggcattgatatagattgatcatatctagctgttatatcaactatatgaggagaaatttgaagataaatacgagcttgccttgcattttttttcttttctttctcaattctcatgatttatttttcctagaatcctgtcatgttcatcctgatgttaagcttcaaagacgcagaaattgttttttcgcgaagaaagacgcagaaattgtaagaagctgcagtaaagacgatcaagatatgaactccagatcgacctccaacaacgtgctctttcctttaagtctgtagtttgggacaaattgctgtggagagcgtccccagtcgacctgaacaaacactagcttcaattggctcttttagttgttttactctacttagttctgaattttcagtctgacaaacacagaattacgaacggtcgaacgcatgcatctgtagcgtgaattgacaattacataaacatttgttatttgcactacactatagaccatagtgaatctttacttacatgtgctgggcataaaaataataatttcagtacacaacaactgtactttttacattctgaacaagggttcttagatgcaaccttccactgtactttgcaagaagaattctcaagctcaaggcaaggccttaattaacccagagaagggaatcattgatgatttgtttatcgccatgtacaaacacaaatgataaaacagagaactatcaggattggaactgttgctttgtgctctatctatatgatctgaagtttggcacaaattctcactgaggcatctaacaagagacctgaaagaaaattaacagagattgagcaacatggtatgtgggaacagccgtgctttcatctaatatattcaaacaaaaaaaagatttgtcagtatgtattttgaagaacagatttgtgctcctttgttcagaattgtcagtctgaatatattcaaacaaaaaaagatttgccagtatgtatcttgaaaaacagatttgtgctcctgacaataccagtagatgtgcaaatgctattcagcaatcaaagagaccatcaaaagtgactcagaagtttaaaggcaaatttcatgccctgaaacaaagagcttggataaattggatttaacaaattcaattggatttggttggggtgcgccagccaaggctgtagtgcaacgcctaggcgacacacgaaggccctagtggcaagccactatggtggaccctcccccacaaaaaataaatttaatatcaaagtgggcacatggccacatatcagatattaaactgataagaacagatactacacttgatcttagccaaaaggccgagaaaggtatgagttgcattgttggctacaccctgcttttctagcctcttcctggtactactctccttgatcctgcgatgtggtacaaaacgaagacagcattggcgtttgctgtgcctgtgtgggccgctgactcgtcgaggccttctcaaatgggccggcctttttttttgcaagcctgtgttactggggttcgtgtttacttgggggttcggagaaaaaaatattcagacccccttctctgatcaaaatctactcactgaaagcgatcaagatctcaactccagacctctgctctttattgaagtctaaagtttggaacaaattggtgtggagagcatcaatgaattgacctgaattaaaacatttagagagacatgtatctgggaccaaagtgtgctttgatcttgtatctattcgctctttgattttgttactgtacttagttctgaaatttcagtctgaagatcacaaaaaaccggaactctttttttttttgcagaaaacagaaacaattgtgctccagtaattgtatccctgctttggatctattatgagcacacacctaataaaattatgaacgtccgaacgcatgcagcgcgaattaacaattacataaacatttgccattttcactacattatagaccatggtgagactttacatgtgctgggcataaaacaataatttcagtacacaactgtactttttacattctgaacaagggttcttagatgcaactgtccacttcactttgcaagaagaattctcaagctcaagtcaaggccttaattaacccagagaaggaaatcattgatgatttgtttatcgccatgtacaaacacaaatgataaaacagaaaatgattaggattggaactgttgctttgtgctctatctatatgattggcataaattctcactgaggcatctaacaaaagacctgaaagaaaaataacagagatcgagcaacatggtatgtgaaaacagccgctttcatctaattgtcttgtatctattggctccttgatttagttagatactgtactttgttctgaattgccaatctgaatatatctatctatcttctattatatactaaaagtccattaaacgtcctacaaacactctcaagacgacacgtggcattcttataaacgctcataaaccgtcacgtggcactatttaatctcaccgtcgattttcatttaaattggtggacccgttattttagaccattagattatatctatatctataccgttgattttcacttaaattgatggatccgttatttagatcattagatatatatctctaatactaatactttccacctatacatacgagagagaataggttcgccaaaaaaaaaaagtaagtacgtaagattgaaaaggaacaataaaacctacatacgtacggtaaaagaataaagccatcatgtcaaaaaaagatagaaccaaaaaaaacatacgtatatagtatcatacaaaaaaaataaaaaaactcccatatactcccacacattagttattattaataaatttgaaaaaaataaatatattcttcgaattagtaaaggtgtctcatgtgattatcaacaataagtattgaaaataaaccaagcgctaaactatagatgtttgtcaaaatataaatgtttaacaccataaacacacatggtgtctactctataccaggaatctactcaaaacttaaaaaaaaaattcttttgatcacctccatcttctcttttagtaccgtcgaattacaacttcgctcattttcaaattgcataatgtttaacaccataaacacgtggtgtctactctataccatgaatctactctcaaaacataaaaaaacattcttttgatcacctccatcttctcttttttcttttatgaagggcataagcatgaataacatagtttgctacgttgctataagtataacagggacgtacatatgggagttaaggcggtcccagtggagaccacagtcaccaatagtgctcaacttactacttaccgatgcacaactcgataagggtgtgatagtaaattaggcattaaaattgtgttccaggttagtctggaggtgcacaactacatcgatatgggacccatgtttcaaggaaatagacaaagaaagtctcgccactacaatcggcttcacgcattagagaagcatttatatataacttgatgttattctattaatttgtacaagtggtatttttacaatatttatatatagttttgaaaattggtgaggcacgaaacacttacgtgtagtggatatttcaatgtattaatgatgtattaggcttattttattgatacattacgtagttcatctatgaataggtacttggcttttaaacagtgataataggttgaagtgacaacaagaaaatttatatgtaaccagaggcaaagtgattttatttaatctaggagataaccttattacttaaatatattaaagtatgcaatatatttctcggcttataaatggtgagatataacctttttaaaaaattgtcttcataaaactgctcgcgcatctgcgcgggctttcttcctagttcaaacaaaaagacaatatattcaaacaaaaagagatatgtcattgttttagttagatactgtactttgttctgaattgtcagtctgaatatattcaaacaaaaagagatatgtcagtatgtattttgaagaacagatttgtgctcctgacaataccagtggatgtgccaatgctattcagcaaaatcaaatagaccaccaaaagagactaaaaaagtttaaaggcaaatttcatcccctaaaacaaagagcttgaataaattggatttaataagttcaattggatttggttggggtgcgcctgccagggctatagtgcaacgtctaggcaacacacgagggccctagtggcaagccactatggtggaccctcccccacaaaaaataaatttaatatcaaagtgggcacaagacccacgtatcagatattaaactgataagaacagatactacacttgatcttagccaaaaggccgagaaaggtatgagttgcaacattggctaccccctgcttttgtagcctcttcctggtactactctccttgatcctgcgatgtggtactaaacgaggacaacgttggcatttgctgtgtctgtgtgggccgctggctcgtcgaggccttctcaaatgggccggccttttcttttgcaagcctgtttactcgctgcaagctcgaactagaaattgctttgttcaacaagtgacatgattctttggctgattatgaagattgcaggtgtgcgtacatcaaaggattgatggaacatgcactgcagtttggtttaacggttacatcgaatcgaagcaagaacaattacatgaatatttgaagtattgcatttgtactatattaataccatgatggatctttaattacaggtagtgggcacaagaatttctgtatacaagcactgcatttttttacatgaggaataaataagggattattgcggaaactatctaactagtaaaatatttatgtggaaatttctcgagctcaaaggcaaagccttaattttcccaggcaaggagatcactgacggttttctgtgatctgtctatctatataccaaatgataaagagtggtacaacgtatgaactgtcgattggcctgcaggcaagtgaacaaagtaaaagaaactaataattagtcatacgcagcaagaacaagatcgtaccacacaattggttaaccgattcttacgtagctactatgggctatgagctgtggtgcgagcgttttcataagaaactgaaaacgtccaacatctgaattcagcattgatgtgatgtgctctaagtctgaagtttgggacaaattggcgctgagggtgttgagatggaacctgaaaacaaaaaaaaaaaaaatcaagaccaaccataataagtctgcgatatgctctgctgctatttcaaactggcagtgctagctagatttggtcagattcttcaatctgagatgttggcaatttgggtgaaactcacatagattggcatagcagggctgttttgatgctgggtcttcttccaagggtgggggcacttggccgtaaatcatttcacagctcatatcttcaaaatctgcggtgattcataaattcagtacttcagggtacataatcagctaggacagtgtaaaaattgagaagaaaaaggatggacaacatgcatgtcaaatggtagtatgtcattgtcaaaagaacaggaagaggaaactgcagagtttggcattgagtagcacaagaacgatgtctgtcttacttggattcatggtgagagggagtccgaactcgttggtgaagaagttttgcgtcggaattttgcacatgttgacgcacattccgacgcagccgctgttctccaggtacctgaaacggagatgaatgttttctgaattttttactgaatctcgcttgaaatccaagacgaacacagttgaatcgtccgtcttacctgcatttctttatcagcactccactcttctgcttcaccccattgacctcaacctccacaacctgaaagatcaaggaattgatgcaatgagttcatgacgatgaactagctgtgtctctgaattatactcctacctctgatgggccgacgagccagtggaagaaggggacggtgagggcagcgttgaactcgcaggcccacctcgtcggcgggaagagcttcttgaactgctcgggggcgccgggggggagcatggagaggagcacctcgcggacggcctcctgctgctgcgcccgcgtccgccccaccatcacccgccgcgacacgtccacgaagctctcgtagtcccactcccacaccgacctcgagctcttctccttcttcttctccttccccttcccgccggagctggagacgacggcgtacttctccatcttgcgcgcgaacagccccatgaaggcgcgctccaccggcccgtcccggtactccgtcttctcccccatcggcgccggcgcagtcgccgcgcaccgaaccctcctccctgcagacggtacacgcgaccatggcgccgccactggcgccaacagcaacgccgccgccgccatagtcgtcgtcgtcgtacgtcgtcctggctcagctcagcctctgcgtactcttggcgcgtctccaggtttcatgggcggtggtggtggttcttggcattggcgttgcgtcgtcaggcgaacctgaggctgccggcgtgacacggtggcggcgagcggggggccatcgccgtggatgcttggcactgggtgcacgacggccacaataatttggtggattatatggtgatggtgatgatgtttgtggcgattcgattggctcgtggcgcccacgattttttgtgtggaggcccaaaggatggcaagtccaatgggctaaaattttcaccttggaataagttcactttgggtccctctatttgtcactcagtccgattttcgtccctcgaccgcaaaaccgggtacgacccgtcccccaacttacgaaaaccgggcaaacgaggtccctcagcggttttgaaggcggttttggatgacgtggcatctacgtggcttgtttgactaggtctccgtcccacgtggaattaacgtagcgcttacgtggcaattttcaacccgaaaaataaataaacctcgcgggacccacatgtcagtttcacatagaaattataaaaaaggtggggcccacgtgagccccacatgtcattctctcccccccccctttcctccaccgccctgttccaccgcatcctcgcagcccgcgcccgccggcactcaccgacgaggcgacgacatgaccccagccgctgccgcagcccggcgaccggcggcaccacccacctccctaacccgccgtggccgctcggggtaagacggttcccttgttgctgctcccgccgtcctccgccactcccgctcccgccgtgacgacgcaagagtggaccacgcccggccgggcgtaggtcgacggtggcgaccagctgtggagcggagcaaaggccggtgacgagcgccgtcctcggtgccccagcgaacagcatgaggcgaggccccatcgaccaggctcggaggggatccggccacccggcaacggcttggagtagaggatagaggagatccagcgaccggcaacggcgtaggcggaggagctcgggggtcggcaagtggagagacgggcggcggcgaggggcccatcccccggcggatggggacgtcctgtggccacggagcccggcggatgtcgacgccccatcggtggaggaagtcggccggctgcagtagccaccgcaccagcggctccgcttgccttggcagcgctaccgcggacaacgacgccgcggccgctccccccgccgccgggtcgacgctcctctgcgcgctcgccgacgctctgtgggctcaacggctgcggcagctagagccacctcccgccgccccttcctctcccgccggccgccgcacgccgagcgccgctgcctctccaccgcgagagaggagaggggagagagagagttgaagagagggagatacgtgtggggcccatgtgggccccactatatttattatctgacttgtgggcccatgtgggccccgctattttaaaattattttttgtgtgcatctgacaggtggtcccatgtttttttattaatttttcaagatataatgccacgtaagcgccacgtcaatgccacgtaggacggagaactagtcaaacaagccacgtaggcgccatgtcagccaaaagcgccctcaaaactgtcgagggacctcgtttgcccggttttcataagttgagggacgggttgtacccggttttgcgttcaagggacgaaaatcagactaggccacaaatagagggaccctaagtgaacttattcctttcaccttccgccctcggcctgatggacctaggcctatgtctacatgggctgaattcacatttcacaactgacgtaggctgagttcgtttcttttacttccccaactcacctctctctcttttccgcaggcacgtttttaaattattaaacggttttttaaatatatatatatatgaaagttttttttaaaaaaaatcatattaatccattttcaaaatatagctaatatttaattaattatatattaatgaggagtatttcgttttgcgtgcgtgggatctcaaccatagaactcagccgtagtgtacttattggctactttattgctatacacgtaatgtcatcgcttatacacttcatcccataaaaacgactttttgaaatgtgtcgtctataggttctactcatccacgcacgtaaaacaaaatgtcgcattagcgcacgattaattactttcttattttcatatcttatagtttcacaactacattttacacctcaatgcataaccacacaatgttattggacgtagatcttctgcagcactgttgctgcaatagcaatggttttcatgtgaacccgaattcacacgtcagtgtctaccattgcactagcaatactgtacataatctcaccatcggatgtcatttagttggaattaaacccggaatacatataattttcatctcttattcctccctacgccattcgtatacgcaagtacaatcgattaatcatcgcaaagagaaaagaaagaaagaaagaaagaaaaatctatactctcgatcaccaggctacatcagtgtgccagtaaagatgctgaaattcatctcgaaacaagatcatatattccacttgatatatctcacgattctttacgtaagttgctgtttaccactagttataacttgatactagtacatcagcatgtcgatatattgcaatcaatacgatgggaagtactattagctagtacagatcaaaaagtaattaatccattgcaacatgagaaaagttcacatcaaacctatcctatcagcgtccatccagtagagaaaagattagaggaaaaaaggagcaagagagctatgtacgggcgtaaaattacgggacagggctgaaattcgttggaatcctaagaacgtgtgacggcttctctgatacaagttgattaattaattaagctgagctttctgtgtcccatttcgtcaattaattagctaccctctcacacaaacacatttaccatttaggccgagtttagttctaaactttttattcaaactttcaacttttccatcacatctaattttttatatacataaacttccaacttgtccgtcacatcgtttcaatttcaaccaaacttataattttggcgtgaactaaacacacccttacccacactcgaaaaaataaacgccagaatgcagttgtataagctatacggttgaacaaatactgattataaaccgtacagcttatcggcaatgaaataatactaccaatttacaggtaaaacttttatatatgtttcttcagtgatttaaattccaatgctaaaaaaaactttgatgaaatatctcaaagtcaactctaaaattaaattttaatgtttaattaaattagatggctgcatgtaaacaatagttatactgaagttcaaatttggcatctttttcttaaccttctgcggggtcattggattgtcaaaagctagcttgcaacttgctctgaaatatttcatgaagattagataagtcaaaagcctgaattaattgtccttgttgtcgggacaatgggacataagcgggatatggtattttgtactacctccgtcataatatgtaggatgaggttaaattatactagaattacgaatccatgaatatgatgtgtttaatcccatcgtaggttgctacttgctactcccaataaaagagagagtatatgttttatcgttacaaacatccttgtacgtactttagattgtcctagcattagattataatttgaagcaaaatttaactttgaaaattacaagcacctaggacggagggagtagattggaagcaggtttcttcaatctctatggcctgcctcgatcgaatgccctcttttaaaaaattttctcggtgaaggtacatatgggccggacagatcctaattagccagcaccaggcagatgcatcccgggatatgatgggattccacaaaataccagatataaatccagatggagaccataattctaattaactaaactgcatgcatgagatctggagctgtttaatttcatcattagctagagcaagccagtttagcatacatgattttcacattaatttatgcatactatagttatttcacacaaactcgatcactgtcgaaccgtcggtttcattaagtttgatccgccgtgcttaactgaaacatagaaaaacaataaattgaaatacgaatagaaacaaaacatgcccatgctcatcgaaatgaactgatcgatgactagctatagcttctcctttatttaattaattcggtaaaagtacagcaattctcatcatgcactgagctctactacatgtgatctgtacataattacacacgcacataatccatagaaagaaaagcagaaaaagatgagatcgatgaactccaagaactaaagaattaattattacatgcacgatcactatcaatatatattgtccgtgtaccgtaagttgctgctagctagctagctagctacttgtcgattaccaccatggacaatggcggcggcggcggcgggtggccggcggcgtgagatcctttgtgatcacttacagtagacggcggttgcaaggagagggcgaggtagacgatggccggagtgcaggcgaggacgaggccgacgggcaccatccacagccggctgttggacgggtggaacgccacggcccaccacgccagcagcgacgcccccgccatggccgccgccaccaggcacgcgtccacggcgacggcacccgctgccacctcgccgccgatggcgcccgccgccgccgccggcggcttctcgtcgtcgtccatgccgtatatactttggaatggtgacaggaagaaagaggaatgaattgaaggtggtcaatggcggcttattagctctgcttcctgtatggctgtatatagtctcgtactactggtgttggtgtgatgtggtggtttacgttattggaattggaagctgcacccaaccattcactgcctataacttactctttccttcctggtcttgcaccactcggtgtaggtgtgttctgggcatgacaacaacttaacatcgagagaccaaatagattgatcgatcgcccagttcgattatttattttattattgtataaaaataccttttttccttcacagaatttaaacttatttctactgtattgcttattattacacttatttgttcaaagctactgttagttaggagtaccgtttcttaaaataatttactgtataattagagaaaatccaagaaataccattaataaacactcaaaatacaagaaatatcatcgataagtgtgagttccataaaatgatgtcgtacaagtgattttatcccagaaatgctatcatcgttagggttccgtccattccgcgccgttaaatgcatgttcattctatagcatttaatggagtgatattaatgtaaccctgatggtgatggcacttcggggataaaatcacttgtacaatgacatttcatgcaacttgtacttgtcaatgatatttttttggaattgaacgcttgtaaataatatttcttggattttctcatataattaagtagctagataatccgtgacaacattgcatgggacgaggaccaaatcaaaccagccatgtaggcaccatatcagctaaaaccatcatccaaatagcattactgtatctggttttacaaaccgattgaggggcgtgatttgaactcgacgcttattgaaggacctaaagtgaactttttactttctaaaccggagtcaggaaagcccatcaattatatccattctttaagcccaattatcaaaagcccatttcagttccttccctgtctcggcccaaacctccccactcggcgacgcgaccaccaccactctcttcttcttccccattgccgtcgtcgatctcgccggcgacaccgccgccaccgcgcctccgcctccctcccttccgcggatcgtggcgggctagggcgtggactctcctcctcggtcctccacggatcgagcccgccgccgatgggggtggtgatcgagcgggaggagtgggcgctcacgccgctcgcctacccgctcctctccgccgcctccctcgccgcggtgctcctcctcccctacttctccccaccgttgcacgccaccgccgccgcgtccccgtcgtcgcactcccccttcgacgtgggcaccaccccgttcctccgattccgccgcggcttcctcttcgtgttctcgctcgcgtccggtaagcgctctcctccattcaccattctgccttgctcgagccagcgtgcgggggggctctgatgggtctcagttgttgtgtagtggcggaggggatccattccgtgttcggggaggatgagttcgcgcggtgtgggcttggaagggagcagatggccgcgcgccttgccgccgccgcagcagccgtgctcttcctcggtgggctttccggcgtcgtctcagataaactgtgagtagttgtgacttttggggagcaaactatttatccttttcgcagctctgtcagtagagattttcattcagactatgaattgctgctggatggtcgaattacttgtaaattcatcaaattcctcacgcttatgtgatctcccattgcatttcgaaacaatgttgatggtattcaatgtttaaatagagggactactgcttcctagtaatcaggcaagctatgtttggtgcctgattctggaacttttgttgactgttttgtttaaaatctagtcatgatgtttactagttggtggttaagatcaataagagtttttcattcatgttgaccctgctggtagaacatttttttatccttcacttgtttattaccaattctataccaagacataccccttcaccac

SEQ ID NO: 74814 - DNA, 842 bp, Oryza sativa
ggggtattgatgaacagatattcaacttgtggctttgccatggctctcttcctcctccaactctacctcctatgattctatttctctaattccaatctcatgcttctgccttccctatattactcttcccaatccctgattctactctcttgattgtattcctgagcacttgtattcttgagtggatttgcaacatatcggtggcacttgtgtgagaaatttggtgtgattgtgttggttcgtgatagcgacctagaagtgcacttgctgagttttcatatatgagcaatcagaagttagatctattttttcctctcgctctctcttttttttttcaagtgaaacacgacgatacgatgtaaattgaacaaccttagcacatatggcttacaatgtttactccaaacacaaatataaccagagtgccccggtcgtgttaaacttcaacacattcttcaaagaaaaacagaacaaggcttgcattgaaatttcccctgaactcacgagtggtcgctactggtacatggcagaaagctcgggcggattaccggcgcattgtgctcaccgaggtaggggtgaaaacggtatggaaatatccaagaattccggctaccgtttccggtttgcaccgaccgtttcagtcggtatcggaaattgtcggtgtcggaaatgaaaacggtaatctcttccggaaatgttagcggaaatgatatgggcttttttccgaccgttttgtcggtaaccgttttttatcggtaatttccgtcaaatttccgacaaaattccgaagaaggaagccgtgttctcgaagactcaaatctatatctaaaaaaagtcggaca

SEQ ID NO: 74815 - DNA, 5075 bp, Oryza sativa
tgcgacgacgtgcagtctcacaaggactggatcaaggacatcgaggcctacaaggtcattttaattaccttcctggcctagttaaatttgtgtgaaaacgtagtaactaattaactagatcgatcgtaataatatatatttttttggttatagcctgggaaccgcgtgacgtacccgatcatggccgatccgagccgcgaggccatcaagcagctgaacatggtcgacccggacgagaaggattccaacggcggccacctcccgtcccgcgcgctgcacatcgtcggccccgacaagaaggtgaagctgagcttcctgtacccggcgtgcgtggggcggaacatggatgaggtggtgcgtgcggtcgacgcgctgcagacggcggcgaagcacgcggtggcgacgccggtgaactggaagcccggcgagcgcgtcgtcatccctcccggcgtctccgacgacgaggcgaaggagaagttcccccaggggttcgacaccgccgacctgccgtccggcaagggctacctccgcttcaccaaggtcggctagatcatatcgatatcgacctcgctcttcgtacatcatgtgcgccacgcgtgcgtgatagcgtgtgctggcgtgatgactatgcgagatgcatccctgtgtgtgttggtgtggataatgccgctacgtttggaacagtagtgcatttactctgtgctactgtctgaactttggctgtttggcagactgtttatgtacccgtatgttcgcccctgtactaatagagtgggtgttgtggttggcaagtactctcctcggacaacattttaactttgactactaataacaaacaaattaaaaagatcaatcagatgttactagacatcttaattttattaattttatagatattgatattgtttgttcaaagtaacatcgtaaagttctaaaatgtttatatttgggacggaattaaaacatcttaattttataaatattgatcaaaatagcatcaaagttctaaaatgaagccatcatttagtatatttcgttaatgaaatttagtatatattgttaataaaatttttatatacgtcttcttagtaattaaagagctttacaaaacaaacttccataaaaaacccctaaaacaaacttcgataaaaatttttatatacgtcttcttagtaattaaagagctttacaaaacaaacttccataaaaaacctctaaaacaaacttcgataaaaaaacccctcgaagataaaaaaagaccctcaaaattaatttgaggttaaaaattaggctaaaaataaacttgataaaaaaaccacccctcgaagataaaaaaagaccctcaaaattaatttgaggttaaaaattaggctaaaaataaacttgataaaaaaaaccttaaaattacttttaaaatgatttatattcatgatttatattctagtacggagaggattctagtacggagagggtgggtgcatacatgcacattccaatgtaaccaaagaatgagaacaaatgattaaaataataataaaacagcgtacacgaaaaagagaaaaaaaaggacgaagagattttagtgagacgtacgcgcaaaattctcagtcgaatccggccgtaaactctccataggaaaagggtcgacaataggtaatcacccaaaccaagtggttaacgaactaatcaggttggcattgcaacgtcatcgatgatgaaatcaaacgccgccttttagtattttatagtaggagggtcagcctcttctttggaaaaaaaactgtgatactacgaggaagcaatcgtccgttggcatcgctcgcgtggttagttgtcaggtcgctccgcttcattctgctgtgcattttggcgagtgcctagacagatccgtgatgaacagtatatgaaattttccacactttggcctggtttagttcctaaatttttcttcaaactttcaactttttcatcacatcaaaactttcctacacacaaacttccaacatttccgtcacattgtttcaatttcaatcaaacttttaattttagcgtgaaataaacacaccctttgattacggtttagtcagaacatttgcgaattgcaatgcgcgcgggtgaaacacctttatcagacgcgatcgggaattcaggatcgggaacagctgcgtgccgtgcagaataatacttcgtattacagaaagtttagaatccgtattacgcgagagcagagtcgatgcagtgtgttttgagtaggggtgtgaacgcagctgaacagcaagcagagttggcagattcgaattcttgtcccgtaaatttttccttgccttatcctacacccaggcctagatgcttgctttttataatcctctagtggcaacacagcctcacctataaatgctgtgactgatgataagtccagtgcattccatcacagacagttcgcagaatcgcagcagcttagcttaattacttttttcaccaactcaactttcagttaatttccggttaatcctcgattcctcatcatgcctggactcaccctcggcgacgtcgtccccgacctggagctcgacaccacccacggcaagatccgcctccacgacttcgtcggcgacgcctacgtcatcatcttctcccaccccggtatatatagtgtactactgcattactgtcgtactgcgtgtgtccgtgcagcagacgagcttgagaagttgagatgttgatcaaatccgtgcgtgcatttcagctgacttcacgccggtctgcacgacggagctgtcggagatggcgggctacgccggcgagttcgacaagaggggcgtcaagctcctcggcttctcctgcgacgacgtcgagtcgcacaaggactggatcaaggacatcgaggcctacaaggtatgtacacgatcgagttcatcgcattcatcaatccttgactgattgatacatttgcagagtcgtatctgattataatttcttggttcaatttgtgatcgatggttgctttagcctggccgccgcgtcggcttcccgatcgtcgccgacccggacagggaggcgatcaggcagctcaacatgatcgacgccgacgagaaggacaccgccggcggcgagctccccaaccgggcgctccacatcgtcgggccggacaagaaggtgaagctgagcttcctgttcccggcgtgcacggggcggaacatggcggaggtgctgcgcgcgacggacgcgctgctgacggcggcgaggcaccgggtggcgacgccggtgaactggaagcccggcgagcgcgtcgtcatcccccccggcgtctccgacgaggaggccaaggcgaggttcccggccgggttcgagaccgcccagctgccctccaacaagtgctacctccgcttcacccaggtggactgagagactgatggtgagggagggagggagagatctgggccgtcggtttcgtgtgtaataaaccaacgcacgacgtagatgcttccacgtgtgtgtttcccgtgctgcttcgattgatcgatcgatcattcggtaagtactctagttatgtgtaatctgctgtttgggtgtagtggtgcatttgctgttctgttgcctgaaagtgacgaacggattatgtttgtcatttgtatgtaaaatgtaaccgtatgttttttatttatcccttccgaaattactgtggaatatagtgaagtaatgctgttaataaacagcccgtttaaatatgttttgtccgtgatgggttgggcgtttgagatgaaacccatcaagagtggtccggtacagttcatttaactaatgggccaaaattctcggccttacaaagattgtaccttacaaagtccgtgatgtactgaaggaataagttcactactttagattcttcagcgtcaaaaaaaaaaaaactactttagattccttagttcgtagccggtctgaaattacgcgtctctcaactttttaaaacaaatgcaaataaagtttcaaggtggtttagatgacggtttcggctaacatgacgcttacgtggttggcttgacttgatcctcgtcctatgtggcggtgacgtggcattagaagaaaaattaaaatgtagggctcacatgtcaccaaataaagataaagaaatagtggaacccacctatcaataggtcccacactcctctccatctccagcgaacaacgacgcttcaacacctcctcccccttctctcttctgtccctcctggccttctctcctcctccccgagctctcttgccagccggctgccgccgttgatgtccatagtcggtggtggatccagaaaattagttcgttggtatcgtaacatgtttagcagtgttatagtgtgttaactatatttagattataagttataatatatagataaacagtctaagtatatttttttttctgaaagtcgcctgacaccagtccatacgcatgtcactgaaattgggcttggagctcagttacagggctcgcagttcatcggcaaccagattagcaatcttcaggatttcactgacagagaacatcaatactattttttttattatattatgtatgggctagtatatatgcattgaaatttgacagtgaggcaaccaatggaatgcttcctttcaagaaaagaaaagggattgcaacctacagggaatctcagtcatgagagcgagtcgatcttaatgcatgcggcatgccaaaacaaagcggatttttgccgaccattatattcagctccacaaagataaatggaaattaatcctattatatcataacaactaattcattgctgatcttaaccatgccctccgaggaatttggcgtgtgctttgggctaatttggcgaggtaatacggtagtatagcacggttatagccaagctgacatgcatggcgtccttccagtcgccggctggcatcaccggcttgtgccgaatcattagcattgctgtgtctttcgtgcatgtggtgttggatcatcttattatggcatgccaatggcagtgatcgcactgttctctactgggcttacgccatgagcctcgatcgtgctcctacaatataat

SEQ ID NO: 74816 - DNA, 1177 bp, Oryza sativa
aagaaatagtggggatagtgcatgcatcaagtttgatgctagagtaaatatagtatgagagagttattaacttttcttggtcttagtgtacctatgaaatatgtagatcaatttggaatggagggagtactgagctaatataaacaataatgtcaaatctgatatccagaacaatccaaaaaatctgactaaagcagccatcaagctcaagccacagttgtaatgaaacaagcaattgaaaatgtaaacatacaaagggaactcttgaggacaaatgccacatatacctgtgataaagaatcctctgcccacgagacacctgatttataatagctctggaggcataagaacaggacagttgcatatatatgtgactcaaatttgctagcagaagaatcttgatcatagtggtgaacgagatcctgcaacagtttagttcattagttcctgatgtaacagtacttatgctataacatttgagtgcttgcagacatgaattctcttataccagatttggaccagagatggtagatctctttccgaccagcaattgtttctctatgtactgtgccattatccgcccagctaaaactatatcagctggcaaaacagctgcccaacaggcacctccacattcatgcctatgttcagcaatttgtttagagtctggagtcttgctctttgtagaagttacactcaattttgcaatatccaccacattattgttagattctagatgagtattttgattacaagacatttgtcctatagccttctcctggcacctgtttgaacagtaaatgggtattgtacatgaagggcagactacgacatctgctggagcttcactaaagcaatagtggcagtgagtatcccggcaagatttcatgataatctgcatacaactgtacaagtaagaggcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtg

SEQ ID NO: 74817 - DNA, 18872 bp, Oryza sativa
tatatatatatatatatatatatatatatatatatatatatatatatatacatatatatacatacatatacatacatacatatatatatatacatatatacatacatatatacatatatatatatatgtgtgtgtgtgtgtatacatatacatatacatatacatatacatacatacatacatacatacatatacatatacatacatacatacatacatacatacatacatacatacatacatacatacatacatacatacatacatacatacatacatacatacatacatacatacatacatacatacatatacatacatacatacatatacatatatacatacatacatacatatacatatatacatacatacatatacatatatatattgtagagagtgggaactgactaaagaggctcactgttaggttggtggtgctggtggccagtggccaccaccactaactctttttaatctagtatggataatcagtgctgacatggtttctatttcttgaaggggtaaagtgtattcctatgtgtttatatggcgagcgtggtcagtttatatatatacatttgcagttatattttttctattaaaaactctactttttgcatatttttctcttatttgagaagagtcccgtcaaccaattagatcttatatgaatttattattcagagcaatttactggctttagttctggggccaacttcaaaggagtgaaaaagacacggaaatcatatatgttgcatgctagattttaatcaataatcatgtagtttttgctaactttaaatagagatttagtaataaattgaactttgaataagctactatttttctttggttgatatggccgtcaggccatgtcgtcttttcatctatctttatttatttctattaggctttgagccaaaaaatataatttataataaaatattgcagtttcagttggagtaaacaccgagtttaatattcactattaaaataaacaactaaatcctactatttaaatcaggttacttcatgatcaccatggacccacttgttagtgagaccaatgataaaaaaaaaatcaaagtgacttaaaaccagaggatccacatcctcgacgttaaacttctgttgctgaactgcatgcttaccactgttttgctctcacacgcatcaaatgcacgcaaggcgcatgcatgcaaaagagcgttacgtgcgcgctcagcctttgtcgcgcgcgcgcggggatcggtcgtcagatcacatgatcagctagcaaaatctgccgccaattgcatgttggttgtggctaagctacctgttcttaattagacaagaacaaaatggagggacaaaaagggtgtcatgtgttcatctacagctagatcgagccaattatgcaaagcacgcccgatcgatgcatatggatcccagctagcttagctagtacgtgccgtgtgcgaccacactcctcattttctttgttggaattgctaagccatcaaattcgacggaaatatatgagcaaaatctggtaaattttcaaccttcggatctactttttgcgattcatcctccaagaagttttttctaagaaattgaacaggtttcgctaaaattcgaacaagttagtgccaaattcaatagaatatgaaattcaatagactatgggatttcttttgcctgtaaaaatatcctaccggaacccaaaatggtaaacgtggaaatttgtgaatctcgtaaatttagttacaaaattgtaaacccggttcgaaattgaagcgaaagttggagaaacaccagtgatgtggtggtgaagtcgtgagtgtatgactccacacccacccgaatttatattctagttcctaggaatcttacacatatgtagctgggcttctaatagaattttactaagatcagatatgtgccgcaggttttcatctcctagagtgtgtgttaggggagtgtattcgtgacggtgtaagtgtggtgttacgtgtacagtgatcaacagtgaaaacctagaaaaaacttatcgagggtccactacatactaattatgtagttgttggttggtatactaactaaactaatatagtataaaataaactaggattgaataatttacctggtgtcctgtgatccgggtagtagtgatatgtgtgcgtgtgcctttgttgtgtaatcgaaaaaactaaaagaaaaaaaattgaagcgaaagttagctagctaggagatcgatagatagtgcaaattatatatgtagtgaaaacttaaaaactatcgttaaattgaaaaatgatcgctttagactcgcgcattaatttttggatccaacggtattttcccacgttcgagagaggtacgttttcttaccgcgcggtagcgtacgtacagcgtgagagcgcgcggccgttcccctgagttgcgaggccctgactggtccacgtgaacgcattcatgcgctgcgcgggctggctgcgccggcgcgtcggctccagccgcgcgcgcgcgcgcggcggggctttgctgctgtgtttgtcagccaatggggtcgtcgacgtcgcgcgcccacaggtgacgcctccgctggcgctggcgccatatgggcgcgcatggccaatgtcccccatgccatgcatgcgcacctgcgcggcgcgcgcgctcctggcacctagggggatctatcggtcgccacagctagcggcacagatcaggctatgcgtacgctttgcagtgcgatcgatgcatgggccgcgcggccggcgatcgatatcggtcgcctggcttgctttgctttaggctggtcctgcatgcagtgcatgcatgcatccatgcaatgcatatggtggtcggtcgtcggcaccacgtacagctgcatgcaggatggatggatggatgcacggatgatggatccaattacctgtagattctcatcatggagacaagagtacacagtgccagcatggatgagtaaaactaccgtactcataataagcagattctgtaacgggaacttcttcaagacgtcgtcatccttctgagacagacttcacgtaagaggatctcaatctatggatcgatccacattcaccacaagaaatcaatgctgtagatttaacatgttagccttgatagcaagttggtggcgcgcgctgatgagtacttgcaggcataggcaccactgcacgcctctactacgcagggttgggagttgggagtaggcagctagtgataggttggacctggtttttatccggccggccagtttttgcaagcagagccatgacccatgagaggagaggtcctcgtacaccgtacacacgtgggagtgcttctgtgctgcgcggtggaccagcgtgtgcccatgcattgcattgcccgagacaggtcaccgcctatccgactatagctatcccgctttctcgctctctcatcaccgaccttttcgttgctctccatcagtagcggggccaaagaaaaagaaaaactaaaaataaactgccgcaaatgttttactccctccgtcccataatatttagcattttagattatttagtacagggacggagctagaacaaaaccaagcaggttccactcgcttactttactttggtttgaatcaaatttagcttgatatgggtgcctaaatttaaattaacgggatatatatatatggtgaaaatagataaactataggtaaaaattcttttgaaccgggttcctagacacccccctagctatactagctccgtccctgatttagtatagattaaagtttaataaaaaaactataatatctcttattgaataatgtatgatgggaagttgaatgatggatgagggtgaaatataatgtgaaaatttttacatggaaaaaaattgataggacaactagctatttcatagtgtaactattttgtataaaatttgaagagtaaattgcatattgggtcactattttttaccactctttcagcttggactagggatatatctacattttcatattggaccaggtaaatttacaaaagtttcaccttggggctgttctcacacctacagctccctctctcctctttgtgctctctcactctctctattccctcatcggatgctgggtgggctcaagatgcagtgtagcatgaagctgtcggtcgagctcgacttaagtgaggcaccagagctatttggactaaggtcaagcgttgagttgggctcaaggttgagcgcggcactgacgacagcgcgacagtgttcaaggtcatggtcaaacgcgtagtgacgccagtgtggcttggtggacgcttccatccaatgccgatgctgatccattcattcaccgacgaactaaccatccattcatttgtctcggacacattgatctccatgttgttgggtacatgtcaggcttgctggtcaccttcctaatggagaggatcagccgatcaagccgtttgctagccgggcgccaggttcgtcacattcctaatggggcagccagtgcaattcggtgatgattaatttggaatatggagaataggaaggagagctggaggtagaagaaccagcccaaagtgaagcaatgggtaaacataagtggtccaaagtgaaaatatttgtttacccctagtccaacttgcaacaatggtaaaaaaaagaggtccaagatgcaattcacttaaatttgaataataaagagataagtattttggaacaggggtaataagtgaaaaactttcgaataactctagtatattatagttgtaatataattttatcataactatattataacttataatataacttgtatagaaatattaaaaataagtttaattttttatcaagtatacatatcaattatgttgtaattatattatagttataactataatgtagtgtaattatattgaaaaatattttcacgtagatatgaatttatctggagcagagatcagtcgtctcctctagttcgtggaaggctcgaagcccaagttcgttgatcaagcccgaagattttactagaacatgtctttcaacatgccgatcgacccacctcttttctcaacccacctctctcattttccacgcacacgctttttaaaatactaaacggtatgatttatgcaagaactttctatataaaagttgttaaaaaaaaccatattaatctattttaaaaaaaattaatacttaattaatcatgtaataaaacagtgctaggaaggagggtttccaaccccctttcccgaacacagcacagcccggtcttcgaacgagcaaatctttgacatgggagcaagtctacgaccgaggtgtaaatttgtctcacgtatactccatatacgaatggacgcaggctttcgaatctcaagtgctgctcgaccaaagaaagtgagagagcttggcccacttccggacgagaaacctagcatcattttagatcacattatgtgccacttgccctttgaacgcactagctcttccttaattaaggatatatatgtaggtgaagaaatgcatttcttccgctattttgtatgtgacccattctcctaataattgttattgataacatctttattggtattataagataatttctctaccagcagtggcgtgcccacatataacttaccggtgtcacaggacaccgggtaaaattgttaaattctaactaatttatgctattttgattagtatactagtgaataattagataactactatatagtgtacgctgggtaatttttgttctaggttcgccactatccaccagtgaatgtaacttgagctaagatagtttcacgacaccgctcgtatagtagccatcgatagacccaaggctctataacctcgggcaattgcctagccacgatagcacgtggcaaagagaggagacacatcgctcaatggcttagaaagttggttctcgtctgacctttacaaaattttttgccccactactaaaagtatcgtggtgattggatatactaaaagcaatgacattcgcaccattaggaatagtgataggaaccactccaccctcttgtgacgtggtaatatttactctccctccgtttcaaaatcactattaagaaaaccgttttttaagacgactaaaaatcatttttgccgggggggaggggggcggcccgcctgtacacataagcctgcctgcaaaattcgcaggctgcatctccatcttcgcaggcgccataggcacctgcctgcaaaaatattttgcgcgaacaaaaaaaaatcgccaccacccccggccacccccacccacctctggccacgttgccgccgcaacccacccacctccggccggatctatggttagggttttgggatggagaaggagagaaagggaggggaggccattgccgccactgcctggagccaccgtcctcccccctccctccagccggatctgggaggagagaggggagtcgtcgctgccaccgccctcccccctgcccccttcatccggatgaatctgggagggaggggagggcagccgccaccgtagccggggagagaaggaaggagaggtgggaggagaggggaggcgaggggaggggagcgcggatgggagggatgcaaggaggagttaagggagagggacttaggtgactttttactgagtaggtggcgatttttatgatgcttaatctttttggtatttttgcaggcaagagatccgcatgtaaaaatagattttcgtaggtaaatgatgatcttgtccatggttgtcatttttgtaggcgtccatttagcttccagagggttacccacctggaaaataaataccatcctctgaaaaaatggtttttctggtagtgaatatatggtatattttattttgttaggataaggctttgactaataattgcttccctaatacttgtacaaaaagtataatcatacaaaaagaagatgaacctaataacatcaattttacttcacaaaaattttattgtaatagagtaattattggtcaatatattttttaaaacaaaataaaatatatatatatcctatatttcaaaatagatggagtacctgatatactgttttgctcaccgaataaaaacatgtacataatatcactaccacataacacctaaaagttgacagttgggaaacctccttaggtgtcggtctttccaaccggcaccatgtaagcggcactgataagtgcgccgacaccaaagccattttgaaaaccggcacctctgagaggttcgcgagccaaaaaaaattgctcaatgcaccggcttgaatcgagccgatgcatcgagctcatccaccccgcatcaatcaatcccaaattaaacaacatcacaggaaacattgaaaaacattacagaaatctttcactaaaacattacagaagaacatctaaataattacagaagaacatcacaggagggagggcgccgccgggccaccacctcctcctgccgccaggtagccaccgcctcccgccgctgggccgccaccacctcccctcccatcgccggatctggcggagggaaaggcgtcgccgccgcctcccctctcgctgccggatctggcggaggggaaggcgccgcaatcgggccgctgacgcctccgccggatccagcctgcgggagttgtcggcgagggagaagagagggggaggggacagggaggagagggagtgagagggtgcgccgttgctgatgcctcaggaaaggaggacgaggaggaagggaggagatggggacgacggagaggggaggaggagacggacggtggagaggggaggagtcgaggagatggccgagagcaagagagccgagcggggctcggtgggagagagaagcgaaagggaaaggataagatcgatggttgccttatctcttgcagtggaccccaccagctcggctcggctgtttagctggctcggcttgattcataggtgcccgtttttttaaagaaaacgacacctataatatattaaatgtgcagtgtcggttcttatttagaatcggtacctataattgcttaaaggtgccggtttttcgcgatttggctataggtgccagttttagcaccgacacctattttatgttttgtagtagtgtatgcatcttatacattaacttatatctgttttaaattatatatagtactggccggttggtgcgaaacgacctgagcccctgaactatcacagatgcaccctgacccaattgatcataaaacaagccactctcttaaatatataaaaaaggatactaggaaataaacaaagcatttctgctcatcacaatcaactctcgacggcggaactctaaagaaaacaattctctgattgcttgcctcattgactgcactagctcatatatgagcacttaaaaaatgcaacattcattctaaaataagtttatttttatacatcccacgcatatcaatataatatatttttatcaaattccaatacaactatttttactttatttactcttaatgtatttattcttttactttggtaaactctaacataataattacattaaaaataagcttatttgaaataaacatgagaaacctaaaaataaacttatcctagaccagatggagtaccagcgttgatctttctgctttacaaaatactccatgggccccacacgcaccagccgagaaggggaggggggcaacggcatacagcaagaatgtggaatgaatgcgagaaaccgcaatacctaccgatttgacacgccacttaattaaggagagccgcattaactgagacagactttccctttgcatttgccgccgtgtttagttctaaaatatttcttcaaaattctaacttctttatcatatcaaaaacttttctacacacataaactttttaaatttttcatcatatcgttttaattttaaccaaacttacaaatttaacgtgcactaaacacaggcattcgcatccatccatgcatgaaaccagccgctctgttcctgcatgaaaccagccgctctgttctgctctgttctggtactgtgtgctctgggcccacctggctagccaccccctctgctggctgcctaggaacaacgggaaaagctatcccttgtgtctccctgtctgtcgccgggggcaggcatgtgatcacgtacacgcatgcccacctgccggatccatcagtttttagctacccacagccagctatatgctctcccctttccagaataagtttatttttaccttttcacctatatgctaagattaatttatttttaaataaccattgcatatcaaagtttacaaaagtaagatatatataaatttattgaaatttgagaaagtaaagatatcttgatatttttattttatattgatatgtgtgggataagtgaaaaataaatttattttagacggagagagtaggtagcccttctctctcttaggctgccctctctgggtgatcactgttttctccttgcctttccctttgttactgttgcatataaaagatcatcaatgtttaaagaattggagctactgtagtcggttgatccggaaatctagaaattaccatgttacttcaaggacgaagaaaataaagacatgttcgacgatgggtttaaattacaatggtattagattagatcattttacccggaagatactccctttgtccttaaataatttagtcaaaaacatcttatgtatgaaagagtttaaaaaaactattatgtcctttatatatggaaagaaaacgaggaagatgaggttttactattggtgtacaatgactaaaaatgagacggaaaatatatagtagtattttagaggtacactaatatagtacgccaatagtattttagtctaagaatttgctctaaaactaaaaagttttaggtaaaaattcttatactaaaaccacactttttttgtaatgggtggagtattaatttgtttggaatgtgggtggtaagtggatagcatgttatgaaagatattctagattagtgttggtgaacataaagctttccatgtatgggtaaaaatgggaaattgaacattgatttccatgtgttgccaaatatttgtaaattactttttttttgtttaaatcatcacttaaagaaaactgagagtgatgtggcgcatctccggcctttctggccttgtaatatatatataaagatagaaaacaaatttgcctggaacaataagcccttgtgtgaaagcaactatgtttgatgaaaactagaaaaataagcacatagtatctaacctaacctagtggtactactctacgcgaggtgatagagctagtacgtaccagctagctagccaatcacgatatacaattatacatccgtatgtaaatgattcacaattggattggttaaaattttaatgttaatttatataatttcaaagtattaaatattaattttacgtacaaataatgtgattttggactcgtgatgacttttttatattaatgattaattaataatcaagtgtcgaacacgttttgttaaaaactaagcatatgaccaaactacggtttccagtgtgttcttttctcctttattaactctactttttcatcatccacccacccacaaggacgtttttaggaaaaaaaatttacaaaaactgttttaaaaatcatattacttttttaaagttcttttagctaatatttatttaataatgtactaatctatcgctctattttacagtatttagaaaaagatttctcgaccattcaaaaatacagcctaaatgattcatcttgggcatggtgtgaacatgttccacgattagtttgaaacgtgtatggaaagattgctttcctaaatatctattcaacaaaatcagccagattaaactgcacgaattacgtacgcccaattaattacatgccaaatgaagcaactgcacgccggagagatgacatatatagcaccatgtaaacctgccatatgccaccctcttgcagcccaacccaacccaataaggatataaaaccactcgcggttttgcacagctagcgcggcgcagtgtgtaaccgtccagggtgacacaattgacttataaatcacgcttttaattaattaattttcttcctaaacatatccgctaatcccccatcccaggtggaatataaacccccgcaagagggagaagaagaagaagggcgaggtgagcgaggcgagactcgagagagaggagaagatccagaaatcgcaagctgcacgctatagctaggtagctatctccggggaaagagagagtaggctgccatggagagcttcttcgtcttcttcacggcggcggcgttgccggtggtggtggcggcggcggtgatcgccgggctgtgcattacggcggcgtggctggcgaggccgcggcgcgtggcggaggtgttccggaggcaggggatcgacggcccgccgccgtcgtcgttcctggcggggaacctcccggagatgaaggcgagggtggccgccgcggcgtcggcggcggcgccaacggcggacggggaggagaccgcctccgccggcggcggcggcggtggccgggacttcgagaaggacgggttcgacgactactgcaccaggatcttcccttacttccacaagtggaggaaagcctacggtacgtgtacacaagcctctctcctctctactgctcgatttcacatcactagctacatgcatgatgcttgcttgctttgcctgttaattactccgctcatgtgtgcttaattagcttaattaattcacactccggttaatcaagtcatgcaaaacccacaattaatcagctatcaattgagatgagtatataccagaatatatatacttacagtaaatttaataaaaaaataaaaaaaagaaaagaaaagctctctcgatctctctgtgacgatgatacaagaaatttgtggttgccctagtaacaagttgactagagtataaaagctgctaaaatgtcaagagctctccatataaaaaagaacagtgggggagaataattaatactgtcccaaacagcgagaggaagagagggggcaaacgagaaaagagagaataaacaaaattaatgcaggatggaaaccgtggttgggacgaactactcggtttgcttccagtcaaccgtcctgcatcattaagctatggattaataattaattaactgcagtatataaatatatatactcccccacatatattaatcggtcgttggtccaattagacaacagcaaagccatgcctaggtacctgtctaggtaggctatgactgtagtacactcgtactactcacttaatagcacattagtgctcttattttgcgaattaatgaaactttaatcaataataactatatataactataatatatttagtataatttaacaatatatctattcagcgtgctatcgtttcttcagcctatcaatcaacttaaaaaacttagtgttaaattgattttggtgttttcttatcgtaatttttcttcagttttggattgttttttaagttgctaacaattttagttaacaaagctatttggaaggagaggaataatgcatccatgacaaaagtatatgcttcataataattttcatataccagatcttgcccctggtggtgacgtgttaccaaataccgactggaattaatttcttctctctttctttttctctctgccggtgcaatgaggcgacatttttgagttataactgtgcgtatgaatgcatgtattaattgctgtttgctgaggttaataggctagcaataccgttgttttgggggaccccgcagtttgacctagtagagtttatcatggacgcagactgcccctacctgttcttcttcacggacagcatgattaattagctatactagtggtagtactcgatgtcattaataattggtctctccgtacgtgaataattatcgatttttgactttgacaagtactccctccgtacttgttaaggaagtcgttttagacagcaacacggtctccaaaacacaactttaacttcttatttctataaaaatatttattgaaaagtgatatatgtatacttttatgaaatattttttaagacaaatatattcatataatttttacattttaaaacttaatggaaagttacttttccaagatttgactcaaacattgttctaaacgatttcctttatgagtacggaaaaagtatgttttttcactgttcttatgaagtgtacatggaaagtgatcgaatagctctgagcagtactctaggtagggaattacttttagttgcgtacaaatctaacaattaattaatatgccatttttagtgaacataattgtatattttctccgtttcacaatgtaagacattctagcattttccacatgcatattaatgttaatatgtctagattcattaacatcaatataaatataagaaatgctagaatgacttacattataaaacggaggaagtaatttatgctagaatgacttacattataaaacggaggaagtaatttagtacatcaccttcgtcgattattacgaaaacatccatcatatcgatcgatatctgtgtatttgctactccagaaaaatattttctgagaccgacccacagatgcatatatatgcacattattgtggcggttttcctttctttttagatcaatcggtggcctgacggccggcccagcttcgattgaaattaagctgaataattattgtggccgtcatgtgctaatcacccatataattaggcgtggttagaacctgactaagctatttaagccggtcagttaggctttcccaaaacggccatcaggccatgcatgttgccattagctgtccgagcacgccggccaaagctcaaccctcgtgatcacatcaactcgatctccccgatgcttatccctttttgcaagcaaccggtatgtggtgcttagataattaatgcaagaattaacagtgtacctcctatcaatttgccgttagctatgcatgtaatggattagaaattctatatgcatgttttcgtctaacagagtttgatcagcagcagtacttagctaactaattattctgtaatttatataactactataagctagagtttaagcagagtatgtaagtatgatattttaactaatttagttcttgtcatatggcactgtagttgaaaccataaaccgatcaattaataggacaaatattcaacctggttgcctcactgcatgcgttgttttagtttgacaaatgcatgcatgtgtatgatattttatttgcttggcccttaataagtatattatgttgaagtcatgcatcttgacacagaaacttggagcaaaaactatataatatatttcaagaaccaaagggcctgaatactagtacttgcctacatcgatcacatgatgctagtgtcaatcttatttaaggtttttatttcttctttaatgtcaaaatggctattgtttaactatctaaaaacaccaataattagaagactcccactagaccatctcatgatgcattgcacgtaggatcgatatatatggcaacattaattattttacttgaacatctaatcgcgttcgctattattcaacttatgttacatgttctcccctaatttaagcaaaggccggtttgaccaacgggaaacaaataattaaattgatcttccaggcccagtacttatattaattacctagtcattaactacattttctccatatttaatttgaatgcttcgttctgaaatatttaaaggccattaacactaacacggcacacaagaaattaatttaaatatttaatttggctagcatgtatacatatatatgttgatatgcatggatatatatatatatatatatatatatatatatatatatatgtatatatatatatatgtatatatatgtatatatgtatgtatatgtatatgtatatgtatatgtgtgtgtgtgtgtgtgtgtgtgacaatagctaactttagatatgtttttttttcgatgatacatggtcccggcctctgcatcacaaatgcacacatccaacgaatatcgtacaaataataataaaaaaagtgatgggacaaaactcccgactcctacataagacttaggactagtgagctaagggtgtgtttagttcaccaaaattggaaatttgattgaaattagaatgatgtgacggaaaagttgaaagtttgtgtgtgtaggaaagttttgatgtgatggaaaatttggaagtttgaagaaaaagtttagaactaaactcggcctaactgaaaacaaatcaattgatatttgttttcagttatgccgagtttagtttgacaaaattaaacgaaaccatacaatatataattacaaatcaataattaattcctaatgctgcttgatgctactagcttctctcctacacagtgccattgactaggtaattgctcctaaccctagctagctaagcatgcagctcgatcgaatcgatcgagcatgaaagcaacaggtcgatcgatagatggtaagccatgacgatcaatatgatcatatcatgcatgcatgacactgtagagtgtgtactacgtactaccaccactccaccaaccatgcatgcattcctcccccctctctcttgcaccttttaaagctagctaggacgtgtggggacttcaatatatttcttgtgcattgtctctcctacaaggattcacatggagatgtgcatatgcatggggttacaccaattaaaagtgcagcccacactctatggattgaaggtgctagctagatctctgtactctatccgtcccaaaatataagcatttttagttataaatccagatagatagttatccagattcgtagctaaaagttattatattttaggatggaggtaatatagtttagatggtggaaattaagtctagtagctatggggaaaaatggcaaaaataaaattacagtatggggttgtactggaaaattttcatttgaatatatctcttcacaaatatgtaagcctaaatttaatctaaatatatatgggcacaaatgaattaaaaaacatattttctatgaacatatatagcaggaataatatgcattcctcgattttattcccttcaagtgttcatatagtacgttaaaagtttgggttaaaaattttaaataatttctttagttattttgaaatggtatgaatgaaataagagcgtatacccttaagtcataaaagatcatccagattgaataaaaaaacaaagttaagataattaagtagatgaatgtaaatgtgcatatacatatcttgtctttctgttgactagttgtctgttcagaaattatatggcggaaaccctaactgaggtgaaaattcatgtgtaccaagacaaaaaaagaaagttctgaaatcacacaaacaatctcataagtagataagatgatagtgaacaaccatgtaaagatcttttccaaatttaactttcatttgtcagatataaaatgacaaattttgaatcagaaaatattttttttgtttgaaatttaccctcgtttcttgatctgaacagtaccactagatacacctagctacatgtatggtcgattgtgataggctcacacacatgctatagcttgatggttgtcatggtggttgcctagttggcaaaagttcgatgtccagctgtgctactatcatgataattggcagcagcctagctagctagttcaaggggacaatattacactggctttaataatttcctcgtcaccaccttttacctcaaaaacatattcttgaaaaaatgaagaatatgatcatttcaccaaaaatcatggactggccatgattaaccaactcattttggatggttttgttggattcctcaaaccagacacatcattctctgtgtcgagaatggagatgacgtgactagcttttatgactttagaaacatactccctccgtctcaaaaaataaactttaggtttctgtgtccaatgtttgatcgtatatcttatttgaaaaaaatatgaaaaaaattaaaaagacaaatcacgcataaagtattaatcatattttatcatctaacaataattcttttcgtgcttgtgattgtgagtattggaattcttttaatatatgctgaatatactaatgagcataaagtataacagactaatcaagtatgtgagttattcaatccttggcaatttccaatacaaatacagacacactatgtatggaacttttttatatatagtctattaaacaatatatctttgagccgtctgaaaccaaattatatgatatttttttagttaatcataccaagatcattaattgagtaggaatataagacttcaagggggaatcaacaatattaattgtttctgagaacaattattcaaagcaattcataataaaagcatatttattttaggagtgggtacacacactatctagcttgtaccatatataagtcaatgaccacgatatatggctagccacctccctccatcatgaaataaattaacctcatacgaatttagatatagaatatgtccagatttattgattaaatcctagattgatttattttaggacgaagagattacctgcctgcctgcactaaccatctgcgacgccgacgtgtcatccatcggtcgacaaaacgtacgcaggccaacacatgcatacgtacacacaattgcccatttgcaccccgctccccatgtccacgtcagacggcgacacgtacacattaacacatgtacacgtcgttttcacgtacgagctaagcaaatccaacgtacagaaaatagttaatttacccggttgccaactgggacacgtacgccggccacgtcacaggtctacgtggcgcggtgtgggccgggctaggagggttaaaagcccacgcttgtgtgctttggtcaactcgtgcacttattactctgaagagttattagccggttcgatgtgtcgcgattactgttgtaattaagtctgtctctgtggcgatatgtacgttgacgatgattaaggtggtgtttggatctagagacttaactttagtctctgtatttagacactaatttaaagtattaaatatagactaattacaaaactaattacataaataaaaacttatttgcgagataattttttttaagcctaattaatccataattagaaaatatttaatgtagcatcacataggataatcatgggttaattaggctcaatagaatcgtctcgcgaattagtctaagattatggatagtttttattaatagtctacgtttaatatatataattagtgtccaaacatccgataagatagagacttaaaagttttaggtggtgtttagatctagggacttaactttagtccctatatttagacactaatttagagtattaaatatagactacttacaaaactaattacataaataaaagctaattcgcgagataatttttttaagcctaattaatatataattagagaatgtttactgtagcatcacatatgctaatcatggattaattaggctcaatagattcgtctcgcgaattagttcaagattatggatgggttttattaataatctacgtttaatatttataattagtgtccaaacatccgatatgatagggacttaaaagttttaatctcatctaaatatggttttagtctcatctaaacagggtctaatagcagaaagttacgtgagattcgtatactcgtacgtacgtatttgcatcggaattttcaaaatcctagactctttctagtactggtggtacagtttggcaaatctgg

SEQ ID NO: 74818 - DNA, 950 bp, Oryza sativa
cataaacaccggttgacatagtcaaccacctcagtgaagctctgtcgtaaattaacctcattcaccatggatggatcaaggacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaaacctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcaccgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaagtgtcctttactgtatcgatggacaccttggcatacccagctagcaggtctgcgccgtggaccttgtc

SEQ ID NO: 74819 - DNA, 2593 bp, Oryza sativa
tcagggatggctgaaaacggggcagggacattcgctgctgcagcggctgcatcttcttgtgcccatattgcctccttgccgatgtaccctgcggtgcccagccgatgcgggtgctcattccgctgttgcagtaggcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctatagattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcataaattacaatcatttgcatgaagggataaaaagaggaaatcagctactaggaggaaaaagcaacccaaagaaaatagaacaagtgtagttcatctgttcttatccataaaatagaacaagtgtagttcatctgttcttatccataaagaaaagagcaagtccaggaaattagagcagtagcaacagcatggccatataatagcagcaataagagcagtagcagggccatataacagcagtaggggtatatatgccacaggggcagcaacagcagggggcgattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaagagagcaagtgcacaaaatctgttcttatgcataaaaaaagaacaagtgtagaggtatataaccactctacactggccatttaataaggaacaagtgaacaagtggtggggcaaaaaaatgaacaagtgtagataatctgttcttattgagcaattcatcactggccatttaacaaggaacacattgggcagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtctagataataaacagcccacaatcattgtggcagcagcagcaagggtatataaatcatgtatataaacaacaattcatacaattgacctattcatagacaacaagggtatataaatcaacaagtgtagataatctgttcttatgcagaaaaaaagaacaagtgtagataatctgttcttatgcattaaaaaaagatcaagtttagaggtatttctgttcttgagcattcatcacagcccaccattaatttatcaagcagaggcaagtgtagataataaaacagcccacaataatttatgtggcagcagcagcaagggtatataaatcatgtatataaacaacaattcatgcaattcacctattcatagacagcaagggtatataaatcatgtatataaacaacaattcatgcaattcacctattcatagacaacaagggtatataaatcaacaagtgtaggtaatctgcggccaatctatcaattctttcatttgaactaaatttcaaaccctaaacctaataaagttccttaattatcaaagaatgacagaaaacaaaatgcatggagaattttggtgtctaggtccggtccgtccatggactacactgaccaatccaccaaaaattccccatgcattttgtattctgtgatggtttgataacctcagaactaccttaaatctacagccaatctatc

SEQ ID NO: 74820 - DNA, 9665 bp, Oryza sativa
gcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtctttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttttaaggttgagggaattaagttgaagggtggtgttatgcttgcaacgaaatgtgacattggtgatatttcaaatgatgatatgtgctatttcttgatatgcaaaccagccttggtttctttagatgatattgctagttcgatacctcctgttgttactaaccttttgcaggagtatgaggatgtctttccagctgagatacccccaggattgccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaaattagaatgaaacttggagatgaatggaaaacagcttttaaaactaaatttggtttgtatgagtggttagtaatgccttttggtttgactaatgcacctagtactttcatgagcttaatgaatgaggttttaaggccttttatggacgatttgtggtagtgactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgcttcaatatcttcgctctcaaaataatttgaatcgtaaacatgcaaaatgggttgaatttattgaatcttttccttatgttatcaaacacaagaaagggaaagataatgtgattgcagatgctttgtctaggcgctatactttcttatcccaacttgaatgtcggatttttggacttgaatcaattaaagaacaatatgcacttgatcctgattttaatgaagtgatgataaattgtaaagagggacgtacttggaacaaatttgtgatcaatggtgggtttgtttatagagctaaccgtctatgcattccagttggttccgttcgtcttttgttgatacaggaagcgcatggaggagagttgatgggacattttggagctaagaagacggaagatgttttggccatgtatttgtcacatcctgatttttgtttcaggatttataaattatttaatgaattattattagaatttatattaaatgttcattaatttacaagtgaagttaaatgtgggaaataaaattttctaaatataaagcatggatggatttaattttttattaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccgcctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttagttgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaactactccactgttttacttctcttaaaagttttgctaaatgctgcttttgcaaatgagcctatattatgccatcctttggtatccttgtgcacttgcatatttgctatgtggcttgttgagtatgtcatatgctcaccttgcaataatcaatcaacctcagttgaagaaaaaggatccagaaggagaagacgtttggcttatacccgagttgagctgcctgtgggagtggagccggagattcgctagattttattttccgctgcagttttcttcatggtgaggactaagtgcctcttaagtaagtatttagcgttttagttaatttgatgaatctgtatattaaattgtcagtttgtgtacctcggctgatttctggacgaggattttatgcacaaataagttcggaaattactagtgaatttctgggcgtgacatatttcttttggccaaggatgagaaaggatgttgacaggttcatggcacgttgcaccacttgtcagaaagctaagtctcatttgaatccacatggtttgtatatgcctcttcctgtaccttctattccttgggcagatatttctatggactttgttttgggattgtctagaactaagagggggagggatagtatttttgtagtggtggatcatttttctaagatggcacatttcataccatgtcataaaagtgatgatgctgttcatattgctgatctatttttccatgagattgttcgcttgcatggtatgccttctattgtttcagatcgtgatgcaaaattcttaagtcatttctggcgcacgctatggaacaagttgggtacaaagctattgttttctacaacatgtcacccacaaacagatggacaaacggaggtagtcaaccgcactttaggtaccatgttgagggctattttgaagaaaaatttgaagatgtgggaagaatgtttgcctcatatggagtttgcatacaatcgggcaacacattctactaccaaggtaagttcttttcaggtagtgtatggtttcaaccctcgtgctccaattgatatgttgcctttacctactagtgagagggttcataatgatgctaaggcacgcgctgaatttattttgaaaatgcatgagtcaaccaagttcaacattgaaaagatgactgaaaagtatagaattgctggtagtaaaagtaggcaagaggttaagcttgaaccgggtgatttagtttggttgcacttgagaaatgatagatttccggaattgagaaagtctaagttgatgcctcgtgctgatggcccttttaaaattgttgagaagattaatgataatgcatataaacttgagttgcctcccgagtttggggttagtcccacgtttaacatttcagatttgaagccatacttgggagaagagtatgagcttgagtcgaggacgacatcaattcaagagggggaggatgatgcggacatcactacctcggatacacacaacaatcctccaatggtcattcaaggaccgataacaagagctcgtgcgcgacaattaaatttagaggtgagttcgttcctatgttcttctttgtatgaattcgagaatagattgcaacctaatgattatattgtgcttaggaacaatggaggggacaaagagacacttggagaaggacttagagtcatggaggaccatcggggacgtccaagtcaaggtggaggcccaaaccaagtcgacgtcgggtgcaattcggagtccaggaccagtctgcactaaaacgggcgcccaggtcgcatacgtgctcagattggggcgttctttatatggatggaaagctaagaaggtaacctttcaaatggttttgctcccacatccaaattctttccgagtcaacaggaattgaccgaacaatttgacgtccaaaatctgtcccagtgctgcgtcaccgtatttgggcctttggcccgtgtatcgtgttggaacccattagggttgcatcgagaggggtttgcacgaccctaaactctatatatcagtacccgccatcatgtttaggtttttgggttttgcttagattaatctgtcgagaacagtttcgccgctagttcggtttgtaagaccccaactcgtgagcttaatcattcatctgcaattttggttgtttttctatctcgttcttctttgtgttcttcgattggcaaacagggattagccttctcggtgtggtcattcgcgtttcgacacgggtgataaccagaggagacgtggtgctgcaattgcggggctcaagagcgtgcgcgttcaagaagccggatcgatttgtgtggcgactccgcccaaatcgttgtttatcagaaccttttggaagatcgggaaccctagtgcacatcatatacttactccagaactaacgagtatatatatatactgattatgtctttttattggtacgcgcagtatatactactgcaacgagcgaatgagtatatactgttctttcacggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttcttttttttatcagtatatgcatttgttattatttgagtatatattgtatgcactacttgttctgtcagtatactgcatgtactaattgtcatgtttggtcggtatactgcatcgtcctcgctaaaggaggttatactgccttcttgtttgatcggtatatactatgtatactactttttttcactcagtatataaataagtatgtaccagtatttcttagataagtcgtatatttgctatccatggaagctggatgcatatgcttttcagttgaatagaataattaatatgcttttcacgtgcaaattcagatgtatgcctgaatcactggcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgctgaccgcacgccggagagaggtggacaagaatgtgtcttcctggattaacaccattagctaggaatcacggttcaatgccgacgacaatgctgtcgccgcacggccacacatgctgggctgttctgtcatcagcaccatctacgtccacgatacatgcatctcgcatttgcatgcaccaaacaaattcgatctgcatgcatgcattatcgatttgcaacgtagaaaaagcaaatcaagaaaatcggaagaaggaaggacttgcctgcagtatagtcgatgttccagttccggacgacgctcaacgtcgtcttgatcgtagcatgggcctgcatcgatgccgtcgccgcacggccacactgacttgcccgaagatcaacggcgtcgttgtctggtcatagctcttcggccagccagtcgcctgcggatagtcataccgaaggcattggtaatggaagacgccggcgtagacatcagcagatgccacgaccttcgaatagccgatgggtcgcgccgccgtcgccttcgaatcgctgatcgagatacctgcggatcgatctatcgattctgtttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggggagactattctatacccccggtcgccgtcaagagcccaacccactaccccctctttttattgggctcaaaacccacctgctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaacacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactg

SEQ ID NO: 74821 - DNA, 2814 bp, Oryza sativa
aacgtggagctaagaacacggtagaagctcaagatagagatgacaagttcatcatccccaagaggatgatggagctttagatgcctgagtggtggattcatagagccaagcaaataatctattttatctcctgcagtagcttgagctagtggcggccgatggaactggtggttgaggatgagaaagagaagggaaatggaggaataatattgaaaaatgtgacatttcactagcttaatggtactgttagaattttgagaagatgttatgttattaattggtaccttaaaaatccgtggtattatttgactacgatggaatctaatgttggaatttaatttgactttgagtaaaatctcttgtctccactcttcttgctctctttttgtgtttcttgctctagtccttgtggctcctgtaactctgtttctatgttgaaatctaggggtgaaattaggataaatgatcgcggggtcagtactaactagggtctatgttttcaaccaaacctggtcgaaaaccatgcaatctcgatgttccaacgtggaatggaagtagattctaagtaaaatttttaatagttttctaaaattcaaatttgaaacgataaattcaaccaaaattaataaaaatttatgaaattttggcaaaaaagtcatatctctatgttcagaatctaatattaaatcgaagaggtgaaccttgatgcaatctgggtttgttcagatctatctacaggttctaaacccttccctcccagcacacacaatggagcgaggattaacacatgattaattatcattaaaaaacttgaaaaaacaatagattaatatgttttaaagcaattttgtatagaaactattttgctagaacacttgagaggttgttggccactagccttatgcatggtctcaaatctcaaagactcaaataatgtatatgcatattcggctgtataatcataagttctagctaattttctctttgatgcttctagtatcgttcctagttgtcaattgggctttaacgcagcaatcaacaattaatgtcactgaggtcatagctggtaaaataaagaggatatgagaggttaaaagcgacaactttcaataccaagtgttcttaactctgtttttccctgattaagatacatgttttatttcggttttcattagatgcttttcaaacttctaaactgtgcatcgcgtgcgaaaaattttctatacataagttcctttaaaaaatatcagataaatccaatttcaagtttgtaataattaaaactcaaacaatcatatgctaatagctttctcatttttcgtgacctaacttcatcttcattttcagtaaaaacgaacacctaattttaattttctattaatgtgatactccctccgcccaaaataagtgtagttttgcactattcacgttcaacgtttaaccgttcgtcttatttgaaatttttttatgattagtatttttattgctattagatgataaaacatgaatagtattttttgtgtgactaaatattttcaaatttttcaaataagacagacggtcaaacgttgggcacggatatccacggctgcacttattttgggacggaggtagtactaagtttcaccttaattgtatctttcttttttttttcttatcctaacggtaacgggagttccaaacatggaaatgacaagttcatcatcatatccaagagcatgatggagctccacatgctagggtgaattccctggagctaagcgaactactaccttgtctctgataatagctcgtgctagtggccgctgactgagctggtggctgagtctgagaaagagggaagggggaagaataaagaggaaatatgtgacattccgttaggttaatggtatagttagaacttttgagaagatgttgtgttattaattggcatgttaaaaatttgtgatattatttgactccgatggaatcctcatgctattaataaaatttaattcctcaaaggaaaaaaaaaaccattctagtgtaataagatgaaacagcatttctttggccagcaacctcaaggttatttggagatctctatttgtcggaattagcgacaagggatagatagaggaagtgaaggtcaaatgctatgagattataaatcagacgagtgtaattgattaccacgagctagctaattgatggctgaccgtagaataaccctcttaaaagtggtatgcatttacatatgagccgtatcaattacaaagtgacggtagcacaaaaatgttgttaaaaaaaacagaggtgttgacgatttgtttttgaaaataaaccctctaaaacccttattattagaaagatcgaaaattttccccggccaaaagtaaacaatggttgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaaccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacac

SEQ ID NO: 74822 - DNA, 1491 bp, Oryza sativa
actccacctaagacttcttctccaaagcttctcttactgaaggggggaaagactgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctaaagctacacagtattactaatcaaggccgtgaacccacacgaacctgccttaacccaaggcctacgatgattcagaccgaactggcaacccgaccctcggtcccagctcgtcccaagccaacccatgccaaccattccacattttagttattaagcaggttttaagaatttaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgcgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactaacaaaaccatgcaccccgagcccagcctaaaaccattttgagggttttgaatagagggggaggtgtgcattcaattccacaataatccaaccattccatagtgtccaagtgatatgaatattcccaaagtctagagttataaaaccacctaatgttgcctaattaatcagcgaagcatctacctaaattcatactagtggaaccatgaatagagtacccactagttggggttttatttattctagggtgaacaaggtaataataacaatagcaataataatgtcataacaaaggtaaataggcatggctaaataaagcagtgaaaacgcgggaatttaaataaagcgataatgcattaatttaaatcaaaataattttataaactgggattcaatatgctcaaggatgatgtgacttgccttgctaagagagaacggccttccgaaccttcggcgacgaccgcgaaccatgcttcgagaaccttcggaacgacagaagctacgcgaagcacacaagcaaagctaaaccctataaagaagcaataacaatacataaaaagaaagcacacggttctttaggttataacaaacattaggagacttgaa

SEQ ID NO: 74823 - DNA, 2629 bp, Oryza sativa
acattgttcctacaaatcaaaggggccctaaagatttcaatattgaaatgatgttggtaagttatcaatggacctccacgaccccttgaacgacccctagcagtaattgtatctgacatatctgcagtggcgtagctagctatgtggcactgtggtccatggaccatctaaaaatttgatcgagattaaaactgtagtatatgtgtgagttaatataataaaaattatatagtaggccacccatttaattgatctattacatatagatagaccacttttactctaaattctagctacgccactgcatatctggtacaataatattattatactcagaggttggtttagtttaggaaatattcccttttccgccatctcctataaattaataagcatgcacaactcgagccccacatctcctataaattagtaagcatgcgcaactcgagctccacatcacagctaataaaagctgcagctaacacgtactgttttgcatgcgcgcgcttagcttaattctcacgagctgatcgatcacaggttattcaattagttaagttcagctacttaattagctagctccattacactgcaagctaggcccagatcgatggcagcttggtccatggcgtctctgatgatcgtcgccgccatcttcctgctcagcctcacctcggcgagcgtcgtgcatggccggagcagcaggaggagcttcttctccagctacgacgagccgtgcatggagatgaggctgtacctccacgacatcatctacgactacagtaacagcacctccaactccacgtcggcggcggccaccaagccgacgccgctgagcaccgccgtgtccaaccccggctacttcttcggcgagatggtggtgttcaacgaccccatgacggaggggagggcgctgccgccgtcgccggcgatggaggaggagacggcagtgcgcgcgcagggggtctacctctacgacaagaaggaggcgcccaacgcgtggttcgccttctccgtggtgttcaactccacggggcgccgcggcacgctcaacctgatgggcgccgacctcatgtcggagaagacgagggacctctccgtcgtgggtggcaccggcgacttcttcatgtcccgcggcgtcgccacgctcagcaccgacgaggcctcggcggacttgtcatacttccgggtgaaggtggacatcaagctctacgaatgctacgtctgatcccatgcatacgtacgcttgctctttcatggccgtggatcggatcatcgcgtgtcctaaatatgcgcttgtatttgtgtgattgtgtgtgttgaatttccttcttgacattcatcatctttgcgtgacgagtcatatgcacggagaaatgtgcaaaatgtgttttttttttcgtgttttggatttgcatctcatgtattgtttgagtgacgagtcagcgatcggcttggcgtggtggtttgttttgtctttctttttcctggttataatcttcatagttataatcttataattttttttctacatcaatataaaatcttgtattatctggtgtagtttgttaaaaatacttgcctttttcaatcaattgtcatagatgtgaccggacgtcgaatgacagttattcgcttggatgtcttcgcgagtgacggttgaaagtcggttatgccatgggctagatcatctaaccactggaagtgacctggctgccaatcaagagtgggcccagtacagtgcatttaactaatgggctaaatgacgtccttcatgggtatcttttatgtgttcttttggcgttagggtagcatcgcggtgaagtcgaagctgctgtgtcgtttgggtggcaagctcggcaacgataacatgcgtgggctatttgtaggggtgggtgttcggtcagaccgaaaaattcggtctcggtcttcggtttttcggtcagttcggtctttgcaaactcaggaccgaatttcatccaaaaaaactcaggaccggcaaattcggtctcggtcttttcgatctcggtctcggtctgaccgaaattttttaggagaaagtttggaacgaaaaaatttgacagaggcgtcgccggcgcggtggagggcggaggcgtcggctgcggcgcggtggaggacggtgtcggccgcgttgcggtggaggacggcggcgtcggccgcggggtggtggaggacggcggcggcggccgcagccgcggcgcggtggaaggcggaggcggcggtggcgacgcggtggaggctggaggaggaggcggcgcggttggggcggagccggcggtgggggctggaggaggaggcggcgtggtggggttagaggaggaggcggcgctgtgcggcagtagtggtagggttttttttatgggcttattggacttcctaggcctattgggccaaaatttctgtcatttcggttaattcggttaactgagcccaataaccgaaatgaccgaaataaattcggtcttttgagggctgagactgaaaaggttaccgaatttctcggtctcggtattttcggtctcggtctcggtcttttcggttcggtctaaatatgcccacccctagctatttgtgtcaccacggcgatgccttgtgtcgggctccattg

SEQ ID NO: 74824 - DNA, 1875 bp, Oryza sativa
agcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgaatctctcctcctcttgcacacaattagcaatgagcttctcaaagttccatttctctggacttatgttgtagttgacaataaaattgtcaaactactttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacatacttaatgttcctaaaattaaattctcccgttggttcgaaatttaattttagaaacactgattttcatcaattacatctatttgcagcggaaaactatataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaattgctactgttctcttttattcattttcggcccccgagggacctaatttgaacttttgccggcggccaacggcccttttggcatgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagcttctcttctcttctctctctcacgcgaccgcgtggacggcgtcgccatcgccggcgaccttcgcgccgccgcgccatggccggcgctcctttcttttctcttcttctccgctcccccaccgtctctaacccccaccgtgtgagaga

SEQ ID NO: 74825 - DNA, 674 bp, Oryza sativa
cctgcaccccaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggggctagaggtttctgatcaacttgtgctcatgg

SEQ ID NO: 74826 - DNA, 971 bp, Oryza sativa
tgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgactggcgcggcatttcccggcacttcgtcacgacaagaacaccgacgcaggtggccagccatgcccagaagtatttcctcaggcagagcagcctcacgcagaagaagagaagatccagcctctttgacgtggtaaacttcaaacatctttgcaacaatatctacacagacagtttcagacagcaagaatcatgtatttatatgagtgagttacagtaacctaacatgtctgaaaatttgatgttttttttcttttctttcagattgaggatgcagaaaaggctccgagtgtgaatgaacgtctgaaactgagacacgagacagcctctgtgcctgctgaaatgggattccctgcactgtcactgggtatcagcagcatggcacagccagaagccatgctgctgcctcctccatccttaaccctgacgccagctgttcatcaccagcagtgagcagcagcagcagcgaacaaccaagaacaatccatccttctctgatggtggcaaagcctcagtgcaactgcaactacaccacctgatctggagctcaagatctcgactgtccgtcagaacgatcagcccagttcgtcgccgaggacgccttttttggggacaatcagggtcacttgaacttaaagagagagagaagaagaagaaaaggaattatcttagagattactgaattatt

SEQ ID NO: 74827 - DNA, 41181 bp, Oryza sativa
  unsure (1)..(41181): unsure at all n locations
tttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggagtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgtgtctgcctcaagcctctggtcatgatactcccggtcccatattaccgacagtagcccccggcgttatgccagagcaatttcccttcccaagggaagcggtcaggtgtgacgccaccctgtgacaggtgggaccggtctccgtagttgggcaaaatacccaacggtctcaatccatgcacattggtattggtaactttggttgtccataatgggtggtctattcaagactgccacaccacttgagcagcgcgcgaatctgggtgagcagattcgtctcgcccggagatatggtaacgccgcttcggtcggcgagcgtaattaacgcgcgcacgatacaatccatttcgattgccacaaccgcatatccacttaatgcgccgtaagcgggcgaatgggattagtggatgcgtgggcacgggaaacgagggagcgagatagcgagatacgagggagcgaggtagtgggcgcgagaaacgaggagtcaggcctagcgatggcaagggtataaaagcatcgaggaaaggatttgctcccttcctttcgccattgttcctcttgccttcgccgcctgagctctaactctttctctgctacgccctactttcgccacacgcgctcgttcccaaccatctcttcctccaccgccatggcgcggggctctgctctgctcgacggcagtgtactgccgccttcccgcatcgtgaacgagaggcacgtcggactgccgcgccgcttcatgccggagtccgccaccggtcgggagatagtgatgctgggcgaggggcgcccggcaccagactacccggggcggtccatcttcttcctcccctttgcaatggctgggctggtcccgccattttctcacttcttcatggatgtcctggagttctacgatctccagatggcgcacctcacccccaatgcggtgatgacattggccatcttcgcacacctgtgcgagatgttcattggggtgcgcccctctcttcagctgttccggtggttcctcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccttcgccgacgaagcgcgcctccgacttccaagccagcccccggcgccggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccgaagcgcctgggagtacactgggcctgaagactacatgcggacccaccagggagccagatgggattgggctcctgaggacttcaagatcgtagtccaaagggtgctgaatcttagctctgcggaggcgtctcgccttcctcaggagatcctccccctctgcatagatcccgaccgcgtctccattctaaccattatgttgggggtcggggcctcagaggagagagcccctaagggccacgacggcgcgggcgagagccgccgggggaaacaatctgccccaggagggggtcgtgcttctgggccccgcgtcgggggctcggggagcagccgtcctgccgacgccccggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggagccatgccggggaaacctgatttcccctccaaggtggtcattcacccgtccccctcgcaggttcgtctcactctcattgcaaccatctttctccaaaaagaagttttttcttgctcattttgttcgtcttctggttttttcttctgctttagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggtcgcccgggttcgccaagcggaggaaactgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgtggccgcgggcgcatcgcctgggcctacctcaccgggcgacgcccaggaccaaacgggcccgggggacatccccgagctcagcgcgtcctccggggggccaagccgcgtcgccttttctccaaggcggcttttctcctcatcttccgtcgccctggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcgactccgccgctgtccgagagcggcgggcaacggaagccgaagcagcgtcccggcggcgcgaggaggccctcgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggatgcactcgctgagcgggagcgagctctcgaggaggccgaggccacgacgcaacggctggcggatagcctctccctccgcgaggcggcgcaagaggagcaggcgcgccgcaaccttgaatgcgtccgtgccgagagagccgcgctggagcagcgggctgccgacctcgagacacgggagaaggagctggccgcgagggcgcgcatcggtggggcggctgcgggcgaaaacgacttagccgctcgcctcgcggctgccgaacacaccgtcgctgacatgcagcgcgcgctggattcctccaccggggaggtcgaggcccttcgcttggcgggcgagatcgggcccgacatgctttgggatgcggtctcccgcatgaagcgcgccggtcggcaagcaggcctctggagagaccagacgacggtgccccccaccaatctggaaggcctcgctccgcacctcaacaggatggcttgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgagnacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccagcgacccgggtgcatttgaatgagcccccaggcccccgccaatctttactttttttctttttctttcttctaaggccttcatgcctcttttgtgtatagatcaacttaatctgcaatcaaaaatgatgaaaaattttctatgttaactttattttgctatgcatgtgagttgaggatgatctgtgccgtgatcctctttttgtgtcttagcctgatttaagggctcgtgctcaagtcccaatcctcagatggctcgggtcggggctagtgcctggggagatccacatgtcgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaaagctgaaataagaaaagtaagactgtgcatgtgtggtagcccccggccaaccctgcacacccgaggggggtgcggggttggcccgagccaaaacctgacacccgaccccccctcttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagagccgcgcgccgccttcgctcttctaagtagtcgaggtcatctctgcgaagctgatcttggtcagcctcgcagtacatggtggcccggggagacctcagggtgagctcggatgggagaaccgcttctgcgccgtagacgaggaagaaaggcgtttccccggttgctcggcttggtgcggttcggtttgcccagagcaccgctggcaactcctcgatccatgaatcgccgtgcttcttgagaatgttgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgttataatacggttaggcactccaaaacgggccgtgatgcccttaatgaatttaagagcagagtgcttatcgatcttaacaaccggataagcctcgggccacttagtgaacttgtcgatcgcaacatacagatactcaaacccgcccggggcccgtttgaacggtcccaggatatcaagcccccagacagcaaatggccatgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacaggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgtccatctgtgggtcagagcaccggtactccttacagacctgattaacgactagctgggagtcgcctaataccaagaggcggcggatccccagtccaactgccactctgagtccggcaaggagtccctcgtactctgccatattgttagtcgctcgaaagtcgagacggaccaaatatctgaggacatctccgttcggagaggtcaacgtgacccctgcaccggcgccctgaagagacagagagccgtcgaactgcatcacccagtgggcggcgtgaggcagctgtgtggggtccgtgttggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggcctctgcacccttcggtggggccgatcctctctgctaggggccgtatccccggggcgttcttcgttcaagtggcctttcggggcgcacttgtcttctgtaccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcaaagggcgttaagtgcggccttcccacagtggcctcggggccttcctgagggtcgggggcacccggcaccttctgacaagcggggggagggccgactccggtcgtcgggggccttaggccaccgttcgactcgggggtctctcctccctgcctgctcccgggcctagtcggcacagagtgggggtgcgcagaatgaggattatcctcatcgcgctccacaaccaacgctgcactaactacttggggggtcgccgctaagtaaagtagcagggactcatttggctccggggcgactagaaccgggggagagctgagatatgcctttaattgagtaagggcatgttcagcttcctccgtccaagtgaacggccccgagcgtttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatacgggcggagcggaggttctcaaaagtttccgctagatccgaaagtaaagtttcttggttgcgcgtttttacaaccaagtcatcgacatacgcctcaacattacgtcctatttggctacccaaagaaattcgagtagtacgctgaaaagtgggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacgatgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcctgtggccatccgctgcctcggggcggtgggggcagaggggccaagcctctcgtcaccgccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagctcacccgctccgtgcggaagttggcaggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacttgagcacatgctcctccatccacggtggcaatggtggccccaggttcttggaaacctaggtcatcatcaccatcatcaatgtcaacagcgggggccttctgcttggcctcacttcgccgtttgccggagggaaccgccggggacttgccctcacggcgttcctgcctcctgtcctcctcccacttcctcgttcgctcagccaggtttttgactgcgcgacagtccgcgagatcgtggagggaggtgttgtggacggagcaccacctgccggcggggcgctccctgctgggagtaccagcctctttcttcttgtcgctcgcaggcctcccctttcgggtggcccgcggagcgccctcgacggcgaggacatgaccctcgtcgccagaacggtccgacctcttcttcctcctcctgtcacaccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacgttccgaagactcgccacaaaggctctacagccaacaccaccagccgggggcacggaaggctgatcttcacgtccgtgtcgaggtgacactctggacgaggaggcaccctccgttgcacggggagtacgccggctattacgccggcgcccgatgttgaggcgggcatccggctccccatgctgatcctccctagtcgacggtgtcgacgagggagtggcagccgaatgacgtgcagccgccgccgctcgccgcgccctccgccttgatgacacggagccggtggtagcggcgccggaggtcttggtggtggcggatcgtccaccagcacccaggcgctgctgtgccgtcatgaccaagttggccacgtcttccagccatcgttgggctggagactccgggtcatggacgacaggcgggtgtcgtagaagcgcgccagcagcctgaagcgcaccctgaggcgtgctgccgtcgccgtagacgaggaggcgacgctccccatctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagccctgaaagcacacgctgagccccctacctggcgcgccagatgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaacccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacacctacctccacttccgccgggggtgagcgcgtcgtgggaacatggctgtgcgctgacgatatgatcagtgtcagaccggtcacaaatcggtcattcttgtctaccgcgtgtaatcttggcaatgtgcatgtttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggcgtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgcgtctgcctcaagcctctggtcatgatactcccggtcccatattaccgacaatggtagtttgttacttatagttctattgcttatagcacctccataagtaatgtgatgcaatctttatcacacgctagggtttttaacctacatgagtacatgacaacgttgttctaccgtgttttgaccaaaaggttagtaaacttgaaaagggatatatgttatactttttgtctccgttccaaaatatcatgatttttagtttgtttaacaaataccaaggttagaataaaatattccctttttaatcatgtcagttgtcaatatttgaattttaaattacttaaattcccttcgcaagcatgcgattggctttataattattgaaataattgaaaccacgggaatcactgcatagatccttatattgtaattcccccattccaaaatataaaaaaatttagttagatgtgacacatcgtaatattatgaatttaaacagactccctatctaagatttatagtagtagaaagtgtctctgattttagttcggactaaatcctaaaatttcttaaattttgaaaacaagagattaaattctactaaaaccgtggaaacataaaaggaaaagtaggccgagagcaaagctcggaaatttgtcttgtcagaaagggttgacacttcaccaaaagctagtagcaggcagctggctatcgatcagctacccatcaaatcaatatagagttccacattaaaattaaaaatttaaagaaattggaactatgtgatgaaaaagtttgaagtttaaatgcgtagaaaagttcgatatgacggaaaagttaaaagtttgaaggaaaaaatgttggaatcaagacagcgccgtaatcaaacggcgacgtcaatcaggcctggataggcatcgtcatgtcgccgtggcatcgatcgtcgtcgtgtgccgtgtcgtctccggcagacctcgccggaaagggacgcgagccactcgacgacaggcaccggtcgtctccgtctccgtcgcggtcgtcgccggccggccgtctctatccctccgactgttacacagaatgattcggccgtgcgtgccagctaagggcccgattagttctctaaatttttttccaaaaacatcacatcaaatctttggatacatgtataaagcattaaatatagataaaaaatgcatgaagcattaaatatagataaaaagaaaaactaattgcacagttatagggaaatcgcgagacgaatcttttaagcctaattagtccgtgattagccataagtgctacagtaacccacatgtgctaatgacggctcaattagtctcaaaagattcgtctcgcagtttccaggcgagttatgaaattaattttttcattcgtatccgaaaaccccttccaatatccggttaaatgttcaatgtgacacccaaaaaatttcttttccccaactaaacacaccctaagctagctagctagctgcaggtgacgtgaaaatttcagctatttggtactttggttttttaatggtcgtctttgagtatgcaccggtgtcgtcagccaatgacgccatcctgcattattttcgttatttactattattacagtttgaaagatgagctcatgcaccatgttggttcttgaatgcacaccgtaccagtgagtatactgtcaatatataatcttctaggaaaaaaatatttgacttaggtgtgttagattagtactcctatctttaaacattattgattagaggagtggtaaacagataaaaagaagttataaataaacctaataaaatcctatcaaaacgtagttacaaatacatatattaatttgggtagaaggatttgaactctaagaatataattgtgctccaacgcttttaataagaccactccttcaaaaagttaaactcgaaattcaatatattggacctcggaaaagaccgagggtgtcattacataggtggtacctattagggcacccacaatggttatctataggctctctacaaaagatctatgtcaacatattttcctacatggaagatattaaatgaagagagagagcaaaactatctactaacttagagatagtctatagagaaaaacgaggcaatgcatgagagagctatagatacccatgtagacatactattgaggtggtttactattaatctagtctattgctgagatgtacatgttttatagatagcaccttactttaccattgcgggtgctcttaggactcttttttggaggctacagttattcatagaatatccggcacctccaaacaatctagatttttatctagattatgagaaattatcgctgaaacataagctaaaaattgagttttccagcttctctatatacttatcagctggtacctatgccagctgttttgcagaatcttgaggctacgttcgttccccagctctagcacataaaatggagcgacccattaacacatgattaattgagtgttagttatttttctaaaaaatagattaataatatttttaaagtattttttttataaaaaaattttataaaaaaattgtaccgttagccgtttaggaagcgtgcgcacgaaaaaaagatggcgagttggaaaagcaaacaaaaaacatagcctacggctgcgtttggttggatccaaagtttggattttggttgaaattggagatgatgtgactgaaaagttgtgtgtgtatgacaggttgatgtgatggaaaatgactgaagtttggatccaaattttggatctaaacacagcctataaacgcttagaagtccggttgacttctcagacaggagaactggaagaacttgcccaaatcaactagaggaggggcttgactcctggtaattccttcgcttggaatctcaggaaggaaagagatgcccacgttttcaatggtacattcacctcggtgcaagcactggtcaacctcatcctgcaggaagccagggtcgaagcaggcgcgccggccacagcttaattggagacctccttacgccttcctccatgttatgcctgcctatatatgcagcttgttcattttcaagatcatggatcctatttttacttcactagttcactgttgtttgcgtctacacaccaggatttacaaaaccgtacggttatcacgataatcatgtcagtaccttagtttttgaaaccacagtatatcttacggttttcatagtaataaccacatgtttaccacgataaccgccaatccatagagtaacggtaaccccaccaaaaacggtttgagaaaccttggtacacactgctagtgactatataaaacgagataattatgggtgatgatatttattttaattagaagtttaggtgttttttgtgttctaaaaatatttatgtttgtattcgtgtccggttatatttgatccttatttttatttgagataattcatatttgttttcgtatatgaattattcatatttatttttgtatgtgaaaaaaaatacaaaaataaatatgatattagcattccatccgtatttgttctttttcattcctagctgcgggcggcctaatcgttattctcagcttctaatgtattcatggcaaagcttttgcgtactcgaaaaataaccagcttgtaaaaaataaaaacaataaaacgagcaagcatgtgtgtccccgtcatacatgcatcagaaaaaaggatgttcatattttagcacgaaagatggaagtcatttaagtggaaaaaacattttttttttgggttatggtggttcattgggccaaaaacaagcccaatgatgtgctaatcgggccaaggcctttgattgcaggtgatgaatgaaatttctaatgtatagtctagccaggtgattccaagaaatagctgatgagttttcaattgatgagaatgcgaaccagacgagggtgtttttactattattattattcacattttacggctgctgagtttcagaatctggaaatcagctatctcgtttgcttgctagctcaattatcaaccatatctaaattatgaaatataaagcttatattttaagttgatttcgaggtttttctatcgcattatatatttttattagtctttatgtcgctaaaaatatatatacaagtagacatacacattacagatgggttgtgtcgtagctaaaacacaacccacccttaccccctacccacccaggtgcgctttagcgcttccttatgtacatactttatatacaaacgtacatatgaaaaaaaaaaaggacgcattgcgcggagagtggcgcgtgactaggcaccggttcgcgtgactcttacattcgcgccaatagtagctaaactgtttgctaccaaaaatacatttggacaagcaaataacgatttttcatgcttatttatatatatggcaaaattagatcaggcaaaatatgttcccaagagctgacttgaaaagcaaaaccgagagcaagaattcatcagtgcacgtggcagctgcatgacatatactgcaattagttcataaaactgtgacactgcgattatatcttaattgtacaaagttataacaatacattgatcaaacataataaatacaacaattaaccacttaaaaaaggaggggaaactgcagaaacatattcagttcctcatccctgtcgccctgcttgtcctacgtaccctatatattttcaaggatacgtaccctatgtatgaaatacggtacatacatacgtatatacgtactgctgcactgtaggcctgtagctactggtacaacaaaaaaaatcaatggtaaattaattaatcacttagtaataagtaattaattagttactatgcttgatcgattaattagcttagctaattatcctttgctattagcttgcaatggatcgatatcgaatcgatcacggctcgagcttgacgaactcgtaatcgccttcctcccctttcttggaccccgacccgccgccggcttgctgctcgccgccggcctcgccgccgccggccttcctctgcgtgagcgcgacgccgccggcctcgcccttggggctgccggagtgggggctcgccgccgcgtggtcgccgccggcgtcgccgtgcttggatgaggacgccgccgccggcttcttcttgacgccggcgcgccagttcttgagcgccttggacgtctggtcgtcgaagattgactgcttcatcgttgaccccatctgaccgtgcacggacacgtgtcagtccagggatatgaccacgtggcaataatatttttttaaaggaagaacacttaaatataataggagtactcgctttgtttcatatttgcgatatgctttaactttttttaaactcctttaacaaaatttatacaaaaaaacgtagtagactgtaaatatataaatatattattaaaatatattcgatgttagatttaataaaattaatttgacgttacaaatattgctaatttttttaaaaaattgatcaaatttaaaaataagtttaatcaagaaaaaaaagttaaaacaatttataatataaaagggatggagtaatatacttgtgagacgagtgcatagagggggagagtgacatagctacacaagaactgaaccacaactctgcaggcacacaaaatcataatcaattttcagacgataaatcaaaaccaaattcaatgatcacaatatctacaaattctggatcgaaacttatcgttctgaaatgaaaagtttggtgttaattaattattacccgaggcagaggcgagcaaagacgaactctttggagtcattgaagcaggagtccatgccgtactcgtactacacaaacacacaacacagaagcagtgagacaagatcaatcaatctactgaagattttcatgaagcagaactgaagaaattcagtgagcaaagattgggtcaccagtatccagaggaagtagatgatctggaagccattctgcgcaaaacaagaagaagaatcaatcaaaggtcaggtatagtttatcactaattgcaatggtggatggtgacaattaattcatggagatcaatggagagagaaaaaatgattgattgagaccaacctggaagagggtgaaatggatgaggaagaggacgaaggttggtcggctgaaccagaagtaggagtcgctgacctgcaccagcggtatcccctggatcaccgcgtgccgctccgtgatgtcgatcgccatcctgcagatgatcccctgcagcttcgtccccaccgacaggatcgtctgccattttcacccaatatatcactcactcatcactgattcatcattcttcagttcagctcagcacaattcagttcagttcagggcagttttgtttacttcagctcagttcagtttaggattgaaatgtatatatgaacattgtactacttaccaccaatgtcatgatggaaattcagctaagtcagctcagtttagttcagttcagttaagttcagttcaggattgtggtgatgtatgaacattgtatacttaccaccactggcatgatggagatccaaagcatggtatgcaaccctggaacatatgaatgcagaggtcagtaattcatcaagtatatactcgaacaaatcaggcaagatcactgcatatttttagaaaaagcaagaaatgtgcagatcagggactgaccgctgacattgaggagcaggaagatgagagcagatgcccaaaggggagggctgcaataaacattcagaccaacaagaatatacttaattcgtgatggttcagtaccaagaaaaaaattgacagattgcaagatgagaatgtgattagcatttagcagcacacctgattccgacaatgaccttgaaatcgtcctcgagagaccgtttgatgtacttctggaaatcgaacttgctgccaggagctaaatgaacctgcaaaaacattattaaccactcaaaagcaagattatctgggatataatatgttttgcacgcagatgctgagagatcatccaagcttgtgttgtactcacgttgacgaagctgtgacgcaacgcgcagtagtcggccctcctgactgatctgaagaactgcctgaagaaattgctctgcatttgacgatcatcagagaggaaattcatgtcaaacgaactgaatttctcgtcttcttgtggcagttggtttttcttgtcagaaatggtgaaccgagctgacagatcgatcttacaatgtagaacgacgccggcgtcttgttcagcacgttcatgtgctgcctgacgaacgacgtctcgtgagtaaatctgaacttcgtcggatctgcaatgcaatgcatagagttaattatgcggaaagtagtattttctggtattttccgcacctactgtatgcatgtggtataaatagttaaataaaaatatgaaaaagtttgacaagatatattatgataatataagttaatatacaaactagaaaggtagcccgcgcacatgcgcgggcacgttgctgacaccttgtttaatgttgcttgaaattttatgaataatattaacacgtgggtgattttttttggtaatatttttttattatattctaaatctgtttttgtccataatttgtttaggattgctttgaatgttggtcatgattttcttctaactaccctatcaacatataaattctacactaaaactatttgaattcgtaaaatcttgagtttatgagaaaatatcgtgtcgtggaaatggagttgattcacatggacctatcatttgtactatatgtgtttttaatatttagtatatcttatttttggagtttctaaactttacgtaatatccttttcttgtgtactatagatatctttatggaatttaggatatttaatggaagaaactttctattaagatatatggtaagaggaaaattttatcaaattatgacaaatttatatttacttctgctacctccttttttcatatgcttactatgttcttggaaaaatgaatttaaaattgaaataagagagcaattatataaataaaatcagtatgtgtagagtatttataaataaaattgtaaatgacatttgttgaagttaggcgtttgtctatagcacttttggattttgtaatcctatttagtcgtaaatatttgtcaactgataacatatatataatgatatactttatattgtcatttgttatataattttcatgtctgtttggattacatgaaaagaatcaaaatgcgacctaaaatataattttattttataagttgaaatatattcaaaacagataataatatgatggtctaaacttcgttttcaattgtagagtgaatttagttatgcatgtttgtaaaagtgatatatgataaaataatatatgtcgccatttgtttgtcatatacgatgaaaagggtcaatatacgacccaaaaaacatttatttatttattataatttaaaatatgtcagcaccactttaagcctatctcaactattacattatatgtatgtaaaaattgtatgtgtaattttgaatttatagttgtttagaatttattatgataaaataacaaatattatctcaactactataaaaaaaattaaaggaaagggaagagaaggtgaggagggccggttgcgtgcatgcagtatgaagtgatattttttaagggttaattggatccatgccactacaaacatgccaatttagaaaaatgtcattattattcacgttattggctacgtgccactggaatttgagaaaattagaaccatgccactccatcacgttttccgtcaaaaatctccgttagccccaattgcacgtgggacctagctgtcagtttcatcttcacctccctcccctcttttctctttccccttcctctctctccaccactgtcgttgaccaccaccgtcgctgccgttgtcattgaccatctccgtgaagaccttgggagccactgccatcgccgctatcgttggccctatccgcggcgggaggcttgggagccggcgccgccgctgccgtctgtggcaggaggctcgggagcagccgtcctcaacgctatccacgtgggagggctcgggagcccctaccgccgtcactatactcgaccccatccgcgacgggagggctcggaacctgcagccaccgccgccgccgctatccttgacgccatccgcgtgggagggctcatgagccgccgccgccgtctctgtcctcgattggatccgcgatgggaggtctcaggtgccgccgccaccgccatccttgacgccattcgtaatatcgtgaatagtagtggtatttttctaaaatgacatatttgtagtggaagaaaatataagtgattttggttgaatgggatagcatagtactacgaatctaaatccatgtccatgcatccaacaaaaatttcttctattttgggacgggggaatatgtagtttctaattaacttctttttattttaatcttattaattagttttgtgtgttttatattgtctagtgtaaactacgtgttgttaatcacatggttttaaactctatgtgtttttccattaaaatgtatgttgagtggccaatagctggtccaaagcaatgtatttcttttacttgttaaatacagttaatttgggacttgcattataaattttgttataaatgatctaatagtatacatggataaaaaaaatagctacatatatatgatgtagatgttacagttgttaaaaaaaattttacaacaaaatatgtttcaatctaatagggcatgaaaatagaaaagaggagatgcacctgtcagttatgggcgtacgtatgtgcagtttgcttcacacgtacatgtacaggccctatgggccttttcttttattattaaagtaaatgcaatgaaggaaaatagtgggtcctttgttaaataatagaaattggtgggtccaccttatttaaaagtgccacgtgtcgaatcaagagcgtttgtaggaagacatgtggcagcttaggagtgtttttaggaagtttaatggacttttattagttagtatataatagatagaagatagatagatagataatagatagatagatagataatagatagaagatagatagatagatagatagatagatagatagatatgaagctacaaattctatctaaagtttacgaaataaaaataacagattttatctacattctgcggtgtcaatttttttttcttgaacgataaatcatatttgactatgtatgttaccatatacttctagcatcacaatcaatctaatcatttttatttttttctacaactattcatgtaataaataataggtgccattgcatctagttgtaaaaaatatatatccgttaattatgttagttaatcttcagagggtgaagaaataacaaaaaatgcaacatatcaaggcgtatatatgtatatatgtaccattagcgaactcgaaatcttggcccgcggcttctttttcccactctttccatccacgaatctgcagcagcgtcgccatgaacgcggctcgaagctattagccgggatcgccatgaaagaagaagaagaagaagaagaagaagaagaagagaagaagaagaagaagaagaagaagaagaagaagaagaagaagaaaaaagagagctttgccttggccctgccaagcgccatggtgatggcgctgtaggtgacgtggaagacggcgaggaagaagatgaagatgtgcagctggtgcagcgcgttgattgagatcagagacaccttcccctgcacaagttgacagcatccatggagcttgttaatcactacatccattttttacgtgtgacgtcgttggctcttcgcataacgtctaaccattcgttttatttaaaaaatagtatatatatatatacatatatgtgaaaatataaattaaaattatagtttttaatgatagaataagtcacaacaaaataaataaaattatataattttttaaataagacaaaatttgaaacgtcacattaacatcctttcgcaatcggtctcgcaggaggaggaggaggaagaagaagaaggaggaggaggaggaggaggttgtgaccgacatcggggcatttggttgccatcttggcctcggcgagcaaacggtggtgagggcgggagaaggcggcggtgaagggagggccgacgccgacgaggctgaagtgctcggccggcgtggcctcgtgttcgccgccggccggcgtggccccttgttcgccgccggccggcgtggccccgtgttcgccgccggccgtcgtggccccttgttcgccgccggccggcgtggccccgtgttcgccgccggccggggtggtcccgtgttcgcccccggccggcgtggccccgtgttcgccgccggcttccatggtggtggccccgtgttcgccgccggccggggtggccccgtgttcgcccccggccggcgtggccccgtgttcgccgccggcttccatggtggtggccccgtgttcgccgccggccggggtggccccgtgttcgcccccggcctccatggtggtggccccatggccgccggcgtcgccgtggtgacccttgccggtctcggcgtggatggtggaggccttgaggcggcacgggagcatggtgtcggcggccttctcagtgatgcagatcttgatgatgtagttctggccgaacacgagcagcagcgagatgaaccctagcaccatgagctctgtcttcaccttctccagcgcctccaccatcgccttcttcttccggtgcgagaagaactccccgatcttgtggagccccttctcgaggaggatggagatgagcacgatgacgccgcacacggaggcgacggcccatgtcggcgtctggtcgagctccctcgtgttgccgccgccgcctcccccgccgcccatggcctcccgcgccgcctagagctcaccgccgcgctcgccggtgggattggatggatcaaccaagaaagatcaaaccaaacgagggagacaaagaagaagaagaagaagatgatgaactggtgaagcaagcggagctaagctagatcaaagagaggaagaggaaggcgaggaggaggaggagagggggacggcaatggtggatggcaacggtgatcgatttgccaataatttcttggtcgcgtaggattagggcatgcatgcatgcatgcatgcgaggagtgatgaaggattgggaattttttcctatcaaaaaaaaaaaaaaaggattgggaatttttgaaggccgctattttggacgcacgcagcttttgcgcgcgaagcgtggagggtccgttaatccatttccgtttcagttttcccgcctaaaaatagccatggcatctcttctagcagtgctacttgtttaatagccagctggtgaatatcttttcgatgtcatatggaagatgaatgcgtgctatgcaatttttcattttaaactagatttttgaccttagatcgcaaagatcgcaaagaagttagttaattcattaaggttatgcttataccatgtagaaggttacatcggaacaattataatttatttcaagccatttgggttctttcttaatcttcacaaagaaagaaatttcgtaatggaaagatagaatgaaaaaaaagaaaaaaatctgagcacatattggcgatgtgaataatctgcatttaagaaaaatctctattttttttttggaaagttccattcgcagcttagttacaagcacggctatacaagttattgtcgtttatcaagctagtgccagttgtctgtgcatgcatatacacgcatacgagaatgcatgcatttgcttaatggaattgcaaattaatattcgacataaaacttaggagaaattatgttgaattttcggatggactttaagatccatgcaggctggacggggtaaaaatatgcaaagggcttttgtttaatggaattgctatttaacattcgataaatgtattttatgaaattttcctatattttcactatttttctttatttttccattcgatattcatattccctattttctttatttttctgacacaaacggttttcccatgttttttaatttgttccctataaatttttcatatttcttttccaaaattttcatgggccaacattgcacggttaccgtgcctaccagtatgtaccataatgggctatgctaatactgggactatatccttggtaggcagggttgttcatttggccttcttaagatatcatttattatgccactgtatagctgttaccaaactatgtgatgataaataacattgatgcttccgatactgaacggttgttcattttatttctaaaattaactctactaagttttgtcttaccgaaatgtggcaaagcaacaatctaaacattaccaaagattgcctcaactatgaatgtttggcaattataagatcttcctctcaaaaaacttattaaaggtattaaaccaaacaacccatatatctcaatcttattaaaaaaatgatatttcaaattttgaggctaccaaaattaacccttttaaattttggctttaggcatcaaagcgaacaaccctcgattatggcaactaacacatttttcagggcacttgtccaccacggattcgttgcttgcacacattcattgaggaagaagtctgaagctgaagtcttatactccctccatccctaaatatttgacgctattgacttttttaaacatgttcgatcgttcgtcttattaaaaaatttaagtaattattattattttcctatcatttgattcattgttaaatatacgtttgtgtataaatatagttttacatatttcacaaaagtttttgaataaaacgaatggtcaaacatattttaaaaagtcaatggcgtcaaatatttagggacggagggagtatatcctcgtatcagattgcatgtatgtggaacttgttcaaagcttctttttcttctgttctttggaaaaaaaaacaggtatgtataacacaaattgttatacacacacacttcttactaattctgatgtggcgtattatgattaaatctagcttttacataacttccaactacttgaattaaatggtcgagagctttagttagtaagattttttttaataatttgctagtacacatagtattttccatcatttgtttcaatagttcttcgatcaacgaatgagtgttggtcatcctcatccatgaatgagttaggcagaaatcctaatatgcgtatgtttttgtgggctgtgtcacacacatccagctcacgagagtccacgtgggggcttaaccttgacgcggtgctagcgtaccatgtatgtccgtgtgtgacatccaattttttttaagaagcgtgcatgcttgtagttttgcatatatctgaaactcaatatttttcaaaaaaattaaactaaaattagaacttaaaattgaaaaactttcgttcaaacgtagaaaactttcaattgaaaaatttaaactttcaactcaaaatttaaaactttcaactcaaaattttgaagcagggcgatgaaccctcaataatgagaatatattgtaaagtcaaaaattggatccaagaagataactaatataatacaatcatgatcaaatgtgcgcacgtgtgtgggaaatggatgtgtatgcggaaaggtggaagatggggttatgattcatttctgtgtgatcctcttccttgcactttatatggagaacatggttatttttatattattttttctctcttttttacattatgcgcgagaatattttatccttctcttgtaagcatttttatgaacatcattttttagctcatatctcacttggcatggatagttggagggacaatcatagacatgtgaagtttttatttggtggacagataatgtatgctgacttccggcatgtaagtttatcatatggtggtgaatggaatattttgataatcctcaagtgtaagcaaaataatgtgggtagaaggtatattcgttgctaacctccactgtggaggaagaacaaacttggtgcgtgtacgtgattttgatcatgaaagcataaaaagaatgaaagaattaaaaagggtctcaacaatttgactacactcgaaataataacaaggaacatatgcataaggtttgcagtatgatcgacgtatggcttgggtaggaataagacattaatgaggagcatgcaaagttataccatttttttcatttcataaaaattccctagaactcaacaaataggagtaaagttcctttcattaggctatctctcattcatcaattacttagatgatatgtgttcctatagatatgtgttcacaagcagtagctaacatgcgaggaataaaaattatgcaacgcatttccaggaaaatcatatactctagttgaagcatccaactccattgtaatcttgagtttaatttttttcagatattttctatggtgagaacagattaaactcaaaatttcagggagtttcagggaaaggatgcgcaaaccatcacttagtataaagtgtaatatgagggggctcagggatggtttggccgacgcggctgacccttccccagttccagtcatcttgctccttctcatgtatgttctgttagattaattggctaggcccaattaaatcctaataaattccattgcctcacattaagtgtgacggagcgtgaggctcctcaccgggagaccgcgcaggccccccttttgccggttcggccggggaccctgggtgaggttctaagctcctagtctgtggaaggttcgcgagaatggaagaagcacaagacacgggcgatgtatacaggatcgggccgctgagaagcgtaataccctactcctgtgttctggtggatctgtgtatgaagaagctacaaagagccggagagtcagagagcttttactctagaaaccctctcctctggttcccaatccagcctcgatcgttctggatcccctttctcagtgcgcaaggtcctccttttatacctcaaggggataccacatgcaccatctctctcttttgtgtggggacttatcctatctttactcaaacttgacttctcttcataaatggacggagatttgtaatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgtcagaccgcctgtcgccacctaacccacgatttgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcggggagacaaagaggggggcggccacatcaccctagggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctcctcagttgggcagaaacccaacggtcgccaatcacgcacatcggcaatggtaactcgactgtcaataatgagcggcctcttcaaggctgccacattactcgagtagcacatgaatcgggatgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacaacgttggcaagggtataaagacaccgaggaagagatttacttccttcctctcgccattattccccttgtcttcgccgcttgcgccctaactccttgtttcctgtgccctaccttcgccacacgcgctcgctctcaaacatctcttcttccggcgtcatggcacggggctccgctccgctcgatggtagcgtgctgccgccttcccgcatcgtgagcgagaggcaggccgggctgccgcgccgcttcatgcaggaatctgccaccggccgggagatagtcatgctgggcgagggacgcccggcgccacgctacccggggcggtccgtcttcttcctcccttttgcaatggcagggctggttccgccattttcttctttcttcatggatgttctggagttttacgatctccagatggcgcacctcacccccaatgcggtaatgactttggccatcttcgcgcacctgtgcgagatgttcatcggggtgcgcctatcccttcggctgtttcggtggttcttcaccgtacagccggtgtcgccgtcgtcggtggttggtggttgctactttcagccgcgggggccggtgctgaaccgctacattccctgcgtcctccgcaagaagtgggatgactggaagagcgactggttctacaccccccttgccgacgaagcgcgcctccgacttccgagccagcccccagcgcaggcctccaactggcgggcgccggtagatctgggagatggctacgacgccgtcctcgaccgcctggcgggcctgcgatccgaggggctcacaggggccatggtgtacggcgactaccttcgtcgccggatcgcgccactccagcggcgcgcccggggcgcctgggagtacaccgggtccgaggactgcatgaggacccaccagggggtcaaatgggactgggctcctgaggacttcaagatagtagtccaacgggtgctgaatctcagctccgtggaggcatccctcattccgcaaggagtcctccccctctgcagtgatccagatcgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgacgcccgggggaagaagaagcaggaaggaacccctcccccatctcctccccaagggggcggggcggcgcgtgccagcagcaggcgcccggagggggccacgccgacgtcgcagcccgagggggagcaaaagaagaagcggctccgcaagatgggggggacagaaccatcccggggaaaccttatttcccctccaaggtggtcgtttaaccgaccccctcgcaggttcgtcccacgcccgtcgtggctgtattcattctctcaacgcgagttttcactcacccatcttgttcgtcttctggtctttcttctgtttcagcgagatcccgtcgcgtccctcccgccattccaagtccggccagtctgaggccgaggatccggcgaccgcagaggcccggaggcgggaatctgaccggcgagaagccacggatcgcctacgggaagccgaggaggccgctcgggaggccgcccgggctcgccaggccgaggaagccgctcgggaggaggccggactccgccaggccgaggcgacgacatcctccgaggtgacccgtgaaactgaccggcaagaggccgcagatcgccttcgggaagctgaggaagctgcccagatggccgtccgagctcgccaagctgaagaagccgctcgggaggaggccagacttcgccaggccgaggcgacgacgacttccgaggcagctcgcgacgaggccgcgggcgcatcgcttgggcccactccctcgtgcgacgctcaggacaagccaggtccgggggacatccccgagtccggcacgtccatcggcgggccgagccgcgcggcatcctctccgaggcggctcttccccacgccttccgttgccccactgagtgccgagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgcctcagagctcgaagcccgtcggaaggtgttggcggagatcgccagggaggtggaggaggagcggggggctgccctcatcgccactaccgtgatgaacgaggcgcaggacaccctccgccttcaatacgggagccgggaggcggagctagggaagaagctcgacgccgcccggggggtccttgacgctgccgctgcccgagaacagcgggcggcggagaccgaggtggcatcccggcggcgcgaagaagcccttgaggcccgtgccatggcgctggaagagcgtgcctgcgtcgtggagagggacctggcggaccgcgaggccgccgtctccatccgggaggcaacgctggcggcgcacgaggccgtctgcgccgaagaggagtccgcactccgcctccgcgaggatgcgctcaccgagcgggagcgagctctcgaggaggccgaggccgcggcgcaacggctggcggacagcctgtccctccgcgaggcagcgcgggaggagcaggcgcgccgtaatctggaaggtgccagcgccgagagggccgcactgaaccagcgggccgctgaactcgaggcgcaggcaaaggagctggacgcgagggcgcgcagcggcggggcggccgcgggcgaaagcgacttagccacccgcctcgcagctgccgaacacaccatcgccgatcagcagggcgctctagactcgtccgccggggaggtcgaggccctccgcttggcaggcgaggtagggcccggcatgcttcgggacgccgtctcccgtctagaccacgccggccggtaggcaggcctctggggcgggaggaccgcaaagtacgccgccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggatcccgacttctccccatggacggcgctggacgagttccctcccgggaccgaggacggcgcgcgcgcgcaggtccgggacgccgccgaccacatcgtccacagcttcgagggttcggcccctcggctcgcgttcgccctcaactccgacgaggaggacgatgacggcggagtgggcggcagtggcgacgaggctggcgacccgggtgcatcggattgagcccccaggcccccgccaatctttaaatagtttcttcttccgaggccttcgggcccccttcttgtatagactaatttaatctgcaatcaaataaagaggaaatttttgtgtcaattctatttgttgtgtgtatgagacgaggatggtctgtgccgcagtccttttgtgtcttggcttgaacaagggctcgtgcccaggtcccagtcctcaaatggctcgggtcggggctagtgcctggggagatccacatgtcgagactggccaggccgggagcgtggtgaccgagggttatgggtgacccgattgtgggtttttgccgattcccccccggatgtcgcgtcccaaatcggctctaaaaattcatcctcaaaattgtgccaaagaataagtaaaatacaatgtgaaagcctccaacaattaaaatgtgcaaagataaaagtcaaatgaggcttggaggatttttgtatatttcctaaaagcctaaaatgcttaaataaattttagtggaattttcagagcacaaatgataattgaaaagaaataaacaaagttaaaaaggtttataaaaagaaaaccctaaaagaagttctctttcccccccccttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccgtccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgtcgtcgctccgctcttcctcccggctcggcgacccctccgtaggcttcgccgcatcgtcgccgaccccgtccgccgctccgcttcgcccgtcgactgccggagcaccgtcgtcatcgtcatcccgagccgcgccgccgtcttcctccgctccggccgccgctctcgtcgtcgtcgttgtcccggggtgagccgaagaccgccgttcgccttcccccttccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatgggatttttaattgaaaattaaatgaagaaattcgcaaatatccatttaaagagcatataagcttcaaatggccatatcttggccatttgaactcggaattggaccgttcaagtctctaatttttccttaagatgtaaagaacccatttttgtgctttgtttctgctgttatgtggagttattttgtgttaaggcctttttcttttccgttggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgttattgttattattattaccttgttcaccctagacaaacaaaaccccaactagtggacactctactcatggtatccctagtataattttaggtagatgcttcgcaatctaattaggtaaccttaggtggttttacaactatagactttgggaaatattcatatcacctggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttacaattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtatagttctaagatcgtgtttacaaaatggcctggagcaactaaatgtcttaaaatgctgttttctgcaactctaaccctttatattataattcccttgtactcccttgcatttattatgcattcgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgaattgtatcaacttttggtgtaccttgcctcctgggacaaggaataatacacgcacgtcaggaacgcctgttgggtgatttccggtcgtgacattgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgatttgagggtcgataactttgcctttgaattatgcttcccaagagaaccaatttatcccacttgacatgctttgacgtcttcccgaatgactttgctgctggacttgttattgtctggtcgtgatcctgccagatctgaagcttcgttgttagaggtgattttaatctgacctctgtagactatcttcgaacatatcacttggttcatcactgggaatagctcccacgaacaagcaactcagattcactttctttatgttcagtttactttccgctattctcttcatgttgtcatcatttagcattcaacgtattcctgtgcaccttcagccttgatgtgttctttcccatgggatcatctcccaagacatggcgttgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaacaggcgtatccaaactcctattccccaactactgtctcattggcttttttttttttttttttttttaacccaatacagtttaattggttttcttttccatcaacaggttggttattaactcgaggttagaacatagttcctctgaaatgagaccctaggtctcctttatcagtaagcaattatacacataatcacatatccgcatcttccaaaagaatcctcatggaacttgtctgtattacacatttctcccacattacatgaatacgaggcactgccttaaacaaaaagggacggtgcttaacatcggtacattgtatcctcaatatgaatcatccataagcatagcaagctcactgtttatagacatgaatatatttatgtattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttttgcttggtatcgccctccggaggtcgattgccctttgcttggcctggagtaggtcggggagagacacaacttcttccatggacgacaattctttgctggggctgtcggtgcagagaatggttagtgctgaaggtattattgccatgatttattgcagagttaggtggagcaagaggagcattggtgctgtggatgatatcatcgatgttgttgttggagctgactagctgacgagacaatcgtagggtcgttcgttggatttctgcggtcttggtcaacaacacactgagttggcaatccttgggcacatggtttgttccttcgcacagaaaacatgtcaccttgcgagtgggacactcccctggtggatggtcttcttcatagggagtgcagagtgtgagacacatgctagcaacgtgtccaatttctccacaacgggtgcatgcctttgatccgaagaagacacatctgaaactcttagtccaaacaaatgtctcttgggttgatcacttgattttcttcgccatcaatcgcgaggttatttgattcataatagattatgagcttacggaaatgagaccctgggtctccctaatcagcaacaaagtgtacacaactcaccgcacttgcaatcttaacatggatccttcataaacttatcaaactccttcataatctcatgtttctctgttattacatgattgacggggaacaactataaaacataagtatatgattactgatataagagtattatggttgcttctgactagagctaggcttaacaggtactgcatttgctccagcgaccacttggcgatgggcatgtccgcttccttaacaggtaccacagttgtaacagacaataactttctcgcgctcgggttcttcatcttgtacttgatttcttggctgctgtgctggaacatccaaaggtacgatgccgatactggcctctgtcttgtcaactgctggctggggctgaaattgagcattgacaccttgtggtaatgcgcctgctggagttggagctgttgcaacgcgggctataggactgcttcgggatgcatggatgacaattcgctgaggagcaagcttctgattgcagggagttgtgtggactgacgtgctggcagctatgtttctcagttttgggcacttgtcggcgaaatgacccattccttgacaattgaagcaacagatatcttcccggactcggcattttcttttctcattttgattcctctgtcctggcactggttttaagctgagactgtaatcttggcgaggattggtgttgccttgaggcttctctccgttggaactggcgggttggttagccatcttcttcgtcagcagaaaactgaattgacaattttttggtacatgatcagttccttcacaaaagaaacaagtgatcctgctcgttggacacctgtcgggtggatggtcttcctcacaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgccttgtcattcctggtggaggccattctgtgctggtaatagtcatcttacgtacttcttcttcagttcgcatcggtgcttttctcttttgattcttactcttcttgcctttggcttgcttagtacgtgaccccacgtggtacgaaaggctaggaggaaagcattttctaggattcaatggattgtctccattgggctcttcactttgcacactaggctgcaagcttgacttggtgcgaggaggctggtttagcgatgtctgccctgctgaaccaaaggaaggggcttctttgacatatacccatggacaattcagggcatagtgtccttgctctctacaatcgtgacaaaaggggacatcctcttctagcattggaagctcattgacctgggtggcaaacgctcgatcaaacacatactgattttggtcttgacttccaactaatggtagctgtgaactaagcagcatgcttggaatggaccgagggtgtgcccttgttaactctcttgaggccagtggcggattgagttgaaaacttgagttactggaggcatacccgctgacattctttcctttttctctgttaaacatctgttacagggattgaggtgagagaggaaaccaaccaggaaagaatagaccagaactagagacaggaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgatgtcttcttcttcacaaagctgaccaactagtactaattgaaatttgaagaaggaagaaaagggtaaaccttttgcaaatagcattaggggaaggagaaaaagaggaactttcgcaaatagttttatttataaaatatgtccttaggttttatccacttggcttatcctacagtcgagatggctctgataccagcttgtcg

SEQ ID NO: 74828 - DNA, 17544 bp, Oryza sativa
gggcggcctggctgggcctcggcctgcggccggcccagctgggagggggaaaaggagagaatgggccggcggcccattcgaaaagggaaggggaaaaagaaaaagaaaaagaaagaaaaggattttccctggaattaaaatattgcttgctcaattttaattggttaaaattatttctagggctctgaaaattccactaaaaaacttgttagcgaatttagacatgtagaactcaagaaaaattccacatgccagattcgattattatttgtattactttcttagggttttctcatgctttgcaccggcattttcttagggtcatttataaataaaattttaggcttgggaggagaacttcagggtgtgacaattatcacccgggaaaggctaatgtcgtagcagatgcccttagtaggaaaggctattgtaatgctatggaaggatgacagttgccattggaattgtgcaaggaatttgaaagattgaatctgggaattgtcagtagaggctttgttgcagctttagatgcgaagcctactctcattgatcaagtcagatgtcacgcccggaatttctatccaaaattccaaacgcttacatgtgtgttaaaccctcgtccaggaatcagccgaggcacacaataataaattgataatagagtacaaataaataactatttaatattcgcaaataataaattattacagaggtaaatagttcctctcaaagaataacatactacgcagcggaaaataaaactaaagcaaactacgaaacagctatggcaactccactccacaggcatcttaaccaagaacaagcttaatcctccaggacatcaccttcgctgagatactcctcctctgatgattgaatattgcaagaatgagcatatgacatactcaacaagccacacagcaaatatgcaagtgcacaggacaacaaaggatggcataatatagcttatttgcataaacagcatttaataaaaatttaagagaatagtaaaatagttgtataattaatcaatattaaataaacaccatacaacacacccgtgttgcataggcccaaccacatttgaacaacctaccccagttgaacaaattaaacctccaaaccaggaatataccattccaaaccaggagtcacattaattaccaccgttaccatttaatgtgtaatatgagactaatcacgaaaaacattgctcaactcacccataaccgcgggtacggctattcgaatagattaaactttgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaaccaaaggcaatggactcccttgcgacccccacggacttttcgccacttcacagtctggcgcactataatgaatcatgctataccaaagaatatacccgttgcccacgctggcttgtggttggcacggtaaatgtttcacaacagtagctcgcgaaccggtccttaattgtcatgagcacaaccatcaaaaccatatgctcacaacccactttatccaggtttcaattatcaattaattaacatcacacgtttaaccatcgtgagctaccatttaatataaccatcattaataataacaatataatataatatagtatataattaatccctttagttagctaatgtgtctaagcatggctaagcaaacatacatatagcatttggctgaaccaatccaatatataaggttcatgctaatcaaattataacctataggaaaataaagtcatcgtaggccattaattaattgggaaaggttcaccacccgatgacattcgaaaacaatgcatagttgaaataaaataatagctttaaacgggttcaacatgctcaaagggttgtttgagatctgtgtgacttgccttgggcttccacaaacgcttcggaatattcctcaacagaaacgcactcctccggaacgtcggaaactaaagcaattaaacaaaaatcaacacaacagtacaaaaacaagcataaacagtacatgtggatatttttaacatgtagatcttgattttagaaaaatttagcaacttgaaccacttgaaacggatctacggttatttagttatgattttccgaagatttaatctattagaaaatcgggaaaaagaaaaaccgatgatgtcatgatgacatcatcaatggtggccggctcggatggcaagctcgccggagctagagcggccggctgcggatttggaaggcatgcacacgtcgagaacgacgagacgaccgcaacggtgctcaccaacacggctaacgacaaccgacgacggccggcgacgaggtgggtggcggcggcggctcggtcggcggtggcggcggagcaccggcggtcggcggcttcgagggacgggcggccgggcttctcctcgctcccgcgcacctaacagtggtggcggcgaccggcggcgacgacggaggcggcggcgcggcgcggatggagtcgtcggcggcgacggtgagctaaacggcggcggcgcggcggctacgaggcacgggaaagctcgggagatggggcaaacgaaagagggggactagggggtcctatatatagactttgattgaagagatcggactcctcccgcaagaaatcggcccgagaaaacaaaaactcggttttggagataaactcaaaaacgagtttgattcggataaaatactcaacggtttgctccgatttttgggggtaaagatagaggaggatgagaggataaaaacccctaaccaatcagaagaaaaagggccggattgggtgcggatttggagcgggaggcggcgtggcgcgccggcttgggctcggcttgcagccggcctgaggttagggaagggtccgacatgtggggcccacatgtcggtctcccgagtggaggggtggctggcgggctggctgggccggctggtccggcttggccgcgggtgagagagggagagttgggccaaaaacagcccaacaacttaaggaggggtttttggaactttttcaataaaataatttgtgaaatgttgtttcaattattaaaaatacttcccttgctcaaataattcccagaaaattctagaaatagaggaacaagcaaagtatttaataaaattttatctagctcatttttatgttgaaaattttcctagattattagggtttagcttgtaggcttttaatttaatttctaaaaatgacttaaacaatgtatttttaaattaggcgatttttagggcgtgacatcagagaagctcaaatcaatgatcccgatatccatgagatcaaaaagaatatgaaaagaggtaaagctatcggtttcttggaagatgagcaaggaactgtatggttgggtgagagaatctgtgtcccagacaacaaagatttgaaagatgcaattctaaaggaagcccatgatatgttatactccattcaccctggtagtactaagatgtaccaggatctcaaggaaagattttggtgggcaagtatgaagcgtgagatcgcagaatatgtagcggtatgtgacgtttgtcagcgagtcaaggcagaacatcagaaaacccgcaggtttgctgcagcctttgaagataccagaatggaagtgggaggaaatcggtatggatttcatcaccggtctacccagaacatcattgggccatgactctatttgggtgatagtcgacagacttaccaaagtggctcatttcatcccggtaaggaccacctattccggaagtcgtttagcggaattatatatggccaggattgtgtgtttgcatggtgttcctaagaagatcgtgtcagatagaggtagccaatttacttcaaaattctggaagaagctccaggaggagatgggttccaagctgaattttagtaccgcttatcatccgcagacagatgggcagaccgaaagggtaaatcagattttggaagacatgttgagagcttgtgttttagacttcggtggaagttgggataagaatttgccttacgcagaattctcgtacaacaacagttatcaagctagtctccagatggctccttacgaagcactgtatggtcggaagtgccgcactccgcttttgtgggatcaaacaggagaacgtcaggttttcgggacggatatcctgagggaagcagaagaaaaggttaaaatcattcaagaaagattgcgtgtggctcagtctcgtcacaagagttatgccgacaatcgccgcagagatctaagttttgaagaaggagattatgtgtaccttcgtgtcacgcctcttcgaggagttcatcgctttcacaccaaaggaaaattggcaccacgtttcgcgggaccttacaagattgtcagtagaagaggagaggtcgcttatcagttagaattacctcaatccttagcaggtgtccataatgtgtttcatgtgtcacagttgaaaaagtgtttaagggtacctaccgaagaagcaaatcttgaatagattgaagtccaagaggatctaacatatgttgagaaaccaatccgtattttggaaacaaatgagagaagaaccaggaatcgagttatctgtttctgtaaagttcaatggagtaatcactcggaagaagaatcaacttgggaacgagaagatgaattaaagccaactcatccgcatttgttcgccagttcttccgaatctcgaggacgagattccgtttaaggggtgtaggtttgtcacaccctaaaaatctccaaattataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaatttcatttaatgaataatttaaatggaaaaaggtttttaaaattcccttttggttttgggacgaaaccgctctctctctctctcccttggcccaagtcagcccaagccgagcgccgcccgcgcgcgcgcgtgcgaccgccgctgacaggtgggtccctgtcacgcccggaatttctatccaaaattccaaacacttacatgtgtgttaaaccctcgtccaggaatcagccgaggcacacaataacaagttgataatagaatacaaataaataactatttaatattcacaaataataaataattacagaggtggatagttcctctcaaagaataacattctacgcagcggaaattaaaactaaaacaaactacggaacagctatggcgattccactccacaggcatcttaaccaagaacaagcttaatcctccagatcatcaccttcgctgagatactcctcttctgatgattgaatattgcaagaataagcatatcacatactcaacaagccacacagcaaatatgcaagtgcacaggataacaaaggatggcataatatagctcatttgcataaacagcatttaataaatatttaagagaataataaaacagttggataattaatcaatattaaataaacaccatacaacacacccgtgttgcataggcccaacctcatatgaacaaccaaccccggttgaacaaaccaaacttccaaaccaggaatataccattccaaaccaggagtcaaattaattaacacatttaccattaatgaataatgtgagactattcacgaaaaacattgttcaactcacccataaccgcgggtacggctattcgaatagattaaactctgatcagaggtgtaccactgtacccacaagacacaatcccacaacatgttaccatgcgccttagtaccaccacggtatctcggaaaggaactgtgacaatacccctcgcacaacacaactcaccacaatgcaccgttcctggatcataatctccccctcaaaccagaggcaatggactccccatcgacccccacggacttctcgccgcttcacagtctggcgcactataatgaatcatgctgtacaaaagataaagtcgttgcccacgctggcttgtggttggcacggtaaatgtttcacaacagtagctcgcgaaccggtccttaattgtcatgagcacaaccatcagaaccatatgctcacaacccaccttaaccaggttttaattatcaattaattaatatcacacgattaaccatcgtgagctaccattaaatataaccataattaataataataatataatataatctatatttaacccctttaattagctaatgtttctaagcatggctaagcaaatatacatatagcatttagctgaaccaatccaatatataaggttcatgctaatcaaattataacgcataggaaaataaaatcatcttcggctattaattaattgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcgaccgaaacgctctcctccggaacgttagaaactaaagcaaaaatactaaaatcaacaaaacaatacaaaaacaagcataaacagtacatgtggatatttttaacatgtagatcttgattttagaaaaatttagcaacttgaaccacctgaaacggatctatggatatttagatatgattttccgaagatttaatctattagaaaaagggaaaaagaaaaaaaacgatgatgacgtcatgatgacatcatcaatggccggaccaagatggcgacctcgccggagattggatggtcggctgcgaaattggagggcatgtacacgtagaggacgacgcgacgaacccaacggtactcaccctcgtgccaaacgacgaccgacgacggccggcgacgaaggggcgtcggcggcggctcgggatgaccggcgacggtgagctacggcggccggcggcgaagggggaggtgcggccgggcttccccacaccttggcgcaccaagtggcggcggcggcaagcggcggcgacggcggaggcggcggcgcggcgcggatggaggatggccggcgacggtggcggggtggagcacgtggcggcggcgctacgaggcacgggagatcgcgggagagggggcaaacgaaagaggaggactagggggtcctatttatagccttggattgaagagatcagactcctcccgcaagaaatcgctccgggaaaatctaaactcggtttttggggataaatccgaaacgaactcgattcgggcaaaatactcaacgatttgctccgattcttgaggggaaagatagaggaggatgagaggataaaaacccctcaaaaaaccggactaaaagtggagagattgaggcggaatcggagacgggagacggcgcggcgcgcccggctcgggctcggcctgaggtcggccggaggtggaagaccaccccgacaggtgggtcccacctgtcggcggctggggaggggagggcggctcggcgacgggttgggccggttttgggctggcttggccgcggggagagggaaaatgttgggccgaaaatggcccaatgactttaaggagggattttggaactttttaattaaaatattttgtgaaatgttgttccaaatattaaaatacttcccttgctcaaataattcccagaaaaatctagaaaatagaggaacaagcaaagtatttaataaaattttatctagcccatttttatgttgaaaatttacctagataattagagtttaacttgtaggcttttaaaataatttataaaaatgatttaaacaacgcatttttaaattagacgagttttaggcgtgacagtcccacccgtcagtcgtcgtcttcctcttgccgaaaccctagccgagctgcgccgccgccgccattccaaatccggccgcccctttccgtttccggtgaaattgattgaggggaaaggatccccgtgatccactctaccttttcccttttgaaaacatcgtctaaatcgctttggaaatcgccggatttgagttcgattcggatcgatctctctcctccgaaccctaaactttccttcccgtcgccggtcgccgtgggccttcgccgccgctccctagcccctataaattgacccccgagctcccctctacccgtcgccactctcgtcttagcccgccgccgtatgtagcgccgcctccgcgtgagaccttgagccgccgtcgccgccgtcgctccggtcgttgtcaccactcgggaaggccaccgtcgtgatcgccgtctcgttgctgtctccgtccgcaccttctccgtcaccgttgaccgccggaacgccgtcgccgtcgtcaagccgaaggtcgccgccgccttttcctcgtcgccgacgtcgtccgttgctcgtccgccgtcgctttggtcaccggtgagttcgcagcgatgcccgcatcgtttcggtgccctccattcgcgccgccgtgccatcgtttgccggcaagcatgtgtgcccaagccgctgccagtggtgacgtcgtcactgacgtcatcgtcgtcgtccctcgtggtctagccgtggaccgatggatctcggtcgtccattttggatggatcgatctcggccgtccgtttcatgaaccgccgccgtgcacccggtccaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaattttttctaaaattgagatctacatgttaaaaatatccacatatactgttcatgcttgtttatgtgctgttttggtgattttgttcttttctctttagattccgacgttccgggagagtccaattttgcaggagaagactttgaggatttccaaggccagcaaggcaagtcacacagatcccaaacaacccttcgagcatgttgatcccattgaaagctattgtttctattcaactattgcatttattttcgaatgtcattgggtggaattaacctattgtttattatggcccttttgttcttgattactttattctttgataccttgggttaatgtaatttgacaagttgagctttatatgatggttcagctagatgttagtcataattgcttagccatgcttagaaacattagcacactactgggataacttatgcttcactattatttaatgatggtttaataatagctcatgatggttaatcatgattggttaattaattaatttgccaactaaaacttgataatggtgggttgtgagcacatggttttgatggtcgtgctcacgacaattaagaaccggttcacgagtttcggttgtgaaacatttaccgtgccaaccacaagccagcgtgggcaacggctttactttctgtatagtacggttcattgtagagcaccagactgtgaagttgcggagataagcccacgggggtcgctggggagtccataccttgtttataagggggtgattatgatccgggaacggtgcactgctttgaattgtattatatagagggtattgtcacaatctcaattcgagtacttgtcaagtatcgcgacgcatggttgacatgatgttgaggttgtgtcttgtgggtacagtggtacacctctggccagagttcaaactattcgaatagccgtgcccgcggttatgggcgggtctaacaatgtctttcgtgattagtctcacacttctcaccatactaaatgatgctgttaataacttgatagctcctggtttggaatggttaattcctggtttggagatagaactgtgcagccgggattggttgttcagaatggttggcctatgcaacggggtatgttgtatagcgttggatcaatattgtttaattattatttaactgttttattaaattctgaaataattgttaaatgctatttaagcaattgagactatactatgccatgctttgttatcctgtgcacatgcataattattgcgtggcttgctgagtatgtcatatactcaccttgcaatctttcatcagaggaggagttctacagtgatgctgatggtgtggatgattaggcgtagccctagtcaagttgcctgtggagaggagtcgcctgcgctgtttcttttattttccgttgcttagaactttattgattgagaggaactatttacctctgtaatgacattttattcgcttattaattagagtaataattgtgctctattatcaatttgttattgtgtgcctcgactgattccaggacgagggtttacacacatgtaagcgtttgaaattttggatagaaattccgggcgtgacaacctatcatgcgtctctaatggcgttctataaagaatgcttatctttttgtcattaatatagtgatgatccttctgtcgtcatacagtctatgacgttcatcttcgtcactatcaagcccagaaattatgataagatgccatgtggcctgttaaggcccatgtagtcagggccggctcgggggggaggagggagcgggatggccgctctaggcccccacccacacaccttgtcaggtgtcacgccctaaaaatcgcctaaattaaaaatgcatattttaaatcatttttagaaattattttaaaagcctacaagttaaactctaataatctaggaaaattttcaacataaaaatgagctagataaaattttattaaatactttacttgttcctctattttctagaattttctagcaattatttgagtaaggtaagtatttttaataattggaacaacatttcacaaattattttaattaaaaagttcaaaaatcccttccctaagtcgttgggccgattccggcccaactcctctccctcccgcgcgcccgggccagcccaaagccgccgagccggcccaacccaacccgccagccgccccctccactcgggagaccgacatgtgggccccacatgtcggacccttccctaacctctagcagtcgcccggccgagcccagccatgccacccgagccgccccctttcccctccaaatccgcatcgaatccggcctccccgagtccgattgtttgtgggattttgatcctctcatcctcctctatctttaccccgaaaaatcggagctaatcgttgagtattttatccgaatcgaactcgttttcgagtttatctctaaaaccgagtttttgatttcccggattgatttcttgcgggaggagtccgatctcttcaatccaaggctataaataggatcccctagtcctcctctttcgtttgccccgtctcccaagccttcccgtgctccgtagctccgccgccaccgccgcctagctcgccaccgccgccggccaactccggtagcgccgcgccgccgccttcgttgtcgccgctgcttgcagccgccgccaataggtgcgccaaggtgaggggaagcccggccgcccgtcccccgtagccgccgaccaccggagcctactcgccaccgccgaccggagccgccgccgccgttcatctcgtcgccggccgtcgtcgttcgtcgtttggctcgagggtaagtaccgttgggttcgtctcgtcgtcctctacgtgtacatgtcctccatgttcgcagccgaccatccaatctccggcgaggtcgccatctcggtccggccaccattgatgatgtcatcatgacatcatcatctttttctttttcccgtttttctaatagattaaatcttcggaaaatcataactaaataaccgtagatccgtttcaggtggttcaagttgctaaatttttctaaaattgagatctacatgttaaaaatattcacatatactgtttattcttgtttctgtaaggttttgttgatttttgtttaattgctttagtttccgacgttccggaggagagtgtttccgttgaggaaggttccgaaacatttgtggaagcccaaggcaagtcacacagatcccaaacaaccctttgagcatgttgaacccgtttaaagctattattttatttcaactatgcattattttcgaatgtcatcgggtggtgaacctttcccaattaattaatggccgaagatgactttattttcttatgggttataacttgattagcatgaaccttatatattggattggttcagctaaatgctatatgtatgtttgcttagccatgcttagaaacattagctaattaaaggggttaaatatagattatattatattatattattaattatggttatattaaatggtagctcacgatggttaatcgtgtgatgttaattaattgataattaaaacctggttaaggtgggttgtgagcatgtggttttgatggtttgtcacatcctgattttcgtcttaggatttataaattatttaataaattattattagaatttatattaaatgttcgttaatttacaagtgaagttaattgtgggaaataaaatttcctaaatgtaaagcatggatggatttaatttttattaaattctccatggttaattatattctctggaattttctcggattttttggagctcaactcttaattttaatcatacaaagagcagttcagcaattatttaaatattaaattaatcattaaatgatctgattttaatattgttaaatactttgagtgtccaagtattttcaagatttttcttgaaatcatttgagcgttggaactatttttaacaattcaaagatcatctcattgattaatttattaaattggaagtcctttgttgctcccttccggcccagcccaaaaagtctaatctacctccctctcgctacagtgtcgtcttccagctccaggcagagcccgagctgccgtcctgtgcctgctgccgtcgcctcctcctccatcaaatccggtgcatccgttgatccccttctaaaattgattgcaaaaacggattcctctctatctcctctacctaatcccgaagaaacccccatcaaattcgttatatatctcacgaattttggccgtttatattcgggtgaactcagataaatcctaacttctttcaccaaatccatccgttcctgagccgatctcttcaatccaagcctataaatagcaccccctagtcgccctctttcgtttgacccatctcccgagctctctcgtcaaccgtagcgccgtcgccggtcaccggagagtcgccgctgccgacgaccgagtcgccaccgccgcacaagctcgccgccggccgtcatccgtcgtcgttcgtcacgttggtgagtatcgttgagatcgcgtcgtcgtcctctacgtgtagatgcccttggttagtccggccgaccaccctagctccggcgaggtcgccacccgtgccgtggctgccgtcgatgacgtcatcatgacgtcatcatctcctctttttcagtttttctttaatagattaaatagattaaaacttcggaaattcataactaaatcatcgtaactccgattcgagtggttcaagttgctaaattcatctaaaatcgagatctacatgttaaaaatatccacatatactgtttatgcttcttttttactgttttgtttattttgttctttcgctttagtttccgacgttccggaggagagcgttttcgttgaggaaggttcgtgagtgcgtcgaaagtgttcaacaagactaattgaagaccgattattgcaaggcaagtcacacagatcctaaacaaccctttgagcatgttgaacccgtttaaagctattattttatttcaactatgcattattttcgaatgtcatcgggtggtgaacctttcccaattatttaatggccgaagatgactttattttcctatgggttataatttgattagcatgaaccttatatattggattggttcagctaaatgctatatgtatgtttgcttagccatgcttagaaacattagctaactaaagggattaattataaattatattattattattaattatggttatgttaaatggtagttcacgatggttaatcgtgtgatgttaattaattgataattaaaacctagttaaggtgggttgtgagcatatggttttgatggttgtgctcatgacaattaaggaccggttcgcgagctactgttgtgaaacatttaccgtaccaaccacaagctagcgtgggcaacggctttaccttttgtatagcatgattcattgcggggcaccagactgtgaagcggcgagaagtccgtgggggtcgctggggagtccattgcctctggttttgagggggagattatgatctaggaatggtgcactgtagtgagttgtgttgtgcaaaaggtattgtcacagcctctattcgggtactttccagtatcgcgacgcatggtagacatgatgttgaggctgtgtcttgtgggtacagtggtacacctcttgccagagtaaaactattcgaatagccgtgcccgcggtcatgggcgagttgagcaatgtttttcgtgattagtctcacactactcgttaatgttaataatgtgataattaatttgactcctggtttggagtggataattcttggtttggaagttagatctgtacgaccggggttggttgttcaggtttggttgggcctgagcagcatgggtgtgctgttcagtgttgattaaaattgatgattaattactttactgttttacttctcttaaatctttgctaaatgctgctttcgcaaatgaaccctatattatgccatcctttggtatccttgtgcacttgcatatttgctgtgtggcttgcggagtatgtcatatgctcaccttgcaataatcaaccaaacctcagttgaagaaaaaggatccagaaggagaagacgtttggcttataccccagttgagctgcctgtgggagtggagctgaagccatcgctagatcgttaatttcgctactgttttcttttcttttgtaagtatgtaacgttaatattatgatggatttgtatattaaattgtcagtttgtgtacctcggctgattcctggacgagggttttatgcacaaataagttcggaaattactagtgaatttctgggcgtgacatggttgtgctcatgacaattaaggaccggttcgcgagctactgttgtgaaacatttaccgtaccaaccacaagccagcgtgggcaacggctttatcttttgtatagcatgattcattatagtgtgccagactgtgaagcggcgagaagttggtgggggtcgctggggagtccattgcctctggttttgagggggagattatgatccaggaacggtgcactatggtgagttgtgttgtgcgaggggtaatgtcacagttcctttccgaggtaccgtggtggtactaaggcgcgtggtgacatgttgtgggattgtgtcttgtgggtacagtggtacacctctgatcagagtaaaactattcgaatagccgtacccgcggttatgggtgagttgagcaatgtttttcgtgattagtcccatattattcattaatggtaattgtgataattaatttgactcctggtttagaatggtatattcctggtatggaggtttgatttgtacaaccggggttggttgttcaaatgaggttgggactatacaacatgggtgtgttgtatggtgttatttagttttgattaattactcaactgttttactattctcttaaatatttgttaaatgctgtttatgcaaatgagctatattatgccatcctttgttatcctgtgcacttgcatatttgctgtgtggcttgttgagtatgtcatatgctcattcttgcaatattcaatcatcagaagaggagtatctcagcgaaggtgatgatctggaggattaagtttgttctagttaagatgtctgtggagtggagtcgccatagctgttccgcagtttgttttagttttatttttccgctgcgtagaaagttattctttgagagaaactatctacctctgtaatgatttattatttgtgaatattaaatagttatttatttgtactctattatcaatttgttattgtgtgcctcggctgattcctggacgagggtttaacacacatgtaagcgttcggaattttggatagaaattccgggcgtgacatcaggtcccaaaattgaagattcggtaactgacatgtttaaactgtatcaagccctggatcagtagattgatacaggttcaacaatctgaatcttcatcgcatacatttgatcaaggctccaaaggtgatttctttacataaaataatagggtatttacaagattgtggctatctattactgtagaagctataggatgagccaactctaatgttttgctatagaattaaaccatctatctaatctataattgggaactaagttggaatgaaactaatttatatgtttaaactcatggttcggcaaaaactccaaattgattctcaaagagagggttaaagcaatggtgagtacaacatactcatcaagctattatatcaagtaatgaatgcatgaaatagtaatctctgagtagggtttaggacttaccctaaaccctatacaaaaaggtccatgggcattaggtgaattgcgtttaggtccataggcccacatggcatacaaagcaattttacaaaaagaaccttacaagatttaaatttctactaatgaaagtccttacgcctaatgaagtggctaaatagccggggcacacatgtcggtgacttggcggctagggaagcagaggcaataggagggcaacggcgaccaatggcgttcgcggcggcgtattggcttgatcatttttgggcgtctttctcctgggacgtaggcgacgtcggtggcgcaatggctcggccggagatggttcgagtcgacgggaatgacgaagtggggcgatggcggcgctatggacaccgggaatgccgacgagcatatcactaactgttcgatctatgccaaaatagaaacaaagaaaatggattgattaggtagagaaggaacttcacgttcccatggttggagtgcggtgaagctcaccagagaatacatgcgatggatgaaactccttcaggtgaaaagagtaagtggaagttcttggagattccgaggtagtttttggtggtttgcatagtggaacactgtgagaaatagatgaggttcacagtggcgagttggctagattaatgactactacagggacccttttagattccgtgcaggcggcaactcgttgcttctgggaaaatcggctcattttcacgtgcggtccttttaaaagga

SEQ ID NO: 74829 - DNA, 1605 bp, Oryza sativa
  unsure (1)..(1605): unsure at all n locations
ggagagctaatgcttatgcttattgggtattttggtttgacactgcttcacgcccaaaaagaaggcactacgtctgagctaaacttggatatggaagtcttctttcgtttagggtgaagtaagaccaagctcatgagcttattatcctaagtcggaacaaattagttgatagtgataggatcccctttttgacgtccccatgccccccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtagga

SEQ ID NO: 74830 - DNA, 657 bp, Oryza sativa
tcctagttagtaagatcaagaggcttgaaggagcaagagatgaagtcgctaatgtcgctataccactcgtccaagctatgttcctcaataacagtggtccgagtgtactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacaggacaagcgtagaggctgctcttgatcttatcagcaatgctcaaaatgcggctgacaagattgcaagtgacgtcgtagatcaattccgcaacaccgatcttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaaatcacacaacccaatgataaaccaaggaagcaaattgaattgataaaaaatcacactccgttattatga

SEQ ID NO: 74831 - DNA, 515 bp, Oryza sativa
acaaataattacattgtattatatttacatatatcaatttttttctaaaaaagttttatgacaaaatgtattagctggtcccttaaatgaaatgggccgtggaggtgggccggtccagtaagagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaaaaagaagagggcggcggcgatggcgaggcggctgatcccgtcgctgaaccgcgtgctggtggagaagctggtgcagcccaagaagagcgccggcggcatgctcctccctgagacgtccaagcaggtttcccccacgctgttcttccccccctcgatctctcgaggagctactgctgcttctgcttgctgcttcaagttggctgcgagtgtgatgcgatccggcgaggggaggggagt

SEQ ID NO: 74832 - DNA, 638 bp, Oryza sativa
agatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcaaattgcaggaagagcagcgagagccaataagccatttttaccatcagatctggcgcaatgcaccaaggaggaagcgaggacgaggaagcagacgagggagatcctggaatccattctcgccgacacaattcctcgctgctgcagcggtgttactgttgcctcggccggggaggaagaaaagtgaggtgcgaggcacgcaaaaagtatgagaggagtgaggaggaaagaggcgagtttctgtcaccaaccacttctttttaaatttactctttattgaatcttgataatctttactctttccttccgggctgggctaaaaactttttaagtaaaa

SEQ ID NO: 74833 - DNA, 14518 bp, Oryza sativa
cctcacctaatttatcgttattattaaaaaagtatttgaattgatttgtaaattatcagaattgatttgtaagggaccaaataattaaatttctgtttgcatgcagtcatatggaaatctgcgactttggctgaggtggtgagaattatttctgcatgattttggactactcgatcagtcacaagtcacaacgtaccttgctagttaggaaaactagtcttgccattttatttgtctttttgagagatcattactaatttggacgcataaatccagacaaaaccacaagcatatgcctttgttttctctgcaaacgctcgaatatgcatgtagtggcaccttaaagcaatggcacgtgtacgtgtaatgaacgtgctaacgaaaattttggcttttaaaggccctccttgtaatgttagaaaattttcttgatcctatgaacacgtcgtctctgcttgttgattatcagccctagtattctattgaaatccagtatgagaaaaaaaaatgagccacatcatcaggtaatattaattagttattggattcactagaagataaaagaggatgaattaatcttgaatggattagatggatggtataaaatttgaattaatcttgaatagattagatggatggtataaaatttattaaggtttccggagatttacgaagctattggaaaggattagctagatggatggtaaaattcaagactttcgaatatgcatgaagttattgaaagaaagaaaagaaaagaaaaaagataaagaataagcacaagaagagatcatgtggtgcatataattttaggatctacacgtacagtaaaaactgttttacaaataaaccctcgtcacattccttccaaagaaacaggcagccataatcgcctaattttttagaatgatttcgtaatgatttttttataggtttattaatttcacatgaatttaaaatacaaataacctattttcttacaaaacccaaaaaatatatgtgcatgatctataaaagcatatgcaccaacagaaaataagaggatggtgagaaggcaaacgataatatagtgactcgtacaaatataaagtttgcactgcatattaagccatttataataccatcataatatcatttatcctagccaacgttctcttccgatcaacgagagaagtccaatatagaaagattgccacttccacgtaaacaagatgtttatagtcgtgccattgcgcgatattataggctagtaattttgaattttaaaaacatgattttaaatttatttaaggttttctttcaatatagcttacttttatgcatttgcttttggaccccgaataatgtagatgcaaaaaaaatacatgtaaactatttttatttggttcattcatatctttgcagattatcattataactcaaccaatcaaaaatagattcatgtatttcaaagaaaatataaaaacaataaccatggtaacaaatatggacatgttcagtaaatgggttataaaaggtgggattgtgatagggtaatgaacagagggttgggatgaaattaagcatgaaaaatgaatggccagtacttaaatatacccttcagtgggtgtgatattatttcctaaacctctttgccaaccaaacactatgccccaattacaccgacaccaggctcagattgaaacagactattcagcaggttatctatttaattatagggttaaattaaagattttttaaactaaacttcataaataacttagaacaatgattcaaacaatgtcataaaagaaatatttttttgagatgatatatttttagaggcataaaccaatgattcactaatgatctaatgaagtagtcggaaaaaatcaggaccctttaaaataaaaaaaaagattgttgtggtacgagcaaacgcatcaagtgcagctcagggatgcgtcgacatcaaacgatagtggaattgacatgtgacgtatctcccaaagcaaagattagctaaaggtccatggatttgacaggtgacgcatctccgaaccttcggatcaaagccaagctcgccatcccagaaagatccgggaagccaagccaagaaagccagccacctcgcgtttctcaggccacatggctgcatataaattgcgagcctcgccgccctgaccatttatccattaccatcacagaagaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgtaagaaggtatttttggtgttggatatattgattgattgatggattaaaattggtactgaattgtttttgtttgatttgattttattaggatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctggccaatcaaagttttataatcaccttttctgaaatatcatctgttcagggttaaaaattttagaatgcaaaaaaattgcggagattttgaactgaattttcagacaaattttgtaatttgaacaggttttcactttacttgaaccgaatttgagaaaattcaatcaaattcagagtgtttggtcggtattacttcctaccgggactcactgatagacccaaattgaatttcattctgaaaactgtaaaccttaggagtgcttcggacgaaatttcgttccaaattaaatttgcattggatgatgaaattcatcaatctccctgtcaattttttcagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctattcggcaggcggctcgctgctcttctgaggctgatgagtttgtctagtactagacacgcccgggagctctagctaggatagaaaactagagaaagtttaattatacctgaattttaattaatcacctcacaaaactctgatgtatcatattatatcgtgatagtgactgcttgttaatttaattttgccgatcgatgtgatcttcggttcgtgtgttcatgacttaacgtcttcatgtatgtttttagcagaaagatcaactgctggttttaatatacaatttttaggaattttaccccgtaaggtcgaataccattacttcataatttagtgggatcattttcataaattttaatgaattggcatgtaaaaaccaagagttgtaatgatgtttgtgaaaaagttatagggttaagtgaccccaaagcctcatacatagctccaccactgactgagcattttcttttctttcgcttgctgaagtgatccactttctgagcgccgcattccaaatacaatagatcaatggacacaaatgtacgatatttgttaataagattagccaaaccctatacatctggcgtactaattatgtctacatctctcttaatatacgcacaactacaatataccaatgacccacaacaaactagtttcatcgatcgcttcctcgcctatgttacagcaaatgcggcggttatctcaggtggttctctttattttaaaaggggctaggatattagaatattagaagttaactctatttatatctttaatacctattacaactttaaaacctattgatagccaactttatatagtagatatatttaacataaacttaacaaagttcaccgttttgcaatgaaatttataaaatgtcaggtctatctcactgtaggaaaaacaagttcaccgcctctagccagaattttagaatttatttgaattcaacaaattaaaatgtttgaaatcagtgaaaacatgtttaaagtttaaaactcttcattcaaaaatttatgtccctttctcctgatttgtttttcgttcgcaatgtaaagccttgttgtctctgagcaccatttcaacaagtaacaagtcattaactggtaactacaagtacccttgacccagcaaatgagctaattagccggtctgttattttcttcctttagtccaaatcgccagcaggcaaattaaaccggttgaattcccagtcaaaatacgagacctgcatgatcgatgataggcaggaaaagactcgtgtaacgtactcctatcattctccgaagtttctatactccttaatctctcgcttgtctatcttatcaatcaaatgaacaccactctttaacatcgaatattcatttgaaaaataacaatccctgaaatggttccatcaggaactaacttattatttggcaaccatacattacatgttccttatgggaccaagaatagtatgtgttggactttggaatgttcttttttgttaattactccattgtggcaagaattgaaatagtttttagtgatattatattggttcatgtcttaaatggattctaatttgcttgtcatgttacgaaagtatggacatgaaatttgcaggaaaaaaactaaggatggcaacgggggtgagggcgggttgtaggcagagctgcaatggagttcagggcctgtctggtacagctccaactccaactccacccctcctagagttggagctcagccaaacagtttcagctccatcaaaactgggagtggagctggatggagctctctcataaaatgaactagagttgtgtagctgggtttaggcagctccacaactccactccagacccaactcctggagctaaatttaggagttagagctgtaccaaacaggcctagaatcttggtgtttgctagagctattgcagggcaaggataaacaaatatgggtgggaactcaccataaacaagcattggttcgaggtcaattggccaccttcactcgcaggagcaccttctccctatcgtgccatctatctcagctctgggacttctgtccgcccacgaatccatgatcaccatccacaggcacggtgagagtaggagttgatttggtgggagtcaaaatggaggtatactgtagcagaatggtctaaaaaaaatatttctactagcgtgaatggccgtatcaacacccgagctgcgtcatctacactttgaatcttgggtaatacaatagatcaaaattaagaactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctatagggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccagctggccttcgccgccgccgactggtgtttccgcctgcacggctggcctattatgccgccgctgttgggcgtctacgacttcaccaccggcctgcctccatcgccgccgactggtgtccccgcctatacggtcggttggtcacaccaccgttgatgggcatcgtcatctacactgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcgttgccgtcgactggtgtttccgcttacacggctggcctattctgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggttcgttggatggaccgagtaacgcaaggtgctaagtattattcggaataaatcaaaagcatagagatgagataaatttattttctgctcttaataattgcaaaagtacctgagtagtaaattctgatccgtgaaactgtgttccattaatgacgaactcatgtcactcatatgcatgtttgggaaatgcctaggccgactcccgatgcttgggggcaatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttatactccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcgtcaccgaccggccgccgcatccgccgctgactggtgtcaccgcctgcacggctggcctgttataacgccaactgatgctatcttcttcacggctagctacatcgctgtcactactaataggcatcagtatcttcaacacaagctgcctacgtttgccatggctgccgactggtgtttccgcctgcacgctggcctattatgccactgttgatgggcgtctacgtcttcaccgaccggcttgccttcgccgccgccgactggtgtctccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccaccgactggtgtctccgtctgcacggctggcctattatgctgtcgttgttgggcgtctacgactccaccaccggcctgcctccatcgccgccgactggtgtttccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcgaccggccgcctcgtccgccgccgactggtgtcaccgcctacacggctggcctattatgccgccgttgttgggcatctacatcttcatcgccggtcgtctcgtctgctgctgactagtgcccttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaggcaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgctgatgagcgtctttggcattatcattggttgctacactgctattggcttgatcaccgacatcgtcatcttcatcatatcggttgcgtttgtcgtcgtcaagtatgaggctaggtcttcatgattggtggatttcgtcatcgcctttgatttgcctcgtctgtcaccgactgattatttcgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagctcaaacacaagtatcataccttcaatttggacttgctctggatacatgcaatatggattcatgatcatgggtctattttctatgtttaaagactggactatttattattccccgtaagggttatcaaccgaatacttgcgccagtcgggattcaatttttatatctattttggagtattccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttagcctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggtttgagagaagattatcttttcgactgtgaaggtctcaggggctactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaagccctctaggggcatgagacaacctgatcgtcagatcaatacaccctcggcggattcaaatccccaaacaggagtagggtattacctctcattgaagggcctgaacctgtctaaatcctttgtctccacatccatccacttttaggtctcgtgcgctaccccgttttattattgccgaattcatgtttcgacaagaacataggtttgaactttacaagtgttcatgtgcctagatgaaaccaagttcaagtacgtatcatgtattttactttgattgtaaaaaaaaattacaattaacacagtggtgtgattggatcctaaattaaataagggttaatttgatatgtgccattgtaaatatgtcaattcagataaatgctattaccattcatctatccgtatcacgtcattcgaattcgcacaaaattataaccgtaccatcaccgtcacgttttccatcatcatcatagaccaaaatatcccttgacgtgggacccacatatcagttccatctttccaccattcttccatcttttttcctcatcttcttttttcctttttctctcgatctttgtctcgctcatctctcctcctccgttgctcacacgtggcatggcaccaccgtgcctcccagtcagcactggtgataccgctgctccacctcacgtcggccgctgctacctttctccacgcctcatctactgtctcagtgtccacttcgatcgtctccatgcctctgcactctcctttgcaccgtgcaccgctcaccgctgacttcgtggcctcgaaacctccttgcatcggcgctctgctcatccccaggctgtgccgtgccaggtccaccactgcttttggatctgccagaccatgtcggatgccatcacttcacggccgatgctgccatttgctccaccaccgtcgacgctacctcttgctcgagctccaccccatcgccactgcttgctgccgttgtttgaggatgacggtggtgatggaaaacgtgacggcgattgcatggatcatattttagaaagtttcagtggcatacaaccgatatcacaaatagtaatgatatttttctaatataaaatatttttaatggcatggatcaaattaacctattaaataaatagcttaagataaagtatttaaagatcatgcctttgaagctttttagttgttgttactagacacatgcaccatgcaaagcagagtcacagagagataaaagagaatggggaatggggatggaagtagtacatcgatacctcgctggtgagtcttcggaaggagtggtggcgtccacactctgacatctgacttgatgaattttagtactaataataactagatgaaactccacacgttgctaagagattttttttatgataatagtaaaaatatttataagatagctagacataataattttatataattttcatctttgatcgattactaaataaaaagatgtaaacaagatggtgtggtttataataatctaagttaatatataggttaatcactcaaaagaaaaattaagataatgtggctcaatgagagaagaaaaataaataagataatatagattaatcatctaaaaagaaaacttaggtgatatgacttcgtgagagaagagaaagaaaaaagataatttggatataaaccaataatccaagggttagaaaaaaataaggtgatgtcttactgagaagagagagaagtggcattaactgtatttagtgggaatgaacctataactattgattttttttatttccaattgctaagcaatggtaaatcacaaccggaaaggaaagcacccaaaacctataattaccctttccaaatttgagcaactttgctactataaaactgcaaagctgtagccatcagaatggacctacacgtcaatcaattaaatgtttatttattttattttggtatctaaatcaggttagtactgaaagatcagcaaaaatcagctagcgtatgaccgtatgagttgaaatacgagagagaaaaaaatataatttacaaacaaaataatgactacttgaaaaaaaatcttaaatactgaaactaaatattgatcaaattttgaaataaatattttacacaagcatttacaagcttgaaccatagaactaaaagttcaggaaatagccagatatgtactcatttcatcctaaatatagcaatcttgtaatagatatgacacatcctagtcttacgaatttttggaagaaacacggtacaaatacaaacgctcacaacgattacgatttttaaataagtgtaggattcctgtccggattccagtcctaattaagtactccctccatcctctaatataagggatttttgacattttgcttgtactgtttgaccattcgtcttattcaaaaaaatttgaaattattatttattttatttgtgacttactttataacccaaagtactttaagcaca

SEQ ID NO: 74834 - DNA, 1129 bp, Oryza sativa
  unsure (1)..(1129): unsure at all n locations
attggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggccttggttggaaagaaacgaagtatattgatttcttggatttctctctctttattacatggcccttgggggctatttatagccccgttacagattctcacttctagggtctagtttgtatgaggaatttacatagttgcccttatgaaaaggacgtttacagggttacataacgttaaagggggttaaggggccttga

SEQ ID NO: 74835 - DNA, 6382 bp, Oryza sativa
cagggttacataacgtcaagggggttcatgggcccttgatggccatcgggcgatcgccggccctatggcctctaagcttggtgggccgagaaggctacttcggccctcgcgggggcgaaccggtcctggcgaagtcgtccttctctgggctggatgccggggcgaaccggtcctggcgaagtcgtctttcttcggcatgcactcacccgacccttcgcctcgcatcatccttggctcgtggtcttcgccatgggtttcggcagattcggtcgaagggactcatgccatccgccaacagctatgaacccgtgttcaacaattcccacgttgagccgcttaaactcttgctgcaattcctcacacatgccctcgatgcatagagcagtgcagtaacttttcctgcttaatgcgtctgccaccacattggctttccccgggtggtagtgaatgctcatgtcatagtctttgattagttccaaccatcttcgttgtcggagatttagatccggttgggtgaagatgtatttcagactcttatgatccgtatatacttcacagcggttgccaatcagatagtgcctccagatcttcaaagcatgaaccactgctgccaattccagatcatgggttggataattcccttcgtgtggacgcgactatcgcgaggcatacgctaccactctgccttcctgcattagaacacacccaagcccgtggcgagatgcgtcgcaatagacctggaaatctttcatctggtcgggcagaatcagaactggggcggatactaatttctttttgagctcctcaaagctcttatcgcactcagctgtccatttaaacttttcatctttcttaagcaactgagtcatgggtcgagcgatcctggagaagttttcgatgaattggcggtaataacccgccagtctaagaaaacttcgaatctgcgacacggtcttcggtggggtccatttggtaactgactccacgttcgatggatcaactgccatgccctgagctataataacatggcctagaaatttgacttccgtcaaccagaagtctaacatggcccagaaatttgacttccgtcaaccagaagtcacacttgctgaacttggcgtataattggtgctccttcaacttctcgagtaccagacggagatgctgctcatgttcttcttcagactttgaatagataagtatgtcgtcgatgaaaaccaccacaaacttgtcgagaaattccatgaacactttgttcatcagattcatgaagaatgcgggtgcgttggtaagtccgaaagacataaccgtgcactcatgcagcccgtaccgggtggtgaaagccgtctttggaatatcttcttcccgaattcttaactggtgatagcctgatcgcaggtctatcttagagaacaccttagctcccttcagttggtcaaacaagtcatcgattcgtggtaaagggtatttattcttgattgtgacctcgttgagtgcgcgataatcgacgcacatcctcttcgtcttatcctttttctccacaaaaatgaccggagcaccccaaggtgaggtacttggtcgtatgtaccctttctgcagctgctcatcaacctgtttcttgacctcggctagttcattggctgccatcctatacggtctcttgtagattggggcggttcccggggccaaatcaatccggaattcaatctctctcttgggtggcatggtggtgaggtctttgggaaacacttctgggtactcgcagactatgggaatttcttccaatttcctcgaattcatcccctcggtgaccactggggtttccgcctcaatctgattcaaggagaccccttgctttggtgagactagtgatttatacactattgtttctcccttctcgttagtcaaggtgactgtgcgattcgcacaatcaatgactcccttaaacttggtcagccaatccatcccaagaatgacatctaggtctttggaatcaagaagaatgatgttggctagaaatggtgatctttgaatttctattgttatagaagggctgaattgtaccgaagtggagctattccctggggtatgaacccgcattggtgtgctaagttcctctcttattaacccatgcatcctgacaaacttctttgaaatgaacgaatgcgttgcaccagaatcaaaaagtactgttgcagggattgagttaacaggaaacgtacccagtacgacctctggtgctgcttgcgcctcctttgcagacgcgtggttgacacgagcctggacaaactttgacccggcacgcctaggcttcgggcatttgtcggcgaagtggccaagctcaccacagttgaagcaggaccctggctttgctccagtctccttggcttgcgcggacgggcctgactgtgctggtgccactggtgggtgtggagctgcaccgtggttaggctgacctccatggtggttctgactgccactggcgccctggtggaagttgctagacttgaacgtgcggtgctggcggacgatcatggtggtaggtccaccctgctgtccgagagtgaagcgcggtcgctgatggtttccttggttggaccggaactgtgccgcctttctcttcctgtccattttgttgcgctgatcctcctgacggattgccttgtcaaccaacctttcaaagtcggcatagtctccagatatcagctggttggttagctcatcatccaggcctgctaggaatttctcctgcttctcggcgtcggtgcagacatcctccggtgcatatcgcgcgaggcgattgaactcatggaggtactctgtcactgtcctgttgccctgatggagtgcccggaatcccctcttcttttgtgccacgaccccgtctggcacctgcgccttcctgaagctacgacagaactccgcccaagtgacttcagtgcctggcgggcgggtggccacgtgattgtcccaccaagctgacgcaggaccttgaagctggtgtgtggcgaaagcgaccttctcctgatcattgcactgcaggagattcagcttcttctctatggcatggagccagtcattcgcctccatggggttggtggtgctggagaaggtgggtggcctgacgcgtagaaactcgggcagcttggactgaggaggagggggaccaaactgctggtgctgctgttcggcgtgctgcagcatcctctggtgcatctgctggtgctgctgctgcatctgctgcatcatggctgccatcatctgagtctgatgtgccattacttgggccagcgtcagattctcgggaaatggtggcggaccattgccggaatcactgttggggtgcacaccatcagcgcgttcttcgccgttgctgccctcgcttgtcgtgcgggtgccattcctggtgtagaccatctggaggaagagcagacggggaaacggagaaaaacagttactcaggaactaagctttattatagaaatttaaactgcaattgttctgatctgaattaaaacactttaaacagcaagcaaaaatccttattaggacagccatatcataggcacatgatatcgactgtcgactgaccccaagcaagcaacctaaacacacaaactaacaagcagaagctaggcagtcgataagctaatggaaaaccagcctaatgctcggaacggctcctgcggtcggtggagtcgaaggcgtcctcctgctcgtcaccacgtccttctgagcgactcctggagcctggcagataagtctcgccgctgcccggctctgagccactggagctgctgctgctgtggtcgcggttgccactgggagtagctggcaaccaacctccatttccactggcggggcccctgacggctgatgcaggagcgaaggagagagcagatgcaggagctgacatgggaacaggagctggagctggcgctggagctgcaggaactgctggagctgcgggcggaactggaggtgctgcgggaactgctggagctgcgggagctgctgacggaggtgggttcctaggcgcaagctggacgcgcacgggtgccgttgtcgacttgcggggcgtagtgcggatccgaactcctcctggcgcgggaagacccttcaattgagcattctccctcttcagacgcgctatctcgtccttcagagcaatgatcctcacaagcttcccatcattcaaggccttggacgccttgtgcaggtccgagtgcatcctgtccatccccctcatcacagcgcacatgtgaccaaaggtggtgtcgttctcgccggctgtcggacggaaggaactgacatcactgccgctggctcgacgagggtggaaccggtacgccgtgtcgtggaagatgtagttgtggcgctcccgtagtctggccatcatcagatatgctgcctcctgacatgcgtgatctgctgtgcctccagacgcctcaaccaccattttagcgaggcaagtccccatgtagccatggacctccaagcggacacggtgaggaagctcgccactgagcggtggaacagtcgtgtactccggcgcgttggggtagcccaccaccagtgtcatgcgtgccaactctgccacgaaatcacccatgccttctccgcggtggttgggtgggtgctcggccatctagagaagacaaaggggtaggatcaatgcatgctcaaatccaatttaaataaaaataaaggactcaaataagagaatcgaataagagcgaaattttatgcatagattattttgcatgagagcgaataaataagacggacttacatagcgataaaataatggggaaattagatacatacttataataacaagaaaagcataaataccttacaacccatattcctgagctaagacctaatgcatttcgcccatcaaatcccaactaacggtcaaaaacatctcaaataattttactaaaaccctagacctacttgtcttaacaaatctcacttaaacgagcaacaagatttgtcccttgaaccacaagaacagatccccaaattttcccggaacaattccaattgcaaagaacatatgcaatgaaaaggattcagagggcccttaggtttccatttggcttgtcctacggtcaaggtcggctctgataccaacttgtcacgcccagaaattcccgaatagaattccaagcagaatgtgcattaaaacccccgtccaggaccggccggggcacacaaacgacaatgttgacatacagatccacgtcttacaaacattataaaagtcttacataaatgcagcggaaaaagaaagataacaggagctaatccttgactggaactgcagcgagaacaccactccacaggcatccttgacggcacggacgaagcctactcctcggagaacccgccatcagacacatactcacactctggggttgggggaaaataaagcaagactgagtactatccactgtactcagcaagtcataccggaatgggggtatgatgcagggattcaacaagggatagctatacaggttcatttgcataatactggcatttataaatagaagtcgaatgcgaaaatagttgtaataattaaacgatattaatcatccactatccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctttctagccaagcacaccacaccccaggtttcacccctgtccccagcgggcgacgggcagtcccctctcgtgcctaggtgaatccggaagcgacagaggccgtcgcagggcccgcccctctccatcacgctcacccttgcctggatgcgtcagctagagaaaagctacactacaagcccagccgttgcccacgctggcttgtggtaagtacgaggagttcttccagggtttcccgcgaaccggtccttaattgccatgggcgcgacaagcaaaaccatgcacccacagcccaccatgtgattcattttaattaaccaacaccagagcggtgggactaatccaacattatcatataaacctacagtctatattttaaatgagttttccccattgtgtgctagttgaactatgcatggctaagcaattcctagtccaaagtctattcatgtcataacccaagctaacaaaggagcaaggtaccaaaatagcatgggtgcaccaataggtaaac

SEQ ID NO: 74836 - DNA, 6151 bp, Oryza sativa
aagacgagtggtcaaacagtgcaagcaaaatgtcaaaatcccttaaagctactatagtagaagatttttaaagtacctctgtaatttgaatttgaattttaaagttactatattgccagttgatgtaacagcttgctcgattttcagtcatatcgaatccccaaaaattttaaaattaaactacacgaaattaggttaggtttggttatagttcggtcaaatcggtgagccgaacacacccgaaaatcactgttaggttcaggttcggtccagttcggtatgtgggccccaccggtcagcctcagacaagaaactccccaaccccatcccgtcctccatcacttcgccttcgccttcgccgccgtctcccctcctcgccgcggccgccaccccgccctcgcgcctcgcgaaccctagcagccacgccaatcgccgcgcgcgcgcgtgggagggcggcgccgcacccgggagacggacgatgtccggcggccaagacgagggctcgggtgatttgggttcgccgaagctagcgcaaggtatcgtgggggattcaactgcaattccttcttgtttttttttcttttggaatgatagggagaagggcttggttgaatcgcgtgacctagtttagtttgttcagtgattgctcttaggtgatccatatgcagcattaggctaggaatttatttcattattatcgcgaattcgttatggcctgcggtgatatgacttagggattcgatggataaatctaggagcaaaatcgagtagtgagtagttcgattgaaagccgcagagtgcttattccaaacaatgtatgcgcgtattttgtgtgaggaaaaattcgacgcgttcttaacagaggaatcgtctctctggagacatctgatagaaaccattggaatatgttattttttgggtagagctgttattcactgttcaatgttaaatggtcaatttgtttgttgttcaacaccactagagctggcagatgagtgtcgcacatgtaagaagcaagttgatgcatggaaaagaatcaacatgccaaacagtagttggaaatgtatgtcctgataacactgctgctgaagccttgataagttaattggtcaacaaggatttcagatgcctgaacggatggaataccgaattcgctagtgtgaaaatgagagcacattcatgatcacaaggtgatgacaccagattgattttacttctagggtggcagtatttagccgattaaaggtatgcggattggcatagtacacggccatcatgtagttgttcagaatggtgaatatcattcaaagaagtatgaaggtgggagtcatcctggtgtgctcctctaataactgtgcaattacctactgccttgtatatatatttacatgaaaattgaatgagactttgaacttcaggatttctctagtccatacccaatgaccctccatttcgtgcggggctaaactgatgattgtaactcatgttctttaattacactggataatagttgcgtaaacaatgtcttgtatgatgtctgaagttgattatagtattttttagatcaggtagtggtggactgccaataggtagctagtttactaatagctctgtgacattggtttggggagaccaaaggtggttgaaacactccctatattaattagagtggttacagatcaagcagtgatgcattaccaataggtcttataattcgatgactctgcttcacggatttggagagaaaattgatgttgcatttgcattgtaatgctttacaatgcagagtgcaaatgttaattaatgcatacaccacttgctgccacaactattacttgtattgtgttcatacttttatttatcgttgatagtttctactgtttccgcagaatcttaagtactccctccactccagtaacaaaaacatgtcattttggacgccaacatagtatttgaaaagcagcattgatcactaatttctattacgatgcatttttgaaatctgacaatattattatattactaaagttctttcttcagtgaatctacccctatgattttcatgcatcctatgcaaatattaaaaaatatgtacatatttaaattttgaaagtttgacttaggatatatttgaaaatcaaaaagagtggggtttttgtgactggagggagtatgatttacctactatcaatgaggttactgcaattttacaccataatattcttaactcctgtcactcaatctacttcttgtagaccatcacatcatggacttgggtgacaactctaagatcaaaagggcaagagccacgaattggcctacagtcatgtcaaagtttgtgcttgattggtaccttcagaagaagaaggagatgccacccaagaccaagttcaagaagatgcaccaccattattgcacgaccgtactaaatgctagatttgagacaactttcactgttgatcaggtccaccgccactttaggcgcttcaaggaggtttggaatattgtggcccgttatatgaatatgagtgggagtaggtttgacaagaaacacaaaatgctaatactacctccttcaactttggctagtctacctgtaagtatttttatcgttggagatgattgcagtttcactattctccaagtgcactaatgattcttttcctccttgtacagatagcagagcgtgcaattcttgttaaaccaattccattcttcgatcatatacaagctctctttggtgagtggtcagtggatgctgcccctgtgacagacccaattgaagctgctgacattaacgatgatgacatggaaatcctcgatccgttgaacatgatggcaaattgtgcagatgcaagggaccctgatggggcagacttggacaagtttgttttggaggatgaagatgactgtcatgaggtggcagcaagtagtgatgcagtgccttgtgaagtgatgtctgacactagtgcaccatctgcccagccatctggatcctttgctgagagcacaatggctgctctcaagcctggattgaagaagtgcaaagtagtcagcagaacaaaaacaaccccaaacccaaaaccgcaggcacccgtgccacatgatggcaggaaggcggatatggtaaagagtaccttagctgggatccatgacacccctgcaaaaccaatacgagcagcaccgacatcatcggacccaaatgctcctctatggaacatgctgaaagaaatcccactgacacctgctgatagactctcagttggaatttgcctttgtaaaccagagtttgaagtgcatcgaagctttttcatgaacatgggtagggagtaccttgaagcttgggcccataagttcttatctggaggtgagcctggatccttatagtctgatagcgcagaaatctggctaatggttcttacttttaccccatcaatagcaacccatagtctctgctgatggattactgtttatagagccttggttcagctgctcaaatataattggtaaatatagtaggcaatgtgaaactcatcttatcttgacccatagctgacagttcagtaatgtcgtcttgtaatttgtggacaaaggtattaacatcgtaagttggtaagctgtccagagcttacactgcaagtctacatctgatgtcccatgatgctgaaaatgattggatgttatgtgtgccatgtctttgttcagattcgagatacctataccttctttttttttccttcatctgaatgtgtccttttgtttaactttcgtgtgtcaatctaactgtatgctgtccttccttgagcaagacagctctaacctatgctgattgccgctatatacttgcagtattgctttatgaattaactgtgcaagtgggtcgacctgtcaacctacttatctctactataaaaacgaagtcatcctctttgcaccctcccccactgtgtcactccgcttacgtaatcaccgggtccaatgttcctcaaccaccatcctagtctaaccctgatgatacggtccagttataatgtacgagtatgttaccagtagaccaaataaatgggtaacttaaggataaaccaatttaattagcttataagtagattcacgtgccgatccacttatatcctcttaaatataaaatagtgcaccgaaaaccttttgccgacaaatatcttgtcaaaagattcctcgcttttgttgatagatttgtcggcaatctagcgtcgcagtgcagtgaccatccctttctatgcatagtcaaatgatgttttatacagtactcccttcgttccaaaatatgcgcattttagaatagtaccaagtcaaatatcttttaattttgaacattagtaacaaaaaaaaatttaaaacatcaatcatgtaaaatttatgttaatagatttatcattcaacaaactatcataatatgcaactcctttttatttaaaatgttttactattttagatactgttggtcaaattagcatctcggaaactgtgtcgaagtctataaatgtttatagtttgagacggagggaatatttaggtacctttctttatacatgtacgaaacatacatataccataagataataaattagataaacggaacataaataaggctgcattcgtttcaggctgttcccaacctctctcccttgttttccgtgcgcacgcttttcaaactcataaacggtaagttttttgcaaaaacttcctatacaaaagttgctttaaaaaataaaaatccatttttgaaaaaaattagctaatactccctccgtattttaatgtatgacgtcgttgaatttttttactaacatttgaccatttgttttattcaaagtttttgtataaatacgaaaatattatttcatgcttaaataacatttgatgatgaattaagtcacaataaaataaatgatagttatataaattttttgaataagatgaatggtcaaatgttagacaaaaagtcaacggcatcatacattaaaatatggaggtagtacttaattaatcacgcgctaatagaccgctctgttttccgtgcagaggagatggttcccaaccctagctaacgaacacagctaagttgagaacaaaacgaacaccagtcattatcgtagcgggcgcgggattaccctgatgggcctaaactcgaaaattaatgggcctaacttgcttctcctaatgggccaagtggcccaatctccccacgatacatggaaaggtagtactagcgaccaatgtgcgcccaagattgatctgccaccgtccgtgaaccaatctgacggccaaaactgcgaaccggattatatccagttctttttccactggacggagtgcgtttcgtatccccttttctccagtgacctgcggtagtagtactcactactacacacggctagggtttgagcgctctgtgacactgacagtgggccccacccccgcctcctcttctctcacgccgcctccgcttcgtctcctcgccggagttgagccgcgggatccgtcggagatggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggtaaccgcgccgccctcccgcttcggtctcgccgccttgcgtttgggggactagctaacccatgcttatgcctgcaggctggtgttagtgggtgtgacaaatctgtggggaatcttctctacactgtgagcatccgtcgctgctgagttattatatgatagtagtattgatctaattaaaatctgtgaattggtgatagttagtttgtgtgttaattggttgcgcattggagtaggtcgcgacgaagtatccggcgaatgccctggtgcatcgtcccgttgtcatccaatacattgtgtcgtcaaaggtgagttctgttgtgtgtgattgtgttgtaaacactgctgctgtgtggctgagttcgtaagtgttgtgaacttgacaaattgtggtttccagatcaagacccccgcgcaattagatgctgctctgtcgtttctttctactttgggtcctgatccattggacacagcaaagttt

SEQ ID NO: 74837 - DNA, 8927 bp, Oryza sativa
gagtttcttcgcgtgaggccacctgttttctctagcaccactaatcctgtcgaagctagtgattggttgcacgccatagagaagaagttggatctgctccagtgcagagaccaggagaaggtctcttttgcgtcacaccagctgcatggccctgcttcggaatggtgggatcactcctgccttaacaggactactgctgaacctatctcttggcttgagttcaccgctgctttgcgcaagacgcatataccatcgggagtggtgtccctcaagaagaaggagttcaggtcgctcacacagggttctcgcacagtcacggagtatctgcacgagtttaatcatctggctcgttatgctccagaggatgtgcgcaccgatgaggagcgccaggagaagttcttggaaggacttaatgatgagctttcttacccactcatgactggagattatcacgatttccagaagttagtggataaggctattcgtcaggaggacaattataatcgcatggagcagaagaaacaccggattgctcacttcaaggcacagcagggaaatagtcagaggccgcgtattgcttcgggacccctgtccatgccacagggaggttcttcgtctgttgttcgtccgcagcgacaattctttaacaacaacgcgggcaacaacaaccgcaagccagctccatgtccggtggcaactccgtcgcagcaatagcctgccaagagggagcaaggcagcaagcccggtgtgtgcttcaactgtggagacccaggacattatgctgacaagtgtccgaagccctgccgcgcgaaggtcgtccctgcccagaacaactcctccgcaccagcagccaaggctcgtgtcaaccatgttgctgctgcagaagctcaaggtgctccagatgtgattttgggtacgttccctgttaactcagttcctgcaacagtgcttttcgattctggtgctacacattcgtttttatctatgagttttgcggaaaatcatgggatggaggtagaggagcttagacgtcctttgatggttagtactccgagtaaccaagcactctcctcacaacgtagcccctctgtcagaatagagatccgaggtgtacctttcctggccaaccttattctgttagaatctaaagatcttgatgtcatcctagggatggactggctagccagatataaaggtgtgatagattgtgccaatagaaaagtaactctcaccagcaatgatggtcaagttgtaactgttcatgcattgccctctgaacctcgaaggtcaagtctaaaccaaataactttggaagagattcctatagaccgggagtaccctgatgtgttccctgatgatttacctggtatgccgcctaaaagggatatagagttcagaatagatctggtgccaggaacaactccgatccataagcgaccatatagaatggcagccaacgaattggcagaagtcaagaggcaagtagatgatttgcttcagaaaggatacatcagaccgagttcatctccatggggagctcctgttatctttgtagaaaagaaagaccatacccagaggatgtgtgtggactatcgtgcacttaacgatgtgactatcaagaataagtatccactgcctagtattgatgatttgtttgatcaacttaaaggtgccaccgttttctccaagatagatcttcgatcagggtatcaccagttaaggattaaggaggaagatatacctaagacagcttttactactcggtatgggctatttgaatgtacagttatgtcttttggacttaccaatgcccctgctttcttcatgaacttgatgaacaaggtgttcatggaatacctggataagttcgtggttgtctttattgatgacattctcatatattcctaaactaaagaagagcatgaagaacatcttcgtcttgcattagagaagctgcgagaacatcagttgtatgccaagtttagcaaatgtgaattctggttgtctgaagtaaagttccttggtcacgtcatctcagcaggaggagttgccgttgatcctagtaatatggaatctgtaaccaactcgaaacaaccgaagacagttacagagattcgcagtttcctaggtctcgcaggatattaccggaggttcatagagaatttttccaagattgccaagcccatgacacgactgcttcagaaggatgtgaagtacaagcggttagaagaatgtgagcagagttttcaagagttgaaaagtcacttaatatcagctcccattttgattttgcctgatccaaagaagggtttccaagtgtactacgatgcatccaagcttgggctaggttgtgttctgatgcaagatggaaaggtggttgcctatgcatctcgtcagttacgtccgcattagaagaactaccctactcatgatcttgagttagctgcagtggttcatgcgtcgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattattgtcactcccagaaattcccgaatagaattccaagcagaatgtgcattaaaacccccgtccaggaccggccggggtacacaaacgacaatgttgacatacagatccacgtcttacaaacattataaaagtcttacataaatgcagcggaaaaagaaagataacaggagctaatccttgactggaactgcagcgggaacaccactccacaggcatccttgacggcacggacgaagcctactcctcggagaacccgccatcggacacatactcacactctggggttggtggaaaataaagtaagactgagtactatccactgtacttagcaagtcataccggaatgggggtatgatgcagggattcaacaagggatagctatacaggttcatttgcataatactggcatttataaatagaagtcaaatgcgaaaatagttgtaataattaagcaatattaatcatccactgtccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctctctagccaagcacaccacaccccaggtttcacccccgtccccagcaggcgacgggcagtcgcctctcgtgcctaggtgaatccggaagcgacagaggccgtcgcagggcccgccccactccatcaagctcacccttgcctggatgcgtcagctagagaaaagctacactacaagcccagccgttgcccacgctggcttgtggtaagtacgaggagttcttccagggtttcccgcgaaccggtccttaattgccatgggcgcgactagcaaaaccatgcaaccatagcccaccatgtgattcattttaattaaccaacaccagagcggtgggattaatccaacattatcatataaacctacagtctatattttaaatgagttttccccattgtgtgctagttgaactaagcatggctaagcaattcctagtccaaagtctattcatgtcataacccaagctaacaaaggagcaaggtaccaaaatagcatggctgtaacaataggtaaacatcccatagtgttattgcaaaacaaatgcactatttgaaggaaaacaatagaacatttgcaatgtaggatcaacatgatcaagtgacaagcatgacttgccttgctctgctgctggaggaacctcggcgactatttcgaagtatgccggagcgtcggaagagccggaatctaacaacatacaaggcaaacaatgcaaacaagctataagtctactgaaacagagaacaaaaccatttttaatggattctacacatttttcttgatttactgagacttgaaggggcttaaacggagctcggatgaattagttatgaattttagaagattcactgtgtttattactataacaaaaagtccttaaataatttattgggcaataattcccagggctgacgtcaccaagggggggcggcgccgacaggtgggtcccaccggtcggtggctcgggagagagggggaagggcgccggcacacgggccccactcggcagtggctcaagggggggcggtccaccgtggaccgggaccacgcgggtggtccaccgccggtccacgggaccgacggcccagatcggccccgagccgatcgggcggtgccggtagaggcggccgccgagctcggctcggcatcaaagccggccggccagccatggctagtggcgacggcacgcggccgacggcgacggcgaacggcggcatgggaggtggcggcggcggccgaaggcgacggcgcatgacttgaagcggcggcacggcactaggtgggagaggaaggggaaaagaggggagggatgcctcaccgcgagtggccggcgcggagggagacgacggcgagctacgggaagacggcggcgacaggcggacgagcttcgggatgccctaaggaaggaagagagagagattagagggagggagttgaaccacggcggccggcatccatggccaaaggcagcggtagaggtagagctcaccggagcgcgaggggatgcggattccggcgacgaatctcgacggggaaggggcggacgaggtggagttcggcctcgcgaacccgacggcgatggcggcgcggtgcggcggcgaccctagcggcggcttgcggcggccggagtagcgggagcggcgacggcgagtggttgcacggcgcgagggcgatggagagctcgggagagaggggcggcaaaaggaaaaacgaggaggagggctcggggatggattttataggggcgggaagatcaggaacggcccgagcacgcccgatttcgccggcgacgtgggaggtgggaggtggagagagagagagagtggcgggattcaaaaaacgaatcccgcccatctcggtagagggcgcgggtgggagagagaggggtgggcgcggggaaggcgggggcacgcgcggcgtggccgaagtggcccggaggaggcggggcggcggtttcggcggcggcggtgacgtggaggggcggccggaggttggggaaggacccgacaggtgggccccacctgtcggcgaccctgggagaggagggaggcggggcggcctggctaggcctcggcctgcggccgacccagctgggaggggggaaaaggagagaatgggccggcggcccattcgaaaagggaaggggataaagaaaaagaaaaaggaagaaaaggattttccctggaattaaaatattgcttgctcaattttaattggttaaaattatttctagggctctgaaaattccactaaaaatcttgttagcgaatttagacatgtagaactcaagaaaaattccacatgccagattcgattattttttgtattacattcttagggttttctcttgctttgcacctgcattttcttagggtcatttataaataaaattttaggcttgggaggagaacttcagggtgtgacaaacctaccccccttaaacagaatctcggccccgagatttggaggagctggcgaagaggtgtggatgggcgacttttaactcgtcttccctttcccaggttgcttcctcctcagaatggtgactccactgaactcggcaaaacctggtgaccttgtttctggttcttctttcgctggtatcaagtatatgaaccggcttttccacatatgtcaggtcctcctggatatcaatatgctccgaatcagcctgttcttcgggtactcttaagcacttttttaattgggacacgtggaacacgtcatggatgccgatcatattggatggaagttctaactgataagcaacttccccccttcgttccaagattttgtagggtcccacgaaacgtggtgctaacttgcctttggtttgaaaacggtgcactccccggagcggagtaacccgaagatacacataatcccctgcttcaaaagtgagctcccttcggcggttatccgcgtagctcttctgtcgagactgggcaattctcaacctttccctgatggttctgactttctcttctgcttccgttaatacctctgtcccgaacaattgccgctcgcctgtctgatcccagaagagaggtgtgcggcacttccggccgtataaagcttcgaacggtgccatctgtagactagcttggtagctgttgttgtacgagaattccgcatatggcaaacttttgtcccaagctccaccaaagtcaagagcgcaagctctgaacatatcttccaaaatttgattgactcgctcagtctgaccatctgtctgcggatggtaggcggtgctgaaatttaaacgggtccccaattcttcctgcagtttctgccaaaattttgaggcgaactgactccctcggtcagattcttgggtaccccatgcaaacacatgatccttgccaggtacaactctgccaatctctttcccgtataggtggtatgcactggtataaagtgagctaccttggtgagtcgattcatgactacccagattgaatcgtgacccgatgatgtccggggcagtcctgttataaagtccattccaattttctcccatttccattccgggatttgaagaggtttatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaatacgacctttaccacaacggtgccgtccatggatcaaattatttcgtggattggatttcacttgcctatctatggttcccttgcgtgtgctcgggatagg

SEQ ID NO: 74838 - DNA, 3484 bp, Oryza sativa
aagcttttgaaaagttgatgaattcataccttgcagggctaaaacaactcttatgttgataagagtcaaccacaatttattttgcacatactatagttggctgataaatcaatagtccttcaaatgcccattttcagctcactgttgtttaagggcctgcgtttttttcccctgcaggggtggttgtttcaactgaagagattcagtcaatggtcactgatatcctgaaggaaaacatggaagccatagttgaacagcgatatcatataaatggtttgttttctgcttcattttcattttactttgttattgatggttttgttttatctttcgatttgtgatgtcgggaaagctgggcatcatttgctcctgactttcttgttttccagttggcagcttgtgcggacaggttaggaagtggcacccctggggcgatgctaagttcataaaggtttaatacatttcatggctgaaattatggagttttttgtttaattgctactatttattactagtaactttgtgatatggcttgtactaattacttctgttaatctacaggaggaaattgataaaaggcttacagagattcttggtccaaagacagaagctgacaatgtaaagcctgtgaaaaagaagaaggagaagcccgcaaaagttgaggtttgttacctgaaattcaatcaagttttatggcaggactgtttagttattagctctgcctcatccagttttgtttctgacaaaatataggagaaaaaaactgcggtagctgctcctgctccaccatctgaggaagaacttaatccctactccatatttcctcaaccggaggaaaacttaaaggtaagatgattgttatataggatatgcaatgatactccatattcctcaaaataaagaattctctaatggccttgaagctgaaaattgttctttacgagtaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggttgtgactatccctttcacctgtgatgtcaattctgcaaatgctggtttctcaaaatctgaaatgatgcttacaagatttttgatgcacaggctatgtttattgattttggactggctaaagagcgcaacggacattgttaccttaggtacgaaggaatagttagatgttatggttccaaaggagccttcaagtccattgatttgcccttttcttccttatatggacatactgcattgcaaaacatgctgacatgattaatatctgaacaacaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccaggtttgttttccttggattgatagttgactgcattaatcatatagctttttaaattgttatcactgaacgcctcttgagaaagcaacagtatgtgtaaattgactattgtatgcttgccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaaggtaaacaattcgacattatggagttactgttttctgtgaagtgtagaatttaatatatttctatatatctacacagtttacacctcatccccatgctggcgacaagtggtttatctatccaagctatgactatgctcattgtttggttgactctcttgaaaacattacccattcggtaatagtttctctctaactacttttggttgtgtgagccttaacatgttatcagttgaaattatcagttgtacacactagaatttgacatatggctgttgcaatcaccagttgtgcacactagaatttgacatacgtcgtccttcatactactggctgctcgtatccctggaccagtaccagccatatgtttgggaatattcaaggttaaacatatcaaacaatgttatgtccaagcgaaaggtatagcgctgattcttgtggagaattatatcaatcttatgatccttgatatatggttctataatatggattggatttgcagctaaataaacttgtgacagagaagtgggtagatgggtgggatgatcctcgcctgttgacacttgcaggactacggcggagaggagtatcatcaacagcaattaactcctttattcgtggaatgggcataacaaggaggtaaggagaaatgttttacccaaagacatgcttccatctttcgatatcagcagaactttttctagttgtcaacataatatactgataccattattttatcctttcaatgcagtgacaacagtttgatacgcttagaacgccttgagtatcatattagagaagagctcaacaaagtagctcctcgtgctatggttgttttgcatcccctaaaggtttagcaattggcattctctttttttttttggcaaaagttttgttatttttctctttgttaattgacgcactgatagtattttcttttaatttggtaaattttaggttgttataaataatttagactatggaacaataatagaccttgatgcaaaaaagtggcccgatgctccaggagatgatgcttcggcctattacaaggtaattcttatgtctgaatgacttaatcattttgagaattaaaaatctggtttagtggttacagagtccctttggttctgcacttctgctcaaagattagacacattgagcaatataagttcatcacttctctgattctggaactgtggtcatccctaggttccattctcaagaactgtctacatcgagcagtctgattttcgtgtaaaggattcaaaagattattatgggcttgctcctggtaaaacagtactactaaggtactagtacattatacatctgtagactctgtacttaattagtttgcttactttgtatactttgtggtctcatctatgtttgccgtctgaaactgataggtatgcattcccaataaaatgtacggaagttatctatggtgataattcagataatatcattgaaatccgagctgagtatgacccttcgaaggctacaaaaccaaaggtaactaggcaattgaaattcttttagatcagatgagaatattattctgctatttgaatttatgagatcatgatgttgtgtacaatatgtagggtgtg

SEQ ID NO: 74839 - DNA, 8837 bp, Oryza sativa
actcttgagcccactagatggttgtaataattacttaaccagatatcaatttattaactaaaagaacaccatcctataaatacagagtgagggtgcatgggggaagagcaaacggggtaaatatgtgctaagtactaactactaacagggagtcagggatgtaagcgaggggcagggagtaaaacagagcagtagagggaggattatagtagatgagatgtagaggagagggaggaaaaccacaacatagcagcaaatgagggagcagagtagaggatgtagaagaggggggaggaaacaccaaaacaagcagcagaggaaggataagaacagggtagaggaaggagcaaagcaggatcatgtagagcagagaaagaaacagaggaaagaagagggtggaggaaagaggagaaagaagagcgtgcctgcttagtttttgtgtcaatggtgaggaccaggatgatggcgcaggtgcagaggaccaggacgatggcgcaggtgcagaggaccaggacaatggtgcaggcacaggatagccgcaggcaacaacttggatcgccgccagggatggagatgtcgcgagggatggatcgccacagcctcagactccagcgaccctctttctgttgttttctccttgatttggtgggatatggtgcgtggggaccttttcaccccaaaaattggcgcttctgttagttctgtttcacgcccagggcccatggcgccaattttttcgggctcttcaaccaatcgcggcaaaaaccacgccctcgacttcctgtggcgttgcctttagccattgtagcgcctaaggacgcaatatcgacgccgtagcggcgccttgggcataaggcggacgccataagcaatatggtaaggcgggccagacgccctgactcctggcagcgccttaccgctatagcgacgctatggcgatgccttgacaaccagcagaacattgaataaggtatcaaatatccaattgttgcaattatgctgttatgggcctcatcgcaggcagttaagagtatactagcaaatacgcagatccaattagtacttgtttgatttgatgactagctttgctctcgaatgtcataattgatgactagtataagtttacttgcatcaagatataaaggactttacagatatgcagtatatctgaagcttatttaatgcttcatacaatttatgtaaatacttaaaaagatcgacttcttttgctacttgtgtggaagcacttatgtaccttagaatagcatgatattgttgtatctccatttgttttactttcctaacattttccttttatcatgtacagtttatgctgatgggagcatatgcttagatatactacaaaaccagtggagccccatatatgatgtagctgctatactcacatccatccaggtagatgatgccttttttgggggtattagcatgtcatgatgtcctgtcatgtttgttgcaatattttgtatcatgtttataattcgtgcttctgattttggtcctgtctttaaaaatattgagcaaactcaccaatctagtataagtgaattgtcactaacttaattgttgtcgccttaaaatacacatggtgtttccttatagatagtctgcttttcctccccacatgctccattgttaagtagtaagctatattcacttgaataattatttttctttgttagaggcactatcacgcgatatacctgtggaagggtttcatcttgagagtagagatattaggcctctgtgactgattatcactattcagtattaagtgacattggcacgtggggtatatatacataaaaaagaataatatttccagcctctgcttagtttttgattctggtgacaactatatataggccacgaagagtagacggctaacttctatatgtaggcaaacttctataacagtaactttagtgtggtgaggccgcctgtcaataacaacatattatctttatatgtttttcatatacatggtgatatttattaatctatgctctatggaaaatagtatagaacacaataatttttatatcagttgggatacttgcatatcttgcttctgtgaataacaaatgcatatcacaacaatgcatatttcatggactcaagacattgacatattacaggcaatttcattgatttaactgttcagtacttctatttcctgctttgtattatttccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgcttactgttatgtatgcccttcccgaatacgaggaaggctttggaccatgttgaggaccatatggacttcttatataacatctattgttgccagctactaagtgttaaatgctatattgagtacgaagccgtgcctaaaattcaatgagtaattcttttcgccattcaaggaattacctcgtgggctatatgtattttatgctctagttccaatatctatctttaccttgaggattaaccaatatcgagatggattcaaccggaatgcgctcagacgtgtgagtgtacttgtgtgtgagaaaaaaaaaagacagattttttcagtttgtcgtctggaatttcaatctggatgggtagggattaatgcaaaaatctgaagcagatataatttcactgatgcaattctttctgcggaaaaaaaaagctttctcccgttgagaaagcccaagatatttgtatctgctcagcccatctcagaaatatactggggccgatattttacacctgattttgggcccataactaggcctgagcccatgtagccttccgtgaactcttgcgatgtccccacctgtcagtctccgctcgctctcccgtccaaacgcctatattaacgcgccgcgcgcccccctctccctcccaaaaagccaaagccccacccaaagcggcgacgcccctctctctctctctctctctctcttctcttctcttctctcctccacgtcgcggctcgcgcctccaaatccccccccgcgaggcgagcagggcgaggcggcgaaagcgcgacgcgcgagcggatcgaggcggcggcgtcggtgccggcatccaccgcgtgcataggttgcgtcggcggcggcggaagcggggcgcgatgacggacggccaccacttcaacaacatatccctcggcggccgcggcggcaacgtgagtgctactcgtcgacttggtcgaaaaattcgcttccccctcgtcgaatcttcgcctccgggcttcgtttcgttaggattttgtggcggcgttgtctcgctcccgtggaggcggtttccgcggacgggcttgactaccggaatttgtggcggcgattgattttgtttttttttggtgtggcgggcggttgatttttctagggtttgcgcgctagggtttctgcttggaaggggggaagtcgaaatgaattaggaaaattttggtggatggactcgaatattgtaaggttggctaggcaaaacgaattattctgttgcaaatgcggcggtgaaaagcattgtatggaacaattttggaagttaaattaattgtaaatattcccaaaccctgggtttttgataatctcttcattcaatatcctttcactagtcgaatgtctcatgaaattgctcctaatatctagttggcttgcgtttggcgcacattttagcattcatcctgtggttatttcgtccatcactgcatcaatttatttaatcgcatcttatgtcctacataattatcagtattcttcaattttaaataccatttatcttcaatttgcttgctttgttaaatgatttattcctcttatgatttttttatcacatgcctgaaacaaatcactttttgcagaactaaaaatgttttcatctgttttgttcatgattttttttctggaaatagtggatgcttatgccatttcccattgcaaataggaatatgtatatcaagtttagtctgatatcaacgccaacttttccatcatcattatttgcttgcccactgttagtaacttcccttgtaccttgaggtgctgaaatcttctgctactgttattgtttgggctcttgtagaaccctggccagtttaaactttattcgggaggacttgcatggaagaggcaaggtggaggaaagaccattgaggttgaaaagtctgatatcacttctgtgacatggatggcaatccccagatcctatcagcttggtgtttcaacaaaggagggcctcttctacaggttctttggcttccgtgaacaggtaatacttcctcctgtttttcctaagaaaattaggtcttcccaaacgtgtatgtttctcatagataacttttattgagctaagatttttcttctaatttttaggatatcagttcattgactaacttcatggaaaagaacatgagaatcacaccagaggagaagcagctttctgttggtggacataattggggcggaattgaaatcaatggttagccaaattctctatattattccgttgctccattgcctttctgcaacgtttggtagtttgattgctttccatgttatttccatttcaggcaatatgcttagctttaatgttggttcaaaggaagcatttgaagtctctctagcagacgtagcacaaactcagatgcaaggaaaaacagatgttgttctggagtttcatgtggatgatactactggtggtaatgaggtatgtggtttatccagatatacatttctctgcatccaatttcgcccatattttattagatgctacttttctgtttgttaggtgcaattggttataagtaatcaatttatgtttatcaatctgaagaaatgtggatgtaacaattgtacaagctatctgttacatttcagtgtcatgtattattagctactcaactgtctgccttgtaattaaagagtgattttactgtcctgctttttcattctcatttgatggtattgcaagtaacacactcccattgttagagaaaaaccatttcataaaattttggggtctttatttgtgctgaagggcatattgatcattgttttccaccctactacatattttggagggtctttatttgtgctcagaatattattaaggtagctaagctaatcgttgacaaaaaaaaaggacagctaatttcaacttcctttccttcttttaaatgtagaaagattcattgatggatttaagctttcatgtaccaacttcaaatactcaattccctggagatgagaatcgtccttcagctcaggtgagtttgctcaacaagcatgcaagatggacaacatacacatgattttattgtgcaaatggtgaaatcctctcctttttttaggttttatggcaggctatcttgaataaggctgatgttggctcatcagaggaagctgttgttacatttgatggaattgctattcttactccaaggtgggtaaatcatataaccatagagactagactttttagaaataaggacatcattcaatgttattgtttcaattttctggaatagctaacttctccttttctattcagaggtcgatacagtgttgaacttcatctgtcattcttacgactccaaggacaagctaatgatttcaaaattcaatatagcagtattcttcgcctctttgttttaccaaaggttctgccccttttatatttttattatgctgtacttgttgttaactttgtatctgacaaaaaatcctatgacttttcaccttggcagtcaaataatcctcatacctttgtggttatcactcttgatccaccaattcgcaaaggacagacattatatcctcacattgttattcaggtgttgtattagaattcaatttgatactaacttggttacagtttacggtaaccttccaatatgcatttggtaaccattttctgtatttatgaatagtttgaaactgaagcagtcgttcaaagggatctgacattaagtgatgaggttttggctgaaaagtacaaggatagactggagaactcttaccaggtgatgtattttgtttgcgttcaatcaagtctgacattcttcatctaaaaagtggatcctaattcccggctcatgtagttttgcatttctttctacatctgagcatctgtagaacaaaaaaaaaagtagtttgggggtgtgaatcattttaaataactgcttccagcaatgttatttgttcttgtttgttttagtttcttgtttgtagtcatatgctctgagctgtatttattgtggtaatgtgctgctggatgcttgcaactccaggaatcatcagtgcactgattcccaaacttgtgattcatccgtttatcactgaattgcttgttttttttctatctactcatgactcctgtttgactgaattgcacaagctgctattgatgtgatgaactgcttctgtggcattactgccattgagtctatcattatgtattcctttgtgtttgcaactttgcatgagttatagggtcctatagcttttgctcatttgctatttttaactcctgatagactaataacaaactcacagaaagtatttgatttatctatagggtctgatacatgaagtgttctccaaggtccttcgtggcctatctggtgctaaagttacgaggccaagcacgttccgcagttgtcaagatggatatgcagtgaaatcatcactcaaagctgaagatggttgctctatccgctggagaagggcttcttctttctaccaaagcccccaacactcattctgcatgaggaggtctgttttctacactgctgagatgattgataattccatccatttgtcctgttttaagctgtagctctttatggcagattgagtatgttgaatttgagcgacatggtgctgggggtgctagtatctcatctcactattttgatctcctggtcaagctgaaaaatgatcaagaacatctattcagaaatatccaaagaaatgaataccataatctcttcaatttcatcaggtctgtgctttatttagctgattccaccatcattggtttacttgcctttttgaatagaagtatgaagctgataagtgcctttttgtaatccctttcaagtggcaagcatttgaaaatcttgaatcttggagaagctcaaggtagagctggtggcgttacagctgttcttcagagcactgatgatgatgctgttgatcctcatctggagcggatcagaaatcagactggcgatgatgagagtgatgaagaggtatttcctgcgtttaattgttgatcctacttatcatgattccatgatctgacttatcaatcctgtcatagcttggaattaatttgtttgtatcggataatcttcaacttcaggatgaagattttgtggcggacaaggacgacagtggatctcctactgatgattctggagaggagggttctgacgctagtttaagtggaggagaaaaggaggtaactcattttactcacgcaatatccctgatcagtgtctataatgaatacatcatgctaatcaacattactattccccccctccaaagaaatcttccaaaaaggaagctagtagctcaaaggcgcctttgaagaagaggaagccaaagggtggggatgcggcggaaggctcggagaaaagaaagccaaagaaaaagaaggatcctaatgcccctaaaagagcaattgcaccattcatgtacttctcaaaagctgagcgagctgtaagttcctttccaccctgcactactgtacagaaattccctgactaatcctatgtgaaacattgtgggaggatctctctctctctctctctctcacacacacaagcaaagaagggagcttacgatcgtttttcccaaatgcagaatctgaagaacagcaatccggagctggctaccacagagattgcgaagaagcttggggagaggtggcaaaagatgacaggtaacattctttgatctctatgctcgacaatgtccatgctggtcggtcaagtcctccgagacctccgtttgaaccatgtccgcttcgtgtaacttgcagccgaggagaagcagccatacgtcgagcagtctcaagttgacaagaagcgctacgcggaggagtcagccgcctaccgcggggcggctgccatggatgtggactccggccctgcttcggactgaagagaagagacctgaattgcattccagattacccttagtctaggagggcgacagacaggatacggctagtggcatctctatttccatgtaaataaaacttatgagttatctggatgtaaataaaactatcgtaggtatctttcgagtcccgttctatgagtgtcttatcgctttatcttagctatatatatagatagcagctatagtatagtagagttcttcccgccatttatgctggccggataacttaccttcacctatgtagcagcaataagcatgcttatctgcttagttaaattataaatgcgtgttctagctggagaatcacctctgttgtgttgagcttgtggagttgcctgtgcataacttgttcgggattaattcacatatacttgctaggtttaaaatcatgggtaaatacatttatgaaaacaagcgtatcagtagaaaatttgaagagttaacgagacttgtcct

SEQ ID NO: 74840 - DNA, 9615 bp, Oryza sativa
taagcaagcaaactaacacagcgaactacggcaacggtctaactagacaactactctcgccttgcgtcggaacgaagagatggatcttcctcctctggagtagctggctctctttcttttgggtcttcctcttcttcctcatcacttaagacatggatgacaggttcagcatgatcaggcacagcgtctcccaccacacgagtcttcgaagctaactggagacgaggtggtagactggttctcttccttgcggtgaggcgaagcttgggtgctggcggtggtgcttctcccttaagctcagctagttccttctgcagacggtacaccttgctctccaacttacaaatcctgccacggttccagttttccctatcatgagctgctttctctcgctccacgcctactgcatccatggcgctaagcatatacacggcgtgcatcacagtggcgctaccttcaccttcgggacagttgtaagttctatagtcttgaccatgtggcttgtgtgggtgatactggaaagctgatgactctaactcctcatcaaagcgatgacgtagctctccaatggccaccaaggctgtttcctgacaaacatggctgtacttttttccctcagcttcaaactttatcgacggaaggtcttcacgatcactagtcaacgtcacgcgaacacgacacttctcctcgttggggtcatggggaatctggcgatactcgggggcaacctcgtaacctacttcaaatgccatcattctcagctccctgacgaatcctagcacctcgatcaagtttttcggcggatgggcatctaaagcaacatggaaagaaggaattaatgcatatttttaagttagctgcacaaactagacttaattaaattggacccaaagaaaaagaaaataaaagaaaaggaacaaacatgactcaattttttttctttttggaacataaatcaaccttgaacagagacaaataactttacacaaatgaataaattaaaactaaaatatttaggatctaccaggagcacggtacagtgtcaccattaacagggatgagtagtactgatgccatcttgattgaatcgataccataatagatgtacagtgccgactaaccaatgaaattcagaaaattaaactatttaataccctgaacagtaaagttttttttctttcaaaataaaagaacaaatttctgttttggtaaagtagaatttaataaattttgtacataaccttgcatgtgctgccaacttaattaatttataagagaatagagaagggcagttctattttccaaaataattagaaggcaacttaaggtttaccatttggcttgtcctaaggtcaaggtggctctgataccaacttgtcacgtccggaatttctatccaaaattccaaacgcttacatgtgcgttaaaccctcgtctaggaatcagccgaggcacataataacaaattgataatagagtactatcaaataactaattaatatgcgcaaagtaaattattacagaggtggatagttcctctcaaagaataaagttctacgccgcggaaaaaaagcaaaagactaaacatctatggcgactccacttcacaagcaactcgacctgaacaaagcctaatcctcctgatcatcaccttcactgaagcactcctcctctaaagaatgaatattgcaagaatgagcatatgacatactcaacaagccacacagcaaatatgcaaatgcacaggataacaaaggatggcataattaagctcattcgcataaacaacatttaataaacatttgagagaatagcaaaacagttaagtaattaagcaatattaaataaacactatacaacacacccatgttgcataggcccaaccttatctgaacaaccaacccctggttgtacaaatcaaacctccaaaccaggaatataccattccaaaccaggagtcaatttagttatcatagtattttcatttatggtggtacgaaaaacattgttagacccacccataaccgcgggcacggctattcgaatagttttactctgatcagagatgtaccactgtacccacaagacacaactccacatgtcaccatgcgcctcagtaccaccacggtaccttggaaacgaactgtgacaatacctctcacacaacacaactcaccacagtgcaccgttcctggatcataatctccccctcataaccagaggcaatggactccccagcgacccccacggacttctcgccgcttcacagtctggcaccccataatgaatcatgctatacaaaaggtaaagccgttgcccacgctggcttgtggttggcacggtaaatgtttcacaacagtagctcgtgaaccggtccttaattgttgtaagcacgaccatcaaaaccatatactcacaacccacctttaatcaggtttatgtatcaattaattatcataacacaattaactatcgtgagctaccactaaatataaccataactaatatcgtaatatgattaaccccattaatgagctaatgtttctaagcatggctaagcaattatacctatatagcacttagctggagcaaaccaatatataaggtcaaagctattcaatttattacccataggaaaataaagtcattgtcggccattaattaactgggaaaggctcaccacccgacgacattcgaaaataatgcataagttgaaataaaatattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatacgagttacgatgatttagttatgaatttccgaagtttaatcgattttcaactaataaaaaggatttatgacgtcatcgatgacatcatcgccggccatggcacggctccacgcgaccaccggcgatagagagctcggttgggctatccgaggacacctacgtgaagaggacgacgacgcgaactcaccggtgcaagaaactatgacggacgacgacgtacggcgaccggcgacgaggaccaacggcggcgcggctcagctcgacgacggcggcggcgttccagcggcttgcgacgacggcgaaggggcggccaaggtactcctccaccgtgcgaacccggcggcggcgacggacagcgacggcgacgacgctagcagccgcgcgacgtcactggagagtcgccggcgacggcggcggcttgagctacgcagcggcggcgctacgagcaacggtgagacgcgggacttggggcaaacggaagaggacgactaggggatgctttatataggcttggattagagagatcggactccaaccgagaggaatcgagctgggaaaaactagggttagtttggagagataaactcaaaacgaattcgatttggtttattcgggcaaaattgacctccgaaactctaggggaaagggagaggataaggaggagatgatttccccttaagcaatcagactcggggacgaccggttgaggaggaatcggaggagaggcggcggcgctcgggctcggctcggcccggcccgaggtacgggatgaccccgacatgtgggccccacatgtcgacgactagaggagacgaggggcggctcggcttggattggcacggcgtgggctgcacggccacgtgcgagggagaaggatgttgggctggaaacggccaaacggcctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagttcaattttatgttgaaatttttcctagattataggagtttagcttgtaggtttttaaaataatttctaaaaatgcattaaaaactgaattattaaattaggcgattttcagggtgtgacattgatatagtttaaacatgtaggttacccaatctttaattttgggacccgacaaggtgtgtgggtgggggcccctgcgatttgggagcctagagcggctgtaccgctccccccccaagcttgccctgaatacatgggccttgaaaggccacatggcatcttatgacgatttctgggcttgatggcgacgaaaatggacgtcatagattagtaacaaaaagataagctttctttatagaatgccattagagatgcatgataggtaacgaatgatattcgtcacacgaatgtcacagagttcacaacatagtgaatcatctatatatgggcctatttgtcgtccaaatacctgcaaacaaccttggtgaatcatctctttgatcctaaattatattttcaaagagacaaagaaacagagagagggagttaaagtccaatttacacccaaacttcaccatacctctcatcttctcctaggaaacatcaacatggggccactagacagccactcatacttggttgagtgaagtacaagtgggatcacaggctcaaaccactgccaactcctttaaatcgtttctacccctcatgttgacaactagctctcactttccacctttactttcaccattcactactacaaccaagatttttgtgtgagggctaaaacgatttttgcgtgcgggtaggcggcctgcacgcacctaggggtctgggaacatgacgatttttgtgtgcgggtggcgcaacccacgggaacacaaaaatccgaaaaaacataattttttttaaaaaaacgaaaccctagaatccggcggtaggctttcgcccgccgcccgcctgccatagtgcagcctgcctcccgccggcctccgcgccacccgccgtcagatccgcactcccctccggccgcacagccgccgacgcccctcccctccgccagatctaggcacgaaaggaaggggaggggaggggagctggatctcgcgcggggacggccgccaccggatccgtgcgtggacggccgccaccgctggattcttgcgttgacggccgccactgctggatctgcgtagggacggccgccgcccgctaggtcccacgccctccaccgccgccacgtggaggaggccggcgcgcgcttactcccaccgccgccgcaccgctgctgtcaccgcgcgctgacggcgctgccgccgttggaaggagaggagaggaggggagagtggagagagaggagaggagatgcgtgagagagagaggactgaggagaagctctacgtggaaattttaaagtggaaaaagggatagaggggaggggagaggagagaaagaggaaaattttaaagttggtgagaggggaaagaggaattagtatttttgcatgcggctctctcaataggtccgcatgggaagatcggctcattttcgcatacagtccatttaagaggaccgcatggaaaaatagatttttccatgccgtcctcttaattgaaccgcacgcgaaaatgagccgattttcctagaagcaacgagttaccgcccgcacgaaatataaaagggtccctgtccaggaaaatcgtttctatattagtgattcgagaagttccttctctacctgatcgatccattttctttgtttccgttttggcatagattgaatacttggtggtgcactcgtcggcgttcccggtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccgttgagtcaccgtaagtgagcccgggtgtttagccacttcattaggcgctaaggactttaattagtagaaatttaaattttgtaaggttctttttttaaaattgctttgtatgccatgtgggcatatggttctaaacgcaattcacctaatacccagtgacctttttgtatatggtttagggtaagccctaaaccctactcagaaattactatttcatggatttattacttgatataatagcttgatgagtatatcgtactcacccttgctttaaccccctctttcagaatcaatttggagtttttgccgaagccaggagtttaatcatataaattggtttcattccaacttagttcccaagtatagattatatagatggtttaattctatagcaaaacattagagttggctcatcctatggcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttgggagcctagtgcggctgtaccgctcccccccccctaagctggccctgactacacgggccgtaaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttatgacgtaaatgagcgtcacctataataagatctattgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgacatgcatgcgaattttgtggatgagtcagaggctgcattcacggagctgatttaattaattaacttgttgccagctagtacctaattaattaagcatgtgtgaatttactattaactactttggtagtgttaatttatccttagttttttttattccaaactactagcatgcatgcctttgtcagagagagaaaccgatggaatatgccttgttacaaaagtattgtgcatgctgtgtggattcgtactgtctgcatgagtttttatattttccggggtagagaagataaaagaattcaacttgccaactaggttttttttagagtctggcacatcgtcgaccatgctgcttccctttatcggacctatatacgttaggatcaaatgtgctcaacgtggtctggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgtcggatttacatgaaaaatacgagactgacaaaaatgatatctttcggttctaaattaatactcccggccatttgagaggagcaatatgtacatatgcatgcatcacacctcagcgttttcgtcttttttttccttgcagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatacacgagcatacatgtgaagatggaaatatgtgaaaaatataatagtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaacggacaaaaatcgcaagatgagaggattgtggtaggtaatcttctccaactgtgcctctcaatcggccataacatattagccagaaggataaataaacatcaatctgccttcacagttttgatcatctcatgagacacatatatataaaccacccataagcaagagtctccaaggtgaattaattaactatgttgatacacatatacttaattggtataagagcattagtagcggtagttaattagtataaaagcatcaatcaaatggagactgttagctagctaggagaccgggcaagcaaagcaaagcattgatcttgatgaatcctccagagagattatttgcatattgtccagttccccctgacctattatacacatgcaagtgctctatgtacttgtgcggtgcaacgacgagcaagagtgcgtacatttatagtagaactgagggggtgcgccttatatacaccggacgagcatgagtgtgtacgtttgtagtgatgtctccaattttagtttctgtcgtagtgaaatattcgacgtttgacacctcgaaccatagaaaaactggagctgtgaaatgttttcttcttttttatgcgtggagcactgaaatattgacagttttgttttttctataaaaaaaagaagaagagttgacgacttgatgggcaggctctcctcgatggagggagatgagcttaaaaagtcgcaataaatggacccatgtagtggaaatgcggagtggagtggagcagtaataaaatttaaaacgccacgcgcagggcatctcgaccacgactggactctccttgagatcttcgaacagtgtgtgcttgctagctgaactgcagcagtggaacggtaataaaatttaaaacggatgtgcagtgttcacagaggatgagtgtgctatatatgtgttctctgcttgtgaatagatatggcgatctctgcatgtgaatagatatggcgagtactattactgggtatacatagttaggatagatgttagtttgttctgtttgtttggagatggatttgggagcaaatgtacatggttagggcgcaaatgttagtttgttttgctgtggaggggagtgggttttgatagaagtagacccatgaattttgctattccaaaattcctcaactagctatatgtctagctccacaaatctgtgatgcctatatctcactagtcttgctatgtgctatgtcatgtacccgtgggtaaatagctaatttatgatttttg

SEQ ID NO: 74841 - DNA, 2100 bp, Oryza sativa
gtgcgctctgctttcggtctctcccgtttcttgcttgattcccctccttcaagcttggtttggtggggatttgtgtttggtttcatggtggttaaggtaggagcggggatattcctgctccctgattttggtttcttgctgttcttgattagagcagcaaatgcttcaaatttttgggggtgccatggagctccttttcgttactgttcacttgttcagggacattgcacaaattaggagcattagattagatgcctatgattttggtcagtaatagctagttcttgcagctcctcgttttgttatggttgcaatgttactcgagccgtaggagcaggaagagaggaaaaacaaaaatacacgcaaaaatgtagcatctttgtttgcttttaatgttaattaagaacggaagcccttacgctacagcttccaattagtgcttatcaacgcaatgacaacgagaatctttcttatgttgcttctatttgttaagcaatgtcggtggaggtttcaccgaggggaagcaatacctcttggttaaatgctggttctgattgattattcattatactattgtttcaaataggattgtcaaatcccaatgggctaaatttgtgtcctgtgtttttttaccaggaacaccgagtgcgaaccagatatggctctgtatctgtttctgtatttggagatgaagacaagccggcgctcataacatacccggatgtagctctaaattgtgagttttctgatgacctttcaagtttgtaggtgaaagcttgctaatttttccatggcagggtagctgatgttgctatttttttttgtttggtagatatgtcttgctttcaaggattgttcttctgcccagaggccgcgtcgctgttgcttcacaatttttgtatttacacatcactcctcaagggcatgaaggcagtcatgaaggctttttcttacccaatattattgtagcattcactgtttgcccgtatttgctctgatacttacatgtgttattttgtcctacagttgggagcggcttcaatttcatccgatgtgcccgtgccatctgttgatgagcttgtggatcaagtcgcggatgttcttgatttcttcgggtactggattaccaccctggccaaattgcgccttattattcggtggtgcttgatccaacccttttatgcggggcttttggctttggttattccaattaagaattgggatgtggttgggtgtcactggccgggccttccttcttaccctttttggaagaagtattactcttaaccgttatttcaaagcttggcttggcttttctttttctttttcttaagaatggatggatacattggcacagaccaaataccgggatagagtgattggccttatgctagtttccgcgatatgcaaagccccttcttggagcgagtggttgtacaataaggtactaacatacatttaaatctgtcggtactgcagtattggtaatgtgttctgtgaattaacctcaaactcttatgtaccaggtattattaaacttgctttactattatgggagtcgtgggctagtcaaggaatgcttgcttcagcggtattttaacacggtatactttggtcttctggtagctgctttttatttgcatccttttatgtatatcagcttcgctcaacagttttctgatgctatgtgcaggaagttcgtgggaatggacaagaccctgaatcagagattgtgcaagcctgtagaagtgtaagtagttcatctcctcgtcagctttctgatatgattttgacaagattggtagctgtctacttatagaaagttagtctgaagcaataggtttccttttatgcagttacttcatgagcccagggatctaatgtatggcgattccttcaggcgataaacgagtaagtggacaaattatcttctgtgcattgcctgaacatgcaaagaaacaggatttgaacatactcaagtgaatttttccatccatcaggagacatgacctgacggaagcgttgaagaagcttcagtgtcggacactgatttttgtgggagagaactcacagttccacgacgacgcagtccatatgacc

SEQ ID NO: 74842 - DNA, 827 bp, Oryza sativa
aattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgc

SEQ ID NO: 74843 - DNA, 819 bp, Oryza sativa
  unsure (1)..(819): unsure at all n locations
gccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtggaaggggtataaataggcaaatgaagttatatatacctatgtgaaaaccactcatgatcatgtaattaagatgtcagagcgctgctcatagctgtatgcatatagaagggttcactgttaagagatgaccgacttttttagctttcaaaggattaaagaattggagctcgagcttgaccaacctatactaactactaagcttgatgattctttttgcccaatgattgattgctcactctctctctctttctccntgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactc

SEQ ID NO: 74844 - DNA, 72784 bp, Oryza sativa
  unsure (1)..(72784): unsure at all n locations
gatccaggaaagtgtgttgtctaaaagctccagactgatgaagaacttcaaaaaacttgaaacagcatactttctcacaagatccaagttggcaaagcaagttgggaatcctgtaagcagttgccatcaagtcgtgaaaaggactactgggtcacctgttgtgactgagggaagttcaatagatgattttgctttggaagggcattatggtacaaggcaaagaggttggatgaactcttttcttgagggattgtgtagttacttatcgttcagtaagttgaaagttaaggcagaactgaagcaatgtgatctgctgaactcatcaaacttagtatgctctgtaggcttcgaccgggataaagagttctttgcaactgctggtgtaaataagaagataaaagtgtttgaatataatatgattgtaaatgaacattgtgatattcactatcctgtggttgagatgtctaatagatcaaaattaagttgtatttgctggaacagctacatgaagagccatatagcatctagcgactttgaaggtattgtacaggtatgctcacttctaaggaacatttttcagatttgcatttgatgaaatggccattattaaatatcccccttttttcaggtttgggatgttactaggagccaagtttttgttgaaatgagggaacatgagaggcgtgtgtggtcggtggacttctcacttgcggacccaacaaaattggttagcgggagtgatgatggttcagtgaagctgtggaatatgaatcaggcaattttattcttgcacctggtgtatgtcagcttttgaactaccgataacatggttatcgagcttatgtctgcaatagtagactaacttgcctctgctatggtaacactttttcatgaactttgcaggctgggagtgttggcactatcagaacaagagcaaatgtatgctctgtgcagtttcaacctgattctgctcgttccattgcaattggatcagcagatcacaaaatttactgctatgatcttcgaaacatacgagctccttattgtacgttagttggccacacaaaaacagttagctatgttaagtatgtggatgcatcaactatagtgtccgcatctactgacaactccttgaagctctgggacttgtccatgagtcaggcaaggataattgacagtccgcttcggacatttacaggtcatacaaacactaaggttagaatatcctgcataccttttttgttacggtgcataaacctttctcggggtattgttctggatatggttcttttttatctaatataacaatcatcctgtgtaaatgtagcttttgcacaaccctaaattgttattcattttgtcagttttctgtgcacctagttaccacctttttccctcagcatgttgttgttatatatgttcagtctttgaattacatgtcataaagcttcagtgtaatccctaattagttcttgtgcacctgcacaaaatttgctctccaacttcggtagtattaaaaatttcaacatgccttataggtggtagtaccccaagcaaaatgtgtttaccaaggtactaggtggtagttgagggagcagcagggcatcctctagtgcctaatcattgataagtggccaaatggttaggcgggcgggttcaccgagcacctaaacactgtctgggctggctagaaagatatgattaaggccacttgcctgcttttttgagaatgacacttgattttcgagattaagattctagtatagccctttcttcatattcctttagttgctttcaggcaaaagaatactttgttttatgcttaatttagttatttcttgaacctgttgaacagaattttgttggactttctatatctgatggttacattgctactggctcagagacaaatgaggtatgttttctaagtttccaccaaattctctgccgactatttgaaggttaatttcaatgtcatacagcgacaccagcttttgtgcaaagctaatcattggagttgccctaatgcagtaaactttgttgcaagcatgctgctgtttattattgatagatagtttggccatttctttgcatgcctttgtgcttaaatttcaatccatgcatctctcagaaaccaatattgagatgaaagaaatcaggtattaagatgagagcgtcatggaaaatgatttttttttttgttttgtaacctgcattttctatgtaacagttgaattaatgtttgccgaattcatgtgaaggaatattttggctcacttaccttagtgcgcaaggtattttgtgccgtaagatgaaatttggtattgaaaacataggcatagaaattattttttataccatacgtgcctgtatattcttgcttggggtttaatattaattcaaatatctaactttcctttccatctcgttttacttcaggtttttgtctaccacaaagcatttccaatgccagtcttggcatataaattcagtgtcacagacccaatatcaggccaggagattgacgatccatcacagttcatttcatgcgtgtgttggagagggcagtcctcaacgcttctttctgctaattccagcgggaacattaaaatcttagaaatggactgaccgtgcacaaatgggcagcttgtgcgcgtccagtttccaatagaaatgaactgacttgacacccaagggaatgcgcgtgcccggggctagcatagtgcattggaagtttgccttcaaatgcagagaggtctatagggcgcgatgtaactttattagagttggagttaggaggttgataggacagagtggtagctgtaccagagttagcataggattagatagaaaacgtagcataaatagggaaagtatttgtgacgcaggggatccaagaggggttttgtacatcattggtttgaggtatacttatataggcaatcaatccaagcttcagtcattgctattcttgttttgaaatatgaacttttagtgccctttcaattgatcgtttcccttatttctttttaagaaccacattggttattttcgtacacatttaatgttccctgcatatattgaaacatttgatacgatgaaatttttgaaagtttgaaaggaactaaacacaacacactaggtctggggctacgtccaacacttttttatcatcattatttgctggatgcggaaatgcacgtccacgtcgatccaccgggcacacgccacacacaaactgtgaccaagttgtagaattcgaagtgcacagccacaccacccccagccccaaagtcccaaacacgttaccgctaatcagaaagtcagcatttcttggggtctcgcgggccgaagacgaagttgccggcggagtagcgcccttgcagcccgtcggggagcgccacgaacctgcggaacttgagcggcgaacccgtcttccgcccaggctggagcgccacgccgcacgccgcacgcgacggcgaccgcggcacgtacaccctgcagtccttgctcgtgaacgccgccacctgcgtccccgtctggatcaggaagtagccgcgcgcgtcgtcgcgccccacaccgacagcgcccacttcccccgcctgcaccgcagcagcgccgccgcatctgcgcacgcacgcagcaaaaagcacacgttatttttcagcggccaaaacgaggccatcgagcgcaggtgggtggtggtggtggtggtggtacgagtactatacttgggaggggcgaggcgtccttggacttgacgtagccggcgtagcggcaggtcttgcaccagacagcgccctcgacgccgatggtgaagttcacgttgggtggcggccgggggagccccatggcagagcctcctccaagctgggtgaggatcacgagcaggacggagaggcagtacagctgaagggatcccgcgaacctagccattgttgtttgtcaaatgatgaagctctatacttatattaaattagtacgtcgcaatgataatggaaaggatgagcaaagatggcgcaatttataggctttgtaggtgggccgatcagctagctaggctagataccgttttgtacggatgatgatgatgatgatgatgatgcgtgtatcgcttatatgggggaaacggagctcatcacgtgcatgtacgtggccttttcggtgttgcaagctacctgcgcgcatccggattccgggtagcgccgcttgcactcgttaaaatggataatgttgatcgaattacttgttttgataggcacagagtacatccacttgttcaaaatgttagcataatctagaggccggcccaggttaatcatgttgtggactggttagtacgacctggtcgatcgattggccgatgcatcaagtggtgtggaacatgatgcattaaccattttcgacaaattaattaccaggcaaatttgcagcctgcaaattaaccatgcatgaacagaccaaacaaaagagttttttttttcttttgacaaaatgagaacagtttgagccccatacaagtaacagattatcgtaacattaagtgttgagtgaacgttcgttcgaaaaaataaaatgttgagtgaaccactgcaattaagcaagctaggagaagccatgcatgctatctatgtcaatgcaataaatctagactagcttctttaaaaaaaatctgggtgctccaaagaggttttctaattaagtcatttcttgaactccgcacggatttgtttgttcagaattcaagctgatgcttaaacatcagagaaccacctagagcacaaaatcggcaggcacggcatctagcaacgcagctacggttcatcatgcacgcatgatgaattcgcttccgcttttgctccagctagcataaaaggggcgcggatactttaatttgcatgcaaagggatgtctttcttcttcttgatttgtttgatggatggcgtcctcacggtacatctatcatcgatcgccgccccacgacacacgcacgcacgcaacgcaggtcaaaacccaaacaatttcagccgcgcgcgacatcgtatacacggaaacttcgtcatgtgtgcgcgcgtatccctgccggccaacagtttgtcatggatggaaaggattaaccaacaaaacaccggcatgttccattcctgaagattcacgttgcataaccgttctgccaaagttcgaaactgctttcttggttttcttgggctgtgatgggcgtttgcttgggccggtaatgacaagaccaaagcaaaccgtccgtccagtggcccagttcccacgcctcctgcccttgtccatggcccatcaaagccatggacaaggacatcagcaagttagcaactacttggccctaagtgctctgttatcacttatcagtgaaactcttttgtttaatggtgagagaatactaagacgatttaattattactccctccgtttcagattataagactttttagcatttatttatatttatatagatattaataaatctagacacggtactgttcatgggagggtggtagtacttattaactattcacgctactctcagtactctgtatctcaacatccaagggcggctctgactcttgtattctgaagagtgattagtggctatagtaaacaggccaaaatgcagacggagcataaaggtgctggaaaattccgaatatacttactagtcagtcgtcacaaaatgcatgcttaagtagagtattcgacctcatttggtatgtgttggaatttaattcaattaattaattgaatcttagcctaaacatgatcaccttctgctcatgtggaaattaattgatatagctgacctgagatgaagccattgcttttctttttttcttcttctgttacgaatcccttccagtgtctaatcgatcgggcgattgatttagggtttagggttggagagagttgagtcgtcacgcagcctccatccttctctttctttatatagcgacactggtggggctcgggggtttatctcaatctaaaattcgaatctattttgtaccgatcacacaaaacagatttatctcttagtttgtttcttgttaggatagaaaaaccggtgggattttaaccttatcctaactaaccggcattagccgataaaatcaaccaacattctccccttgattttgagactaactgacgagtttatcacataaactagctccccaaggcaatgtgtcttcaacaacattatgcgtcaccgagacaacaagacctatagtttactatagtacccaaataaactcaagcttaacttagtgggtgttgattgaaaaattaagtccccctcatccaggatcttagtgaggctattatttatgcatgtactggctagaacatatcttaattaatcttaactttatgagcctttagagtatggatccatgagcaaaagcttagtttagtaataattcgatcctgggacatatctttcacaactatatcaatgtgttaggcagaaaacacataacatgttgctactacaatagaaaactgtgtgtaatcagtgcacaacttataacacagtatattttgggtggtttacaccttttgagtggtttatgagcgctatttaccacttttagttctgggaaatattcttatgattaattataacatgctttaaaatctaaactgcatcgtcgattatgcagtaagagattatttttggagcttttccatggttattgctcccctatgtgtggacatagcttaatcttagttaacttaataatctttatatatatccacacatctcacaaaataagtgtccaaatgtctctaaacttctgagatcattggactttagaaatatgagcatgttacttaagattgctttgtaaataatacaaaacattcttaataccagtggtctagtctggatttaattaatactgtcaagattcccagtaaaatgtatgccaaatctgtatgcatccagatttgagctaatctcaagcttctatcagctgaatcataaatgattatctttataacttaacttcagcttgactaatctttaactgaattctctgaaattatttctttatgtcaatatatgacttactgatataagcccagtactccttcagaccaaaataattcatggaaaaatttcctttaatttctaacagcaatatgtattgcttgacaataaaatgtcattagtatggagtaccggtgtgaaatttccacctttaatttccatacagctatccacctcacttgaattattcgaaattttcatcagtcgggcttaatttcattaacccacttaaatggcccactattttgactcatttagaaacttctactaaattctttattttattcatcaatctcaattatccttacatggttcgaaaaccatttagatgaacactttaatgtcttattttgttcatccatatcaatttattcttacatggttcgaaaaccatttggataaatgcttatttttaatgtcttataaggtgaacaagctttatttagtgtttaccaccataatccgatctcataacttcatttgattttagcattagtgtcttaaatttcttaaaggaaatcggaggtcgcttatgggtaaacatagccataaaaaatcatttgttggctaatctcttaacttcgtgaaattttcacttaaagctaaacaacaccattaaaatctaagggaaataatatctctatctcatgagacgttccaaactcccctaggtatgtgacataagcgacaatgacacaatttcaatgacgtcttacttccatcattatagaataattattctcctcattcttatttaagcttagttcactaatgacgcagcggaatttaaaacatcatcaatgtttgattaagtccacaaatggatttcttaagtctgtaccctatatatgacttgtatttccataacaaaaccctcaagttatgttatgtatatttaattgtgtaagtcacaaattaagagatacaaatttctagcatccacataatggagctatgagtcataaatgaggtagaataatcttctcttattagagctcttgatgagctcccactgattgtattatttatttaatggaagcataatatcttatttttcataaacttaaatcacttaattttacttagtgaattatcatctaagtaataatagatgtcagaaatttctaagggtgaagtgtctcgaccttaatgagacgtccattctcccctagaaatgtggccgaataataaggccatagtttcgacaacgtctcataatgattcaacccaaaataatgcccttaatcttcttatttaactactttattgaatcaggacattaagcatgtccctatttcttgcaaagaacttacacaagaaaatttcaagagtagcatacatacgacatagaggcaactttatttccccttgcgaggaaagtgagctttattattattaaatttggagttgctacaaccccatagtatagcttcatcttttccatcaaatgacaagattaaaaggatcttacttagtttgcctcttagtcttctatatttcttattgatttgcggaatgatgaaccaagtcaattatggtccacttggtcttagtattacaactctgaaaatgaccgtagtctaatgggagaagaatcatatgaaatggacaagtggcgcatataaaatgtgcgatatccatctcacaaagtttgcacgccatgtgatttatttcttgtgctaccttttaaattatggcggcaaatgtgcataggcactaaaattgtactaagcatttgttttgacaaacttctaaagttcatctcaacgtttgctagatacagtttcacaatgtcatgctcaaaattctcccctaacactaacagggatgataatctcaatatttgtgagtgacatgcgaaacatagcattatattggccttctcccaggctaaagatgcctcttgagtttaggaaacattagtgacattagctgcgggagccacaagggatcctttgttaatgctaagtcatactcaaataggccttaggctccgttaagtcaatgaggaaaaataataataatttcatagactttaactgataataaaattaagtggcactattattgtggttgcttgtgcaaattacgtacaatagtacattaacttacacaataataacttaatctttatttcgctttgtatcaccgttgggcagagacaaaatgaaggaattacttataatccaaaatcaagtcaccgttgggcagaaatgattagggaataaacattaatgtcacatcaccaaaaggtagaagtgataaagtaaataatttaaaatcccaaatcaaatcaccatacggtagaaatgattaggaaatgacgccattagtgatgctatagaattaaaattaaaatccttagccatatcaccgttgggcagaaatggtaaaggaattaagattactgatagattatatcctcgatcacatcaccgtaaggtagaagtgataaaaggaattaatgcactaatggcataaataaaattctaagtcatatcaccattaaggccaaaatgacagagaaaattaaaataatgattgacaatacttagatttcttcccttaattacatcaccgttgggcataaaataattaaggaaataacaatcttaatgaaatcatctttctttgtagataaacttcccgttggttccatttatctagaaataatttactcattatttcaactgatcttaaataataagaattgttgattgcatataattagtttaccatagcttaatcaatcgtatgcaaaataaacttagaatttcatagtcaaagcaccattggtcataaataattatgaataatcttaaaattaattccttaattatatcaccatttggtagaaaataaataaggaataaaaattataattgtcatgcaattataataacgtgggttaaatataacttcagatcttaatactttctagtcgaatttctcgttggttccattcgactataaataattaagttactaaggcaatgaccatcataatgatgttgacatgaaatcataaatattttctagttaaatttccatttaactagggataaattaaatggcttaaggaaataataaccttaataaatattgacatgaaatcatattaacgttggtcaaatataatatcatatcattaatttctttatgagtgaccaaataattgatcataatttccagaaattttaaatggctaagaaagcacataaatgaatttctgaaaataaataagacattaaattcgcgggcttaagattaaaattaataagagcccactcttattggtgaggccggcccaaaacggaccggctcacttatgcgcgcgcggcgctgaggtggccgcagcccagatcggctcggcccattaacggcgatggcccgacgcgggagcgaggacggccgtccgatcaaacagacggccaagatttcgcccgcgccgaagaaatcgcgtgccacggggaatgggtgtaaaccctaaccctagctcattcttgtccccttctcttcctgattcggcgtccggcgagcgagcgagcgaatcggcagcgatgttgtgacggcggtccggcgaggcagcgcgcgcgtgcggcagcgagcgccgtagcggctccacctcggctggctggggggcgcacccaagggcggcgccaagccgtgtgctacggcgtcggcggtccggcgaggcggcgcactagcgacggcaagcgtctatgcggccggacctcgtcagcgggggtgcggagcccgaaggcagccgccaagccgacgcttcccgtccccggtgagggacggtggagagacaagctccaaggcggcgcgcgcacggcggtcaaccggcgcggccccgaggagaccggagagctccggcaagcttagggggtctaaatccggtaattaacccgaactcaaacctaattttgacttgaatttggatttaattctggtatttgtgacttagggttcttccccccaaaaattagggttcctcatttggggattttaggccgattggatccggcttattggggattccgggaaatttcaatcttgtttattcccttttgcttaacagtggggaatttcaatctagtttatcccctgttttccccaatttacttcttaatccactgttcttatatgataagaacctagggtttatgagttgggaacaatgagagtttcaatctggtttatctcattcgttctccgcttagtaaaattcgagagaaaaaaaaatctctctctgattgaatttctccttcccttactgatttctagccgaagctatgatttacttaagcatgaaccctaattcgatctaattaacttaaatatgacataatgctcaacacaaagcaactttaagaactaataaacagaataaggggcttaacagattaatcatggcatcatgccgggcttaacagattagggttcatcacttcattggcacagtgccttcaatcagggatgatgggatcaagtggctaagattagtatctgataccacaatgttggaatttaatccaattaattaattgaatcttagcctaaacatgatcaccttctgctcatgcagaaattaattgatctaactgacctgagatgaagccattgcttttcttttttcttcttctgttgtgagatacctcacgaaccccttccagtgtctaatcgatcgggcgattgatttagagtttagggttggagagaattgagtcgtcacgcagcctccatccttctctttctttatatagcgacactggtggggctcggggtttatctcaatctaaaattcgaatctattttttaccgatcacacaaaacagatttatctcttagtttgtttcttgttaggttagaaaaatcggtcgaattttaaccttatcctaactaaccggcattagccgataaaatcaaccaacaggatgcaagactattttccaattcttgcaagaactgaattggtcaatgtgaacatactataatgctctctttgctgtgaattactcgttctttttgcttttttttttgcacagcacccaatatttagcgtcaaagccggacgtaaaactggacatctatactgcagcgttccaaagtgtactctgttttggttttgttactgaacctggcgttgccacctctctctgttctaaataaacagtgacgaaataattacattcacataggatattactgatacattccggaaggtgtatagtagtagtactatctgcaactgtgattaagatcaagtggtcagaggctgcattatatagtccatttggcagagtaaccatttccctccaggctctagcaatgtgtgcaatcagaggcttacagatccatggacgacgacttgtaagattcctactttccagagttccagtggccagtgtttggaactttggatcgagtgaaccagatggcctagatttcaacgtcttaaaaaatttgcaaaatttgcaagcggacaaatcatacaagtttgaacagagaaccaatggagaaaccaccaatgctacactgacaacaagcgatcgaaacatcacagccgcgctacctctcaaactagaactgaacgtacacacacagtctcgctacctagtcgctactgcaagtggaacaccatgacacacgttgacaatacgtatgtctagttgcctactttaattattccttccttgatcgatcgatcgatcccgcgcagtcacgcacctcggcgcgcgtgccgcatgcccggtcgccggcgtaacggccggccatgagctgccggagtagctagagccagctggttagccggaggggcactggccggcgttggcggggccgtagaagaggacgctggtggggcagtagatggcctgcaggccgacgggcgggacggtcctggtctccttgaggagcgagaggccgatccacttgtttggcgggtagacgggcttgtcgcacagcgacgtcggcgacgagcccaggaacaccttgcaggtgcgcgggttgaagttgcgcaggtcgtagaacatcaccaggaagtagccgttcgcgtccgtcaccgtccccgtcacgttcaccaccttcttcccgtagcacaccagctgcgccgtcgcgcctgcaccgcaccacgacacggtcagaaaaaaagaaaagaaatgtgtagcaatgggggacagagggagaagaggatcctggatgcgcacctgggagaggtgacgcgtccatgtcgctgctgtagcccctcgacttgcacgttttgcagtagaccacgccctccacgatgatgaacggcagcggcggcggggccaccggctctacggccgtgtcgttggaggacgacggggccggcgccatggccgtgtcggtgtagggcgacggtgccggcgccgtggccgtagcagcggacggcgaagatgacggcgccctggccgtgttgtctctgctcgagacgacgtcctcggccatcgcatggtgcgctgggagcagcaatgcagcggcaagcacgagcagtgccgagcagactacggctgtgtggctcctcatctttgctgaactccttgactttcttttgcttggcgctaattttagttaagttgcagtgtgtgatcagcgttgctccggcaccggctaatttatagggcgatctgggtctcgacttggccttttactaatttgcagtttgaccaaacaaacagcccggctaaatcagattccgttcacagttaatgcgtttcccgtctacgagagtagcctggggagcccggtgatgtattacaggggacgagtgcattgggaaagttacagtcctgccttcttggcagctgtacaacaacatactaggaccgtaaaaaagtttccgttcaattggaggcctcagcgtgtgatccaaagttccaaatgaaacgcccaaagagctccaaattgcatcaggtaatataaacgttcttctctgttcacttcatcacttcccttcctagatttgggaagcgtgtcaagatgagttttctgaacaagtgtcgcgttctcggtgaagcgagatcgacccgttcgtgaggatgcgcgcggttacgtggttttgagcggggggcgcgacctggtttgacttcacgggtaatgatgactgcgccttacaccggcggcagcctcgcgtcccggccgattgtttagtcgcgggcgataaatgcaccattagtccaggtaatatgaaatcctgcctgtatggggagctggggttaatctgccgcaacttgctgcatcagattccggtttactgcgtcaggtgatatgtgctattgctaccgatcggatctgcggcggacgagaggcctcaccatcgatcgcggcgctgaccgtttcacggcgcgtactgagatgccctctgcttgtcacttgtcagtctgagtctgacgccggagaactgagcgatagaaggtcttccgcggcagagagccagagatgttccagctgcgtgcagccactctgtatgcagcgtgggaaaatacatttgacaactctcaaactctgcagcttcgcgttttgcctccaccgacaaaggagcgcaacgggattttgcatccagtgcggtgcaggtgcagccgtgcaggtagcgatcatgcgttgcctgccttgtccacatgtagcgcacaccaggaaaggagaccaaattacagaccgaccgtgattaccactcgaccgggagattacggactgataatgcacttcactcttatctcccttccactttcgtactaaacttttccccctcacgtggttaaagaaaaaaagtataattgacaatgcatataacaatatcagagtgcattaacgtctgatggtgcatataaataaatgtacgtttgtacgcacgctatgaaaatgcatgccaataataaaatctaggggttatctattccttggtacaaattcattctttttagagactttttacgatcagattacaccatgagtcatgatcatacaataacattttatcctcttcttccctgtgacacccgctcgcactgtcacactctaacccgatcaccgacttatgctagcggcaccaccaagacctgctcaaactggccttcgccatgcccattttctccccgtcccctgtcacgagtgctcatattccctccggtttgataatactagtcgttttggacaagaacacggttttcaaaaaacaactttgactactatttttcattataatacgtataaaactgttaacaaatatatgattttattaaagtactttttgagactaatctatacatgtagtcaccatatttgaaagataaatattttaaaaatgatcaacccgaagggagtacttgtctaaatggcaacaagatgctcttgctctcatagttatttgcgtacgtcttcaccaatgacgccatcattatccccgcctcctaacccctcacagtaatgcatctctaccagtgacgccgcttactggctttctccaaccccatagctttagtggtgccgcaaccgcctttccagttgccacccttccatgtttgctgccccaccgttggtttgtcatctctcagtcatccatctaagctcaaaccctcggtactagtgttcaaccctagtgtctaatgctcacagcgaaatcctaactattagccctagggcccaaacactagtattgtttggtctcaacttgttgcattgaacaagttgaaaacaaccgccaatcagaaatagcccaaaataaccccaaaacatcaacttggtatgcaacctcagcctatctggaatcaggagagtactggttttcggcccgtcaaagatttaaagtttttcagaggaataagttcatcggaggtccctcaacttaacagtgagattttgagccgtgcactcaaggtcctattgtagtatatatgggtggtttcgctgacatggcatcctagtcagaattttttttaaaaaagtatgtggggcccacatgtcagctacaaattttttttcttctcttttctctcttttctattctcttcttcagtgagagagccgtcgctcgcccgccgtggcgtccttgctatcgccgccgccgccgtagtcaaagtggtggctcaggtagagcgtcactggagagacggagacgatggtgcgagcaaggcggtggtcgggccgcgtcttccgctccgcgtggtgctggcgttaatggtgagcaccggcaaatccgggccgtcggcaccgacagtgctcctgacctccacgatccgtcccccatctccctctgcccagggatctcgagcgcggcggcgtacgacgcctgccccctcagccgccaccgctcccgagggcagggaagccacctccacctccagattgcccgatgcgaagggcgggcggtgcctgccccttcagccgccgccgctcccgagagcggaggagccgcctccacctctgaggcacctccgtacgcctcagccacctccgccccgtcgccacggtgaagggaggtaaagggagcagcgcccgcgagccgtcggtcggtatccacggtgggtctgcatcgtggcgcgcttgtcaccgccgtcgctgccgcacggtgagtcccacctccatgatgcgcatcctcccagccagggacacggacccgaatgcgacgagccataccgcggccgccgtcaacgctttagatggctgcagaagttgggctgcggcgccgtggaaggagcatcctcgtggtagtcggacgagctgtcggaggaagccgatagggacggcgacgtggaggacgcaggcgccggtgtgatcctcttctcacccccaccaccggctatggccgcggcaatgttgttgttgttgttgtgatccccctcgtcggacggagcataggcagcggctccgggcacgggaggagcagaggggcggggtagtgtggcgggcgagcaccggctccctcacttaagaagagaagaaagaaaagagaagagaaggagaagaaaagagaagaaaaaaagaagaccagggtgtcacgtcaacgaaaccacccatatatactgtcatagaaccttaagtgtatggtttgtgtgagtttagggatacacatttattttttggttaagggacctaaaaaagctcgctgttaaattgagggacctctggtgaacttattcctttttcagaggaagccactgaggcctagatttggctattgaagatgggcttggcccagttaaggcttggtgcaaggatacgaaatcttgtccatcaacggttgatcagacggtcatcgattcagcggcctagggttttcgccccgccgtttgtaggattgcggctcttaaaagcccgggggcgactagtgaatccggaagggcattgcgcagcctccccattctctcccgtcgttgtggcgttttttttgtttcctccttttgctttgggatggctctattgcttagcgtgattttacctctcttgccgttttttcagattgatttgcaacgatttggagcaatgatgagatttgagtatgatctctgtgatgtgatttataatctctatatcgctacgttcttgctgagctcctcgttgctgttatcgttttgtttgtcgttgcttctttgagtctgtggagacgagcaattttctgctgagatctctcactgattttccttcggtctggattttttttgttctttttccttttctttttgtctaaagtgaaaacaagattgacgaaggtaatattcagtagtttccgatgtgatgctaatattcgcctaatacatgacgccgtgcagagagttcccatgagatcaggaaacaaaagatgagctcttgccgcaaacacttctagatattgcttaaccccggaaaagttcagcataatctttcataatagaacactggctctaagcagcaataaaggaaatctgaacgtcaagcgtccatctgtttctagttgaaccctgcataataccgaggtttgtaaggtacaaatacaatcggatcacccaattcatacataaggtacatgattcagtcgtatgactaacccagtttaaggtccaagccattgcttagtgaggtggatccacattccacatccttcagagtctgtgcatgagcaatctgtgcaggaaaattacagagcaacatctaaaatactgaagcatttcaaaatctcagaaagaaacaaaaaggagggtttgagaaatcaaacaaaaagttttggtcactttctctacccacgtaacccaatagtaagctactagcggccactgtaggtaggcttcatgagctaccctgcatagtttcatgtaggttgatgcagttgctttcacgaactgaaagctattccacttccatggtaaaggggttccatgaaagggtctatatgttctaggttagtatactttgtgtctctttatgccttgtaatggagcattgctcttgtctagcatcggtctactgtgcctgtgtatgtagtaccatgagtagggcatgcacgcttcctctgaatggtgcttctatagtcctatacttgcgtctatctttatactgtatcctatagtctgaaaaaaagaaccaaatatccaggcacagcaacaaaaggggaataaatttaaaacaaatctaccatggtttttcgatctattttctgtcttatttttatttttggagggaaagctatgtatcttgatccgtcaactaaaataaaccaatgatttctcagctaaccattcttataggctagtatttgcttatttatctctaatttagagatgaattaagatctgaaggcaaaactacaggaccaagaacaccaaagaacttagctacctgtttggatcaatgtctttctttgcacttgtgggttcaatacttatatgaaattgctgccaagtgctatgtttctcacgagtgtttgcctatcatctgtcaacatttgcctatgaagaacatttacacaagatttctttttgaccatttgaaagggaaaattgatgatgacgatgataatgaactgactaacaaacgaagatagtacaacttgataaatagccagaatgattatattctttaccttgtcgcacagcccgtaccgctcctcttgtcgccccctaatctgcacgcagataatcgaaaaacacatgtatattactagtgatgtttggtctcggttcacaacgcaatctgtaaatctgtacaagtgtcctgacggcacaggtatgaatcgtatcagaagtgggccgtgtttacgaaagacgtacaatgttctggaggtagcagatctcgcctccgatcttgcggtccttctcggagcgcaccttgcgcatggcggcctccagattgtgctccagcgcctccagcgacggcaccgtgtactcctcgccgtcgtccaccgtcatgaacctgccaaaaacacaaaagcacacacgatatcatgacgagtgacatcgatcagctcgcatcgagttgcttacctcagctgtttctccaggaggtcgcacatgctgcccaccttctccagctcggcgcgcctctcctacatgcatgcgcggtgccaaggaagagaaaaaaaaaacggcgcacgtttatttactggtgagaaaacgctcaaacaactgattactacgcgcgttgcgttgtactacgtgctacgtacctgcctgatatctgcccaaaccttggtgtgcgtggtggcctcgtacctctcgacaaactccctcacgctgcgccaagaaagaagcagcaacgaaacgtggattaaccaacaatgtcaggagacagcgcgcgcgcatatacatacgtgacggatcgacaagcggatgtgtggcagggcagcttacgaggggacggtgggggagaggaagtggtagagcttgccggaggcggagaagaggaggaggaggaggtcggcgtcgcagaggacggcgagctccctggccttcttgaacaggccgtccctgcgcttgtagaaggtggactgccgctgcgtggggttctctatcctctttatctcgctgcgccccctccccattctggccgatcgaatcctccctctcctccccgcgactccggccgccttcccgaactcgcaaccgcggcgcggagcaggcgctgcccgttaccgaggcgttgcgagaataaggaaaggttcgccgctgtagtgtatgtatgggagagattttgcccaggggatgcacggttatttttactgttttaaagaggcagatggaggaagaggagaggagggggtgcgggaaatgaacaagatggtctagtcctgttacatgtcaggcgccgcgtgcgtggcttttgcttcgctgcaggggtggtagggagcatggctgagagcctgagacggtaatatgtacgtgacatttgccaaagcgacggagacgcgtcgagggcacaggcacagtgggttgcagggggggagtctgttgctcccgcttacgttgtactactactgtactcctgcggggcagcacgtcgcgactatagctcgagagtacttctactgcattttgttggtttcgaaactatctatcggctcaaagcccctcaagcgcgctgaagagccatcccagtatggccttgtttaggcaccgtttagttttcaaaaacttttcacaaaaacatcacatcgaatttttggatacatgtatgaagcattaaaaatagataaaaaaaaactaaatgcacggtttgcatgtaaatcgtgagacgaatcttttgagcataattagtccatgattagccataagtgctacagtaacccatatgtgctaatgacagcttaattaggctcaaaagattcgtctcgcggtttccaggcgagttatgaaattactttttttattcgtgtccgaaaacccctttcaacatccgatcaaacgtctgatgtgacatccaaaagttttaattgaggaaaattttaagtttgtttgtcacatcaaacatacggacacacatttaaaatattaaatttagtctaataataaaataaattacggatttcgccagattacggatttcgccagaaaactgcgagatgaatttattaagcctaattaatccatcattaacaaatatttactgtagtaccacattttcaaatcatggcgcaagtaagcgtaaaaaattcatcttgcaattttacacgcaatctatgtaattggtttttttttctaaatttaatactatatgcatgtgtccaaacattcgatgtgacaacgtgaaaatttttattttggtaactaaacagagctatgccactgtacgtgtagaccgttacattttcacatagaacataaatacgtttttcagttcctaagcacactcagtattaagtatagtcgtatactatttgctatactccgtttcggtaggtctgagggggtgaataattgagcacacctgggtgcaaaattgataagagcatcctcaacagctcatctaaattccatcttctatactcttatttagatagtcatccaaaaagattcctactctatattacttttcactccaacagatcatccatattacatactatattttactaatttttacaactaccacatatgtatcaccactctaacaaaatttcccacctttatctcttcactccccacctttctctcttctccaccgctgatctccccgcctttctctcttctctaccgccggcgccgagaggacggggaggacgagggccgaccggaggggcggccggcgggtccatctccctcctcctcccgccgatggcccgtcgccaccaccacccagtctctgtgaaggggcggcgcgagcggcggaggggtggcggccggcggggcagaggggcggcagggtcagaggagtggtgcgggcagcggaggggcaacagaggagcggtggggcagaggggcagtggggtcagaagagcggcagcgccggcggagaccctgagcgacggggacggcggcgacctcactaccagatctgctgcctctccacctctactctggtgatctccacctccaaatccggtatgcacctcctctctcctacggtatgcagtccatatggtggcgcgaggtcggcagttgaggatggcgtgaggggagagaacctccatatttagcttgggaaggacgcggtttggaggtcctctaaaaatggcgtgtgtgatggaaggtctgctggagcgttgtttttcacctccatgcgccaaaaaggggatggaggaccggatagaggagctgctggggatgctctaaaggacagatatccgcgcgcactgcccccacgcggctcagccgcatgacacgcgtggaaaggggacggcggaagggcgcggggaaagagggcacgtggcggtttttcctcttttttctccttttttttagtatttttcgtttttacacattaaaaggtatagacacacacgtataaaaaaacatatttttgtctactgttagtattataataccaatattattaagtgtaaattagtaatttactaatacaatgattagaagttaatttgttatttatgtttttttctaactaaatcgatctacgatcatccattacattgggatctctcaatattcatcgaaaaagcaaaaaaaaaagagaaaagaagatttagttactgttaaatgatgattatactctctgcacctattttgacagtaatatccctccacatttctattaccgttaatagtgtgataatataaactagctgggtgacccgcgcaattgcgcggctagtagccaaacaaaatcatataattttcagtatgattttacttaagatttattaaatagctatcctcgtatttctaattatataatttttaaaagtcacaccagctgctaccccttacttctctcatatccttctttatttatttgctcggtctatcactatttctattcattctcctttaaacctctaaaaattggatcttatatatagttttttgagtttattatctcgttgagtttcgtttttataatttctagaagtcccgtcaaacgctgccattatactcctttacatcctgtctactctcttttctctttattgtcattgggattttataaattgaacataattattgttcgggtaccatcagcggctttaccattgtaatcctttatggctcgtccgttgcctcccttctttattatcattgagattttaaagtcgatcatgattatcattgtcttttttactttttagaagttccgaacctttaaaaattggaccttgtagtttttagagtttattgtattgttgggtttcatttttttataatttttagaagacccatcaaacaatgccactatacacctctacggcccatccaccacctatttttcattgggattctaaaaatcgaacataactatcgttgtaatttattttgtattttatacaagtcccgtcaaccgtcggtgcctctgcaactgtactcctatacaccccacacgctgcttcttctttttattctcattgagattttaaaaatcaaatatgattatcaatgggttttttttttactttctaggagtcccggcaaccgtcttgctatttggtgttttaatcatcattaggattctatttggtgttttactaacagtttttatatgtcgtatcaattgctaccactctaatcttttataggcctgttacttaatttatctcgtcacgtgttttagatggtctttttttaatagtctttattttttatcatcattttttttatttataaattatattcctaattgaaatcttttttcctttttctaatttcagaatttatttttttttcaaattttaattaataccgtatagtgttcttttaatattttgtttttttttattttttgaattttagttgtttcaaaattatattcctactttaacttttcttttctttttgctaatttcggtttttttatttttattccgaacattaactaatcttgtattgggttcttatatggactcttctctcaatattccttatttttaattccgaatttcagctatttgtaaattgtattcctacttgaactcttcttttattttctaatttcagattttattttatttttattttgaatttgtattaatctcgtattgggttcttatatggaaacttctttcaatatagcttatttttaattccgaattttagctatttttagattgtatttctacttggactcaccttttctttttttttctttttctccgattaatgtgggaatttctagcccccacagcgaacgtggtgcctcctttcaaagctgttttaatactataactagctgggtggcccgcgcaattgcgcggctagcacccaaacaaaatcatatcttttagtacgattttacttaaaatttatcattgttttttttttactttttagaagttctaaacctttaaaaattggacttatagtttcatttttttataatttttagaagtgccatcaaatgatgccactatgcccctctacaacccatctgtcacctactctttattgtcattgtgattctaaaaatcgaacataactatcgttggaattcattttttattttcaagaagtcccgtcaaccgccggcggctctacaactatactcttatacaccccgcccgctgcttctcctttttattgtcattgagattttaaaaatcgaatatgattatcaatgggtttttttttttactttgtagaagtcccagtaactgtcttacttgtttgcttcacggtctgcctgaagtccccccttttaatcgtcattaggattctatttggtgttttattaacaacttttatatgttgtatcaaccgccaccactctacttctttataggcatgttacttaatttatctcgttatgcattttagatggtcttttctttcaatagtctttatttttattataaattttagttatttataaattgtattcctaattgaaatattatttttctttttctattttcagaatttattttttaaaaaaaatagttaataccgtattgtgttcttttaatgttttaattttttattttcaatttcagttgtttcaaaattgtatttctacttgaactctctttttatttttctaattttcgatattactttatttttttgatttttctaatttttgatattattttattttatttatctcgtattgggttcttatatggattcttctttccatattgcttatttttaattccgaatttcaggtaattttaaattgtattcctacttgagctcttcttttattttcttttgctaattttggatttatttttatttttattccgaattttaattaatctcgtattgggtttttatatggactcttcttttaatattcctttttttttaattccgaatttcaggtatttttaaattgtattcctacttggactctcctttccttttctaattttggattttattttatttttatttcgaattttgattaatctcgtattgagttcttatatggaaacttctttcaatattgcttatttttaattctgaatttcagctatttttaaattgtattacgctctaatgtgggaatttctaacccccacaacaaacgtgatgcctccttttggcccgcgcaattgcgcggctagcacccaaacaaaatcatatatttttcagtatgattttacttaagatttattaaatagctatcctcgtatgtctaattatatagttttgaaaagtcacaccagctgctaccccttacttctgtcatatccttcttttgtttcctcggtctaccactatttctattcattctccttgaaacctcttaaaattagatcttatagctttttgagtttattatctcgttgggtttcgtttttataatttctagaagtcccgtcaaacgctgccattatactcctctaaggcccgtccactctcttttctctttattgtcattgggattttacaaatcgaacataattatcgtccgggttcattttttttactttctataagtcccgccaaaccgttagcggctttgccattgtacttctttatggctcgcccgctgcctcctttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctatgacccttccgccgcctattctttattttcattgggattctaaaatcaaacataactatcgttggaatttattttttattttctaaaagtccgctaaccgtcggcggctctgcaactatactcctatacaccccgcacgctgcttctcctttttattctcattgagattttaaaaatcgaatatgtttatcaattggggttttttttactttttagaagccccggcaaccgtcttgctcatccctccttttaatcatcattaggattttatttggtgttttactaacaatttttatatatcgtattaactgccaccactattcctacttgaaatattttatttctttttctaatttattttttaattaataccgtatagtgttttttaatacttttattttttttattttttgaatttcagttgaactctcttttatttttttactaattttgaatattttttattctgaattttaattaatctcatattggtttcttatatggattcttctttcactattacttaattttaatttcgtatttcagttgattttaaattgtattcctattttaacttttttttctttttgctaatttcgatttttttcctatttttattccgaatattaactaatctcgtattgggttcttatatggactcttctctcaatatttcttatttttaattccgaatttcagctattttaaattgtattcttacttggactctccttttattttataatttcggattttattttatttttatttcgaattggtattaatctcgtattgggttgttatatggaaacttctttcaatattacttatttttaattccgtatttcagctatttttagattgtatttatacttggactcttctttttttttctttttctccaattaatgtgggaatttctagcccccacagcgaacgtggtgtctcttttcaaagttgttttaataatataatagatagatagatagatcgatccaaactttacaattaaatgagatgaacggtttaaataagagcacaaaggaggctgatgagagaggagagactagaggaccgaaaactgatggtgcgaccttccgctgatcaacgccccccacgggtgtctttccatgggattttgtaggattcggccgggttacccgggcatgggtggtgagtactgagtagtaccggtgagaagccagccagaagcggcgtcatggtgggctggtggctcctttcctcacaggctagctacctactgtagcttcctgccgtggcccttgctagcactagctttacaggggaaagaccggaagacgacgacgagtcgagctctctcagctgtgcaggtgcagcactggttctggctagctcctagctcccggccactactgtgactgatggcgacgcgaggactgcacctgacacgacctatcctccctgcatcttgtggacggacggctccggctcatctctatcccaggctctcagcccataacgtcggactaggataactagctactcaaggatcatggttctggtccggggggcactgtagagcgtagagttgtagacatcgtcacctacgtggaataattgagttgttttctgatagcggtgtagcggagtagtagtagtgttcatctgtctcaaaatattattatcaggataggatgtcacttattctaagacaactagtctgcagggtggatccggtaaaatatagtagtggaggcggaacaaaatacgcagcaatccaacataaatcaaaacatgtatcacgtgtaaattggctaaatacctagtttaaagatcacatacattgaattaatgatacgtcgataattttgtccataccaaaccaatgtcgattagatgacatgtcatgcccaatcgcctattattcttcatgagtagtaatctatacaaagaaaaaggcaaattaatgaatgattgaaacagacttattttcaattcaaataatttagactaaactctgcccgaggtctctttggttgaattaaacactcgttactaggtgcaggatcactgacttttttgttgcttgaactagaattagaataactagctgggtggcccgtgcaattgcgcggctagcacccatacaaaattatctatttttaatatgattttacttataatttattcaatagatatttcattgtcttaagactttgaaagaccaaaccatatcatccccgtatttctaatgttgtaacttttataaaagtcacatcagttgttaccccttactttttttttgtcaccctttctttatttgtttgttcgatctaccatggcttatattcattatccttttaacctttaaaaattggatcttatagtttttttagtttattgtctcattgggtttcatttttttatttttagaagtcccgttaaaagctgccaatatacttctctatggctcatccgctgcttcctctctttattgtcattgggattttaataatcgaacataattattgtttgagtttaatttttactttctagagtcccaccaaaccgtttgtactcttctacggctcgcccgcttcttcccactatttattatatttgagattttaaaatcgaatgtgattatcattgaggtttattttttaattttttggaaatcccgccaaccgtcgtgaccattctgcttaacggcatgtccgtcgtcactccttttaattgtcattgggattctatatgggattttgttaatagtttttagatgtctcatcaactgtcaccactctactcctttacaaccctttacaaccatgttacttcttcgatatttattatcatttatcatcgttgtgttctagatgatttttttttgaaatttccatatttttcgttccgatagattttatttataaattatattcctagttgttttactctattttcagaatttattctattaattatttggaattttaattaatctcgttatgtattctagatggtgtattctttaaatagtctttattttttattacgaatttcagttccttttaaattgcattccaagttgaactcttctttttattttcttatttctaatttcggattttattttattttttattttaaattttaattaatctcgtattgggttcttatatatggacttgtatgaaatgagggcactgtattttttttctactgctgcagcctaagcgtgctggcctggtatttccaccctatatatgtgcgggaatgtatgttggtttagaactctataatgtatagttctgcaattgatttttctaaacggacaaggactcctagtacggatggtatgatccataattagattaatatgattatcttttgtacagtaaatctatttagtaattttaaatttgtattcctactcgaactctctttttttcttttcttctaatttcagaaatttatttatttattattctgaattttaattaatcacgtattgggttcttatatggactcctctttcaatattgcttatttttaattccgaatttcagttattttttagattgtatttctacttggactctttttttttctccgattaatgtgggaatttctagcctccacagcgaacgtggtgccttcttttcgagctgtcttaataatataatagatacgcgagtaatgttctttttgacatgttagacaatctaaagatgtatagatatagaaaacaattataagtatcaatcacaacctcattgaacttgaactattgagacacaatcttatacttgtcttttagtattagagtttcaatcacaatcacaaccagtttttggcttgctgcctgcctgccttgccaccttgcgccctcgcagcgcctcgttggagagcggcacgccacctccccggcagcgtggcagcgcaggcgctggaccaccgcgtctcaaggcccccccgggcgccctccaatccgcccctgctagtctggatgcactgtccagatttattatttagtatgaacaaaatcctatcctaaacaacaaaattttgggaggtagtactacgaagccactgccagcaatttctccaaataaaactagctgggtgccattgacacggctagtgtgtgaatgacaaatgggtcccataaatatttattttaattctaatattatataagcgccacgtgggatgaagactaggtcaacgccaccacgtcatccaaacagtcctccaaaatctccgagggagttaaattgtactggtttcaatagttcagggagtcatcctttccaattttgtggttgagagtcatggattagattcccgtcactttaagggagttgaagtggacttatttctatattctatagtactccaatatcgcatttgggctacttggttgggctcgttgctacgttgcatttgggccgtgggagtacgttttgcattgggccggtgagttccttcttctcggcgtgtgtattcgatttgggcgatatgattcgtttcgtggacaggtttggcgctctttttggttgtggatattagggcatgtataatggtgtttaatagtaggccctctttgttatcacgtaagtaaatttggtgacgtgaaagaaaaagagagaagaaaggagaaacatcgttgctacgcatgacaacggctcagaatcgactcttagcatttattaacggaaaatttattgcatgaaggtggagaaaagaaaagaaatataataaaaaatatttatgcattaatggtttagaaatcttattgtctctactattgtaggaggatactccctccggttttattttaattgacgctttggacaatgacacgctctacaagatatatctttgaccttatttttctattacaatatatacaataaataaatgcatgtttacttttattatagtgttttgaaagacaaatatatatatatatatatatatatatatatatatatatatatatatatatatatatatgtttttctagtttctttaaactaaatatttttaaagttattgatgggcaaagttataaaagtttaatctcaaccttgttcaaaacgtcaattaatatagaatcagagggagtagtctctagtggcattaattaatatagagagctcatattaggttctacctttttgtacgtgcgtttaaccggcatgattgtgtttaccattgatgactatagtagtctcatttattaacctgttcaagactgtctaatcgtggttcttgaacaatcgctatgtgagacatgacgagtatttgaggactgtaagcaacagcgtactgctgaaactgaaagtatgaaagagcggtgcagtttgaagcacaattctttgtacaggactggatttaaccatcgtcagtactgttttgtattttacagtgtggtaattctacatcttttcacctggtatatcggttcttgtatcctgaagtttcggggtatattaaatttctttcgtgtgatcaatctggatagagtattgacaatgccgactaactgacacatgttaatatagcgaccaagctagtagcaaaaatacaatcaggtcagtaggtcagcaagtatttcagggaaaaaaaactttgttacccaatgaaataccaactggcctgagagcatcaccaacagattatctataatctttcctcaaaaaattgtttttggtttcctaaactgaaaaaaggaagggaaaaaactcctccctccaatagatagcctaaattcattccctaaaacttaaaagtttttttcttccacgcgcagaaagatcgctatcttccacgcgcaggaacgggaggagagagaggcgggagtgcgagattgggagcgactttcgcgagaatgcacgcccgcatataaacggagtgaggaatcgagagaagggaactccaaaactcgggtagaagattaggggatttgttagagcagttttttagactaaaatcccttaaaatcagttttaggaatcagatatgtagactgttggtgatgctctcaagtcaagtagcggacgatatgcgattttttttaaaaggaaaattggaaactctaccaatcagttaagaaggaaattaagtgaagtacatgtccacaagatcggtccaccggccaggtcgagcaaatatatactatataatatatacactacatattatggggtacaagaatggatactttcgggaaacaacctctgcgcaacgatcataaatttctaccacaacttgaaatcttgaataatggccagtagccaagtacattgtcggtgtctgccgtctgcgtggcatggcactgctgaacgacgcgtggtcgatccaggtacatgccattcctatgtatgcgaattatgagagcagaccaatggtaggtgaaacaaagaatgcatgaactatagcagatatgaactcagcagatatgaactcacgagccatgacccatgagtgtgttgaagacgagagcctgtacatgtatcggagaagaccaaagcaatgttgctgttcatttaagggaggaagcaggtgaggaaacaacattaacaccactgagcacacactgcgcgtagcaaaaatgagcccatcaccacgtcccagcgtcccgctccgctcttcgcggcgatgggcagcgccgtgccgacacgacgccccgagatggctacctagctgacacgcaacgccggcctccggatcgatcagtaaagagagtgcagtgcagtgcagcctcgtgtcgtcatgcacctggaaggaaaaggttactgtatttctgcttgtgtgcgcgattttcgctgctagctggcaatcgtgggatttgcagcgtactgtgcaggcccagtgtaactcgacgccacgccggcccatcgtatttaatgagctgagtgtaagcaggtacacaggccgcccaactaacctccttcacggcgcatttacgcttgggcatggccggtgtaaccgtgcaagcatcgtagtgccatcgatcgctgctgtaagtttgtaacatgtgcgtgtcctgcggagagttgtgtgccgttgtgcatggaatggaaggcaaagcataacatgggagcttttcatataaaggccaccagcacgcgggctgccacttcaagcttcagctcgtgatcccatcagatcagcaagcagtcgcgaaatggtgccgatggctaaggctctcgcggtcgtgtccgctttctgccttcttgtggcgccggccgccgcggcgcgtagcctcgtcgacgtcatcggcggggcgttcggtggccggaaggactactacacgcccggtcctactggccagcaccactcttctagtcccagtcgttcgtacattacccagtctcttccatatcttatcttgctactgctcggttacgtcaactggtcaaacgtacgacgtaatgttcgtgcgtgtacgtgtttcccatgcagattcgcacaaggctccgccctgcgcgccgacgccgccacagggaggtggtggaggctacaacccaccctcgccgtccattggaacctctccgacaacgccgggaggaggtggaggctacacgccgacgccgagcgacacgccaccctctccgtccagtgacacctcgccgagcactccgggtggcggctgctcgtcctcacccacgccgtgcgacgcaccgccctcaccgtccagtgacacgtccccgacaacgccggggggaggtggaggctactcgccgacaccgagtgacactccgccctcgccgtccagtgacacctctccgacaacgccgggtggaggtggaggctacacgccgacgccgagcgacgcgccgccctcgccttctagtgacacctctccgacaacgccaggtggaggtggaggctacacgccgacgccgagcgacgcgccgccttcgccgtccagtgacacctctccgacaacgccgggtggaggtggaggctacacgccgacgccgagcgacacgccgccctcgccgtccagtggcagctccccgacaacgccgggtggaggtggaggctacacgccgacaccgagcgacacgccgccctcgccgtccagtggcagctctcgcactacaccgggtggatgctccactcccacgccgtgcggcacgccgcccgcgccgtcgagtggcacctctccgaccacaccgggtggaagctactacccgcccacgccgtccattggcgacgtgccaccctcgccgtccagcgacacctctccgaccacaccgggcggaggctccccgtccacgccatgcgacacgccgccctcgccgtccagtggcacgtccccgaccacgccaggtggaggctactacccgcccacgccatccgtcggcgacgtgcctccctcgccggccagtggcacctccccatccacgccaggtagtggaggctactctccgtccacgccatgcagtgcgccgccgtcgccttcaagtggcacctccccaaccacgccgggtggaggctattctccttccacgccgtgcaatgcgccgccctccccttcaagtgacacctccccgacaacacctggtggcggcaactacccgcccgcgcccaccattggcaacgtcccgccatcgccatccagcggcacctccccgagcacaccgggtggtggctgctcatcctcacccacgccatgcgacgcgccgccctcgccatccagtgacacttccccgacaacaccgggtggagggtactacccgcccacgccgtccatcggcacctcgccatccacaccgggcaccggcggaggctactaccctccctccccttccaccggcggctacacgccgactccggacgttccgatcagcaccccgtcgagcccctactccccgctggtgcccacgccgccgtcgagcaccaccccgatgcccttcgaccccaacacggcacccttcccgtgctcgtacgttacttcgtcaaccttagcgccgcgcatatccacacgtacgtcgtgcataatatggagtatatcaggtgcatttactaatctaacgcacgtgtcgtgtgcgttctgtctgattgcagatactggctgtcgcacccgggcgtgatatggggcctgttcgggttctggtgcccgatggcgcggctgttcgggccgaccgccgcggcgccgttcggacacgacctgaccgtgccggaggcgctggcgaacacgcgcgccgacggcgtgggcgagctctaccgcgagggcacggcgtcgcttctcaactccatggtgaacagcaggttccccttcaccacgcagcaggtgaaggacgcgttcagcgccgcgctcagctcaggaggcgaccacgccgccgcggctcaggcgcagctcttcaagaaggccaacgaaggccacgtcatgcgttaggctaggcggcctctcgatcctctgtacttgaacgtactcgccacgtgaggcggattcgatgcgatgtacacgcgagcatgcgtgcaggttcatgtcggggtggggtttggagtaatccggcgtgtttgcaactttgcattatgtttgatctagagcggatggcctctggaataactataggagagttaagtacgtatgttttgttatccttttagagtccatggccgcacggaatgactacaggagtgttctctgtggccttttaattcagtatgtacttgtggcgttaagcatcagacgtgttctagtatttctagttctatgaactactggcatctttcaatttactcagctcttccataggattcaatactcgaaaccatatgcattgagatttgaatactcgaaactatgtagagaatgttgagaatgagcagttatgtgcatttgagcaactcctaaccacatgatcacaatctaacggtttagattacatcgctacactaccaaaagagtttggttgtttagggtgtgtttagattcagaggtgaaaatttttggcgtgtcacatcggatacaccaacacacatttaaagtattaaacgtaggctaataataaaataaattacataatccgcatgtaaactgcgagacgaatttattaagcctcattaattcgtcattagcaaatgtttactgtagcaccatattgtcaaatcatggcgtaattagacttaaaagattcgtctcgtaatttacacgtaaactatgtaattggttttttccgtccacatttaatactacatgcatacgtctaaacgttcgatgtggcagggtaaaaattttttggtgggatttaaaccgggcctagttcccaacttttcctttaaacttccaacttttccatcacatcaaaactttcttacacacacaaacttccaacttttccatcacatcgtttcaattttaatcaaacttttaattttgacgtgaactaaacacacacaaaatctctgtattgacaggaattgtactactgtgccatgcagtagttactgtagcagactcataatgccgttcacacaggatcagctctgtcctgtgctgcaaatgatcaacatccgagaggagacggtgaaaagtgagaacttgtaacggcgatgtcttctgcaagcctcggtaggcttccttcatattaggattgaggtttcaaggctagagacggtgaaaagactaccatagaacacggaacgagatcctacgtcagagggacgtccaatacgggatcactgttcgtagcgcatctgacggcaccaatcgttcgtagcgccagttcgttctccatcttcgacccagaagaccattcagtcgtcgtcgccgccgccgcctccgcctgcttggtcttatcgccgaggacgccgcctgccaagtccaacaaccacaccatgctagtcactcttcaacatggtcggcaagaaagtgtagtttccaccattgatgttggtgagctacacacctatgcagggaacgaatcgacggcagcttcatgcctggtgcagaagccagacgcacgcacaagtgttgatgaacctgcaatttgtagagcagccaggagtggccatggccgggcacgatggcggactgcggtgcccaaacagcagcggcaagctagagagacgctgtagccgacagcgtgatgaatggcaacgagagaggagtagtagtcggcgacgcggtggacggtgacgagcgagtagtggctccgcgacacccatttttcccttcgcgagcgaacaaagccagtgacgtggtggacgatggcgagcaagtagcggcacccggcgtcgccgatatttccccctcacgagcaaacgagagcagttgcaaatgaggaccacattgcgctattcatcaggagcgttggatgcttgggggcctgtggatcgaagagctactgccctctggcctctgacgtagttttcccaacgtcaaagatccggttccgtagaacacctaatacatgtcggctctataggtatcggaagtggtgaaatcaacacctacagtgcccttgccaccgacacgagtgcatgttagcacgaaccggcacctttctaaagaaataagtgccgttctaaagaaaaaccatcatcaatactataaataccagtttttataaaaaaaaacccgacatctttagtttagtttattgtaggtgctggttataaaacaccaacacctataataaattatatgtccagggttttttagaaagccaacatccgaaaaaatcgagccgagccaactgcgtcttatccagtcacacctgtccttatctcctcacccgtgactctctctccccctctcttgcgactctctctctttcttcctctcctccccacccgcgagccggtagcggtgtcctccacacccgcggtagcgcccttccctaacaccctcttccgcggtagcaacaggatggaggtggcagcagcgtgcggcagctagactggaggcggtagcacgaatatggcagttgtgggtggatctggtagtggcgacggctccctccaacccctctcgccaccctcccacggcggattaagcgctggtggtagccgcgagtggatctggtggctgttgcggtggtggtagccgccatgggtggatccgtcagcggtgacggcggccgagggcagatccaacgccggcgggagtgaagttcttggaagttctttgatgttgtgattccatgattccttttgtgattatgtgatgatgattgtggtttattttaggggtgcaaagtgtgattgattcgattccaagtggaatcggtatgtgactattgacttagtgttcttgaatgtttttggatttcttggattgatcggggtgaagggaagctactcggctcggtgcatcagctcgcgtcgagccgatgcatcgaaccagcttttttttattcgtggaacctcaaaggtgtcggttctaaactaacaccagatccggcacctatttgattttcacatcagtaccgccctcgtgatgccggttgggaaaaccgacacctaaggggatttctgtagtagtgaaaggggtagaggcctgttaaatatgtgatctgaattttagacttgcaatatattcaaataagtttcctaatagaacttgactattatgattagttccctagtatgacttttaagtctttcctcactaggacttctagatttctcctatatatatcctgagaaattgtaattattgaatttaaaaaataaattagaagctagctttctccgttttttagatttatagaaacttgttatcaaaccactggttcttaggctgcgttcaacaaatgcagtcagagattagttttcgtagcacgtgaaaagagacagaccattagcagataattaatcaataattattattataaacttaaaaaatgatttatttttatttttttaaagcaacttctataaaaaaatttcttgcaaaaaaacaacccctttggtagtttgggaagtctactaacgaaaaacgtggaagttataatttaaagttgaaagatagaatggggcttagaattttaagctattctaaaaagggcatgaagtcttttcctgctgaagcggaaggaataggtagcagcgctagcgaagatagagatgctaggccaggcctagctatagatggccaaatgggccgcccgacccggcacagcccaggcatgactgtgcctggccgaggccatttgggccggcacggcccaacatacacgtcgggtcatgccgcgctagcccacgggctgcacatacgatttaggcatggcccaataagactttggtcgtgccgggccaacccaaaggcacgacagcccatcgtgcttctccacagaataggtatattgttcatccctcaactatttgggctttgtctatattgctggaaaattagtctattttgtattcctcttctctttgggccttgccttatatggttgattaagtatattttgggtccctctattatttttcttccatcgtgccgggctatgccggcctatcgtgccgagggaacaggcccaggcacggcacgattgtcgggctaggccggcacgggcacaaccctagtcgggccgtgccgtgcttggaccagaccaaattaccgtgccttgggccgggccgtcgggcctcgggccatatggacatctgtaggcccagctagacgcctcggctagactacttatggcttgctttgcttcttgacaagacataaatactcaggacactaatgattttttgctaattacactacttaatatgcttagaactaataaatcactcttagaattaagcatttgcaccatggtatgtgaagagtggcccaatgatattttttttctagctccgcccacaactcgtatctatatactctatagatggccataaggcccgaggcccgaaggcccggcccatggcatgactttttggcccggcccaagcacagcatggcccgacttgggtcgggcccgtgccagcccggcccgatcgctgggccgtgtctgggcctccccgccggcacgctgtcgggccggcccggcacaatgggccggcaggccaggcccggcacacaaagtatagggactaaaaatagacatataaatgtaactgtccaaagaatagggatcttaaatagacttattagctatttatataccacagcccaaagaagagggaggtaaaatagacttttttagctatatatatatgtcacaacccaataggagggagggaaattagacttattccgaggcgtgttgggccctgcctgtgtcgtgagtgcggcacgtgggctggcacggcacggcccagtgtgtcggttgggccgtgccggcccgacaagcctcagcccaggccgtgcagtgccgggcggccccacatggccatctatatactccctccattccatccctccattccattttaagtgcaaccataaattttcgttcccaattttgataatccgtcttatttgaaaatttttttagtatttttattattatgagatgataaaacataaagtaggacttaatacgaaacttatgttttaatttttttaaaaaaaaattttcaaattagacagacggtcaaagttgtgcacggaaaattatagctgcacctaaattggaacggagagtgtatttgatatttcttggagcccagaagccagatatatcagtctcctaccaaacaattttttcgccggtttcctggcaaacagtatcaaaattttttggctgagggaaaaactagcgcgttgtttaccgtatcaaaatacaacaatcaatagcatagtgcacgtactgcaagtttgcaacagccaatggttcgataacaggctgatagcactgcggaaatcaaaatgacaagcataaaggccacaacagccaacagcgatcaactcaaatgctcaattagattgtactagatttgttttgaaaaaaaaatgtgcatactacacagtcccaccactcgcgtggtaagttcgaagaatctgtagcaacaaataaccaaaagtaacgagcgccggccgaggcaatggatagagctgggaatgaaccagagcagatcccaaaaccatataacgttgcaaacacaaaactgagacatttctttgcagggaacaaacaaggtatcaacgtaactataaaaaaactagctggacataacaccttatgcataaacatagcactattctagcgaagggtaacaattacagtgcaagctgacactagagaggaatctagtctattctattctattctattctattatatactaaaagtccattaaacttcctacaaacgctcctaagccgccacatggcgctcctacaaacactcctaaaccgccacgtggcactatctaatctcattgttgattttcacttagattggtgcaccgttaatttagaccattagattagatctattattaaaaaggtgatagtttttctaaaaaaatatgcaactggtggctgggaaaaggaaagaaaactaaatgtccatacgcaagtataattgagaaaaaaacaaataaagcttcctactgttaggcggaagaaaaagaaataaacatctacgtacgataaaaaatgataaagccaaaaaaatgtgtagttagtaccggtggaaaaaaccacggtctaatgtacgattttgtataatataaaatataatattacataatatacagaagtacatgcatgtaaactagatctataatataaatatcaaatatcaaatcaacggtctctaaatattatcttttaatttatttttaattgtatatccaatttatgatccattgtattcatttaattatataaagtaatgatgtataaaagtaatattatggtcttaaatacatcatgacacattgggtcgacatacaatatgtaactttagacactaaaaatctattaaacttcctacaaacgcttctaaatagccatttggcgcttctatgaacggttctacgccaccacgtggtgctctaataaattatagaaaaccttacaaattgtgagaaaaaaaaaatcatgcaatcatttttattggttgacctactattttaaaatattagattagatttatttaaaatacatctaatctgctcaaataataaaaaacacgtgaatagttatacgtatatatatacatacttccgtactttgctagcttaaaaaaaagaggaaaaaatgtaattaggattgaaaaaagaaggattagccatgccacggtcccacctaattgttacgagttacacgtacataggtacctttcacccaaaaaagtgaaaaaaaatctcaaatgtacaatgcatactactattcaccagattgagaaaaaaaattctcctgggtatgtacaaaccctgtcatcggctttcacttaaatcatttagaaaaattagaaaaataaaatctccatctcctcctcactctcacatctacgcaacactgtcgtcccctccctattgttttatctattaaattaaaagagaaacaataaataaagtttgatattttttaatacaaagtagaaacgtgggcactcacaacgcgcgtacactcacatctatgaacgcgcacatgcacatactcctatgagtactttcgagagactaggctgatatatattgagattgacaaagtcactatatatgtctcgctgtcgacgggtacgtcacctactactgaaagaatttgtcaagtctgggatatgaacctgagtgggtaaattccatcactacgaacctaaccggttgagctacgttcacttcacaataatgttggatattaaatcgaccataatttgtaagctacatttctagaatacttatatgccttttaaaccagtggaatcattatttctaacagttagatctatcttatataagaaaaaccagatgtgtatatatggtacatcacatttcaaaaatattattgtgcaattatatttcgatttcacattagcttgcatggaacttctgacccactctacatgaaatgttcatacatggatcggctctcaaattacattaatcatattagcctatataaatccatatatttaatggagcatcatgtcccacccaattaatcgttgaataaactatgataatatatatgcaattaaaaatgaaaaatagcttagttttactttacacttacttttcgttgacatgttttctaaagaaaataagtctaccttcttttcaagtgatgtagaagattataaataattgcttatagatattacttaaatatgatataatataaaactaataggttagaaaattataaaagaaattaatgtcgacaaaaacaatttatggaaaaatcgtggtagatgttcaccggttaatattttgctcttataagtgtctcaaacttagcatatgacacatgcccgcgcattcgcgcgggctaccttcctagttctttatagaactcaaacttctattatggcgcactactaaaaagccataatataggacttgtaggactagtcgggcaccttaatagagaaggtgccctttctactgtacagtgccccttgtttgatggatttacacatttccagattgtagattgctgccatctctaccagctgcagggtgcgatgcaaacctttccatggagacgtctcttaaatatggtattgtctttagcatcagtatgtaggaaggcgtgataaagatggttgttccaacagctgcccagaccgacgacatacccttgaaacaaatgattacaagaacaatatacactgccaatattatcaccatgctaattttctgcaaaaacaaatatcaaccagaaaaaggttagtaagtggaaataagtttcagcgggtgaaaaaaatgatattatggtgtaatggctggattcaatagctgtttgtagtggataaacaaaaaaaaccaatacatttgatttgttttgtagaaataaggctgagtagttgagtgacatgaaagtaaagttctatgtatacctaggaatttgctgcattggtggtgaaaattttcagcatggtgagcaataagacatcggtaactaagactcaaaattgggttgatttatacaaaataggtttctgaaacaaacctagacagaatcagtggttccgttatggtaatactgattgacttctgtcagatacgaatacaaatattatatactatagaagcacgacactggcacactgctaaaacaaaatagctatttggtttgatgtccaaacgagaccaaatttggcttgtttctctatttgaaatggccaaaacttagcagatcttgccgcatggatttggcaatgcaaagttcagcttgaattttatgtgattattagtttggaaaataagaaaggtccaaattttaaccgactgttggaaagattgctcggtgccaaactgcccgcagtcagtttgtattgaatcgaacagttttaccagatagggacaccaaaaaattcgtgctgggtgagacacatcagacagggattgaaataaaaagcgggccgtagccttcgatccaaaaacatcagtcagggaggcaggattacagctagaaattaggaagggggatctgaagcttgacttacactgagcacgttcgccaatatttgattcttggtgtcagtttccccctgcttcgtctcgcatccatcaatatcctggcctttctcaagatcgacgaattcggttggttttgtttctccccctttctcaaaatcgacgggcttgggaagctccatctaatccttgtgagattgcctagagattccctgtcttgctctcctaggtaaggcggcgagagcttcttgcagatcttacaaatgcgcgctacggcggcttcgttggggaatatgtgagatggagaactctccgattccgaacactaacgaagaattacgcgcacgcctctccgattccaagtctgtctccaacaccttcacggattcacttacgaagcgcgggttcaaggtgaccgcgtagaatcacattccctcctctgctcccgtcgccgctgctcccggagtagctgaccatggagtggctggcgtctcgctggcgtacgccgacgtcagctcctcggactcctcccctcccatcgccgctgctcccgccgtagcggaccatggattggccgcgcgccgtcgtgctgtcggacgccggagggtcccagcaatgctctggtctccatcgattcgcgcctgagatgctaaaaatgctgtgataaaccctagtgtccgacagtccgaggtacggtggcggcggcggcggaggagctaataagctctatcagccttcccccgttccccgtcgtccggtggacaggttagtgaacaatggatgtcggatcaatgcaaatgtcacataatcctcttgataagggctcttttggaataaaagatttttaaaggattgaattcctataaaaaaaactttaaagctttcttgaaaaatcattaggattgtaccaaatagagattttagagaaaacttagcaagagttccaacctcttaaaaaaatttatgaatctatctcttgaaaaaaaatattatgcaatactctaatatttgtttgaatcaaataaataccatgtatttaaacaagtaaacaaacaaacaatactaataagaaatatttttctatctatgacaaatcgttatatattttcttttacctatagcagagcatgggtattttactgtgtagtagtaggtagtgtgatataattaacggcaaacatagctagcatgtcgactattccaattttctaaaaaagatttcaagtaaaaaaatatagataattttatatcatacttcctccgtttaatattacaagatgttttgcctttttttatagtcaaatttctttatattcgatcaaatctatagaaaacatagtaacatttcaaacacaaaataaacatactatagaaacatatttaatggaactagttttttgtggatgttgttttttttctatagatttgattgagtaaacttgtccaatttaatagtgggatcaatatatttttataaatgatacgaattagattacacctacatttcgagggaataaaagtggacttattatgcatgagtttacgcgggcctgtgtagcccaaacccaattccactcttgggctggttagctttctagcccaatattacacgatgcagcaaagtgccgcgcgtgcagccagtaagaatgtactccatccattcacttcagctagatttcttgacagccactttggttgacgccttgacggtaccaaactgttgaaccggccaggcgcactactagagttctcatacaggtcatatccatctttgatctttattgaagcccaacggccagagatgtaaatctccttcctgccaaacattgtttttcctccgggcctcctgccaaacaattaggccattcgtgcatgcgtgcgacttaaggggaaaactagcacgtagtttagtgtttaccatatcaaaatgcatccgtcagtagtgaaagtttacaagttgcaacagccaatggttcgattgaagactatacgtagtccccattcagcttacaggcgtcgtagttgggttgcggtggcaattcaatacggctatacggccggccggtgcgagagccctcgcgcaacaaccgtataaatcgtctgcatttattcgtcagaagctcaagctcagctcagatatggatcgcacgcatttgtgtccccctggtttgacattcggttgattcacgacctcgaatgaaagagcccacttgctggactggatgtacgacgcactgaaaatctgaggcatccttgtttctcatcgatctgttggcaattcgttcccattagctttgacaaaagcttctcctttcgcagctcaggacagttcagagagcgggaccatagacgtactgtacctcctatagtccatagatcgacacttccgagttcagactttggaggaaggctagagattgaggtacggctaatgagctaagataatgaaacaaccaaaaaaattataggtaattttttatatgtatttgaattgtttgtggcttaataactaaatatagctagtaatgaaaaatacactaatactctcaaggttccagaataattttatttttggtcctcctatttatcctaaaacaagttgacttttaaataatcctagattattatattctgaaatggagagagtaatactaatgtaggcatagattagacttttactagtactacaaatctaaatatggagttgattcattgaactatggctgtgtttagtttcaaagtttggggagaagtttggtagtttggaaaaaaagttaggagtttatgtgaataggaaagttttggatgtgatgtgatctgatggaaagtttagagattgggggaagtttggtgtgaactaaacagggcatatggcatgtctaatactccatccgtcccataatatgataagggtttggaggaatgtgacacagtactatgaatcgatatgttatatttgggacagagggcgtatgtgactagattattatattttaggacggagagggtaatttcatcgggattgataaagtggtgatattctagtttttttaatgtgtaggatatgtgaaaaataaattatttaagacaaagagaatataactctaaacttaaatttaaaaaattatttttttctacggctacaagcaggcgataattcaaaaatcaagtgttacagatgcaactgacctgcagacagaaccagctgaggttcaaaagaaaagacaagtgtcaaccgacgagctgcatcctgtattgggttttccctgttcgaaagaactgaagaatgtactactagcgtcattacaaaccagtcgtccccttgtagtttgttgctcacgcaatcatcaatgcgcgcaagcgcaaccatcgaaaagctccggtgccgaatcagatcagtggatgattttttacttggatttccttttggcaaattgacccccatcagaatgtcaaaccgtggttgttatcttttgatgtactccacctgtattgcgcgcatgcatgcgttgtcaccgccggcccatttcatgggcgcgccacgacaacatctgctgcaggtttgtggagctctggcctcactctcgtacaagtgcggtgaggtaacagatcaccaagtaatgtgcacgccaaagtcatcgtttgaggtgtcgaaaaaggagcgattcatgaattcaatacagtactactgtactagtatcaatttattacaggaacagactctgtttgtgagctacgtgtactcatcatcttaaattacgggagtacagactacagagctccgcacttccgctacaaaaaagccacagatatcctttacatctgctccatcctttccttcatcacggcataagtttgcggatgctgtcaaggagtatatggtactcctaggtactcctactaacacaactacacaagcgaggatgtttaggtgttaggacattaggtgcactgttaaaagtggagaaaagtaccgagtcctgcttgaagtactagcaagctgaaacgacatgactactagagcaaagtcaataatgcagctaacaacggacggtaaaacggcccatgtcagatagtgcagctaatactaaaagctcagtttttactagatcagtccatcatgtgattgggtggtgttaggttggccccacaaaatgtgtgaaaagctacgctgtaaccggacagtaaaataagcgttggcttatttctctctcctaagttctctctcctccatatagaaattaaatgatgtgtcatattttgaagcctgactagtcagcttattgtacctgctctactgatcttcccatcagctgttattcactgttgacgctggccccggctagtgatgtccacactccacagatcgtcaccgttatccattgatatcggtgggggcagtttggtaacaggctaggctagatgcacgggtacgcttggcagcattttgcccacattggtccctggtacggtaaaaatccaagttcagtctccattaaatcctacaggaccagcaacggagcctatagttacatacacacgaaccacactcttagctactatctctatcttaaaataagtttatttttagcttctttcaaaaaaaaaaaaactaaatatcacctactgtatcataataagtttattttttagcttattttatttgttccaaaatatgtttttaaaataactattgtatcaatgttcgtgaaagtaaaaaaacagtagtattaagagtagataaagcaaaaaatatttgcattagtatttgataaagtaggtggattatagttttttttttgtttttattgttatgtgtgagataggtgaaatttttttaagggaaaacaacactagaatagtttactgaaaataaatttgtactccctccgtttcaaaatgtttgacaccgttgactttttaacacatgtttgatcgttcgtcttattaaaaaaaattgtgaaatatgtaaaactatatgtgtacataaaagtatatttaataatgaatcaagttatatgaaaagaataaataattacttaaattttatgaataagacgaatggtcaaacacgtactaaaaagtcaacggtgtcaaacattttgaaacggagggagtagtattttagaacggaggtaacgtagcaaacattttaggacaggtgaagtaagttacatcatgtagtggcattagacaatttaatagtttactgacactagcaatacggtagggaggggacaaaaattgagttgctgctgcgaggtgcaaagagcagcgatgtgcggcgccatttcgcgttgaatcttcagtactattattcactaatccgattaagcagacgaccctagtacagtacaggtatgggtaggagtttacgcgcggttacgccgtgcaagtgcgaaagctcagcggtgggcgatcgctgccaagtcggttgataccagcagaagtgctcgtcccaggagccaatgataagagccaaaaccgacgggctcattctccagcttaactctcacaggtggtactaactgctggcctctggcataactccgactggccgcctgccaccacccccacgcttagtagcattcaaacaagatgcacgccatgcctgggtcagccagcatccaaatccaactcactcgagcgcgagctagcccagccgtcacatgggagatatcgtgcgtacgcttaactaacgagacaaagggccacataattatgcgggggctcatgaccaattaattaacggtgttttgcatgcgagtgcgacgccgcagcgctgcactgcactccactccactccacggcagtctgcagacgcggataagcgtttcgaccgatcgggccgcggcgcgagggaggggatcggtgcgcgcgtcgcagtcacgcccgtgtcggtggtctccctccccctcgcgagcgattcaggtcgctttccgtggtcgaacccggcaaatcccatcgtcccattcattcgctcactcatcgacccgccctccccctccgccgctgccagattcgccgcgccccctaccaggctaccacctttgccacaccctcccagacctcgcatcgcacactgatgcggtgatgcccgcaccgtgccatctctctctcttttttacttctcgggctttccttagtttccttcgttttcccacacgcccacgcgcggacgccgcgtacttagctagcaaggctagctagaagctcccatacttgcacgtacgctttcccattctcttttgcttaaaccgagctagagctttgctagctcagttcgtccatgagagcagcagcggcgggtcggcagcctcgcttgtagctagcgataatgaaggtctacatcacgtcggcggcgccgctggctggcgaggcaacgaaggcgatggcgtcgccgccgtcgccgccgccgcaccagcaccagcaagcggcaacaaggcgcgggtgccggtcggctgtcgtgacggggctcctcgccggcgtgctcctcttccgcgccgcgctcctcaccatcgaggccggcgcatccctctgcccttccaccaccggtaagttttcacttcgcacgcaccgaggccaccggcggctgcttggtgaattgcccattttcgtttgcgatatgatcatctctgacgcgattggccaatgctccaggatgcttggactggagggccggtctcggggactggctgtacggcggcagcggcgacgcgatggaggtgagtctttactggtcactggtggtgtgctagtgttaggccggcgcgtgcactgactgcaccttcgatcgtgcgactaacacagtcagagtgcgttaggaaacaggggtgacttttatgcgccggggttttgacatttgttttactacttttgcgcgcggcggggcaaagctgtagtacgggacgaaacacgccgttgggcacggagctcctcacgcggttggggcgatttttttttccgcatggttcggctcgctagcagtaagcgccattcacgggaaggggaatggaatgtcagggccgcgtcggcaacacgtcgcggcgttcctaccacgtgccccgcggccgcccacgctgacaggtggggccagtcgatccgatccagagtgctgcatgctctggattctcaattttttgttaaccactgtcacagtcggccgttgtcagctctcgcctctcggtcattggtcaatccattccgcccccagctacggctcaccggctgaattcaaatgcagaccagtaagccaagtaccacccactagtgttgttttgctcttggagaagtaccccaagttgaattacacaaaaaaatcgtgaaattagtagtactccagtacctttctcagtcaacttgtaccagaaaaacggcctaatccgacgaggagttatctatgcactggttggcgatttgcgcgacccttgccattggcatcattcctcgagggccctaccatagttggtggcggcttgggatattgtgttgccagccgctacggtgcccggcacttgtgacgtgctcgtgaggattctctcgcgctggtggcctgcgctccagctaggacatgctcgtaaagatggcgcccttgcgtttggagctacgtggccttttcagttccgactatacagcggcccttttggcccgtgaccgtgagcctgagccactagctattcatgaacgcgtacggtaggcataacccctgtggtttttagtgctctcgtgtcacattgtacatggactggacgcctaatgtacgggatccaatcaacgatgagctaatcagtactctagtactaatgaccattttaagcaagaccatgtactgtgacagtttgtgtttttcttcactgggtgtgactagttatatactatatccatgtttttctttttctttttttgagaacatactatatccatcttgattgagtttatgaatataagaatgctgattttcgatcgatgcgtggaatggtcaggaattcatgaaggagtggaggagaggtcgcagggaggccagcctgttggatcccgtggtggtggaggcggcaccggattcgctggacggcctcatggcggagatggacaccatgctggcgtcctacgatcggctggacatggaagccgtggtgctcaagattatggccatggtataaaacttatcagcccatattccgacgcgctttctctattacgaactttgctaatctttactgaactttttattagtcttgtatcatgcttgcatgttactggcacctttgctgaaacgagtgctttccacgcctaaagaccacacatcatatggtccatgtgtcttgcatcctgccttgaaattagagaagcggaacgtatggtcatgcatgctctccactaaatctccggttaaacatgcaaacgtcacttttttaggcgtgtccagttgaaatgactgcaacttgaagcgttctttggctgtgtttacttcctgaaattagaaagaagtttggggaaaattgttagtttggaaaaaaagttaagagtttatatgtgtaggaaagttttggatgtgatgtgatataatggaaagttgggggttggggggaagtttggtgtgaactaaacagggtctcatttgtaggagtaggattagattcttttgtagctagggttaggattagaccgtgttgacacttgacactacaatccaaaaatgaattatcgagctttgatccattaatagtactcctatattgcaagttgcaacaactatattcgtcgattttttattggggataatcttgaagcagctgctgaaaatggatcggaaggttaagtcgtccaggatcagagccctgttcaaccggcacctggcctcgctgggcatcccaaagagcatgcactgcctcacactgcggcttgccgaggagttcgcggtgaactccgcggcccgctcgccggtgccgctgccggagcacgcgcctcgcctggccgacgcctcgtacctccacgtcaccatcgtgacagacaacgtgctcgccgccgccgtcgccgtggcttccgccgtcaggagctcggccgagccagcgaggctggtgttccacgtcgtcaccgacaagaagagctacgtgccgatgcactcgtggttcgcgctgcacccggtttccccggcggtggtcgaggtcaagggcctccaccagttcgactggcgcgacggcggtgccatcgcctctgtcatgaggacgatcgaagaggttcagaggagctcaatggagtatcaccagtgtgacgcgtcagttgtcagggaatacaggaggctcgaagcctccaagccaagcacgttctctcttctcaactacctcaagatccacctcccagaggtataaatcaaggcaacaattggacaaagatcacgcctacatgcctacatttgcctgacattaatttgacgtctggagatatatctgatgcgttttgcttgagcagttcttcccggagctcgggagggtgatacttcttgacgacgacgtcgtggtgcgaaaggacctgaccgggctgtgggagcagcacctcggcgagaacatcataggcgccgtcggcgggcacaaccccggcgaagacggggtcgtctgcatcgagaagacgctcggtgatcacctgaatttcactgaccccgaagtgtcaaacgtactcgaaagtgcgagatgcgcgtggtcgtggggtgtcaacgtcgtcaacctcgacgcatggcgaagaacaaatgtcaccgacacgtaccagctctggctagagaaggcaattagctctctgattctcttgaacatggatgccgttttcttggttacagtactaatgacaaaacatttttttcccctgtgactgtcgcgtgcaatgcagaaccgggagtcgggattcaggctgtggaagatgggctcgctgccgccggcgctgatagcgttcgacggccgggtgcaggcggtggagccgcggtggcatctgcggggcctcggctggcacacgccggacggcgagcagctgcagcgctcagccgtgctgcatttcagcgggccgaggaagccctggctggaggtcgcgttcccggagctccgggaactatggctcggccacctcaacagatcagacagctttctacaaggatgcggcgtagtcgagtaacacagtaaacgacacagcagcaattgagctgggaaagagtatataagtatagacgatttggttcgagatctccatgtggcgcagagctgggttcatgtcttcatgaggagagggaagtaggtgctgccttcagtctctcctcgctctggctctacgtgcaacatgttcagtgacacagtgtagaattgtatagtgacgatgtatataagggctgttatctatttcttggttatagaactaaatgaaaaactagatgcaaccacacgcatttatagaataactatgtcactgaatgaaaaactaaatgaaaaatgatgctagacatggtagaataactatgctaaacatattagaacaatactaaaattgaatatcaagcacagtgtagtgctggtgcatttgtttggtaacttagcagatgtacaatatgaatgtgctagtatatgattagtgattacactgtaatataaaactacttttctgagaacaaaacacaatcaattaatcacgctctctcagaaagactccacttgagtagtagaatagatcattcttaatattttccgatacggtcagacatatataattatggggaaaaaaggcttgaaatttacagccaaatgttaagaactgacagaaaaaatggtagctttggaaccttgatcgattgctactccatccgcttgagattataagtcgttgtgactttgatcaaagtcaaactacgcaaagtttgacttacacaaagtttatagacaaatatagtaatatttacaacaccaaattagtttcgtcaaatcaataatctattatattattaaaggaatagaaaaagaagcctccacgttcactctaatggcctagaaattctcacattaatcgcagaaaaagaaacaaacagagtccatataggaatacaatttaataatagctgaaattcggaattaagaataagaaataggaaggtaagactagagtccatatcggtatacaatagaactaatagaaattcggaattaaaaaataagaaaaaataaatgtagaggttagagtccatctagaaatataatttagaaattaaaaaattcaaaatttaaaaaatattggatgaagactatagagttcagatagaaatagaatttaaaaataattaaaattcggaatttaaaaatattgaaagataagtttagaatccatatatagaaatataatttagaaataataaaaattaggaattaaaataaggaatattggaagaagagtatagaatccatacaagaatttaaaattcagaataaaactaataaaattaaagtagaatttggagtactaaaattagaaatttaaaaaaggaatattggaagttcgctctcatgagacacgcaaaattatgttgtcattttaatatatttgaataatacattgagaaaacatatatattattataagacagaaaatataatatgatgtgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcggccccgagggccgaggcgccccgaccccttgtggattttgcgcngngnatatggnnangnnagnnnancngcgctcacctaaccgcatttattgcggtttggacgagcgcgtcacgccgcatgtaacgcagtgcagcgcgctcgttcgtccggtctgtgatcagtcacagaccggtcagatcgtgggctaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagagcgaacatgcagattgttaaactgacacgtggtggacaagaatgaccgatttgtgactggtctgacaatggtcatgtcgtcagcagacagccatgttcccacgtcgcgcctgcttccggcggaagtggaggtaggtatgtgccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaagggaggagaggagaaacgatcccagaacgatcgggggctggctcgcactttgtagcttcttcatacacagatccaccaaaacacaggagtagggttttacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatgatgctagccacgcaatctgcgcgggccaccatgctaattaaatatattttaacaatatagttgtcttggattaaaaatgttactacctttttttacaagctcaattaaacttagagcagtttgactttgattaaagttaaaatgacttataatctgaaatggagggagtacttcttagaatcagtagcacaagtaaggttgatgtagcaggaaaaaaaatgactgtttgagttgctgaataatgccacatgattcttgtattttacctgttaagataaattgttttaacaggtaaaatacaaataagttcctgatgttagctccaacggccgagatagcaaaatattagagaatatactttctgcattctagtatcacatggcaaaccaaatgttggcatgttgccaaataattgaagtgatggtggtaatactgaaaaagaagttgtatcatctgattcaacgtattagctcatcgcaggatattttttagataaaatttgctataagacattcaaagattatggtctttgctatgagacacccgaagaacgtgaatcttttcatggacactgtaaaaatgtggtaattagctgctggacactccttttattattttattatttctagttgaaacggagagggaaatatttgtaaaaggcaactttgcccttgggtcaatagtgtttagcccgctgtagttggtttgaacagacccattccccattcagtctgatgatcccctatcctccaaaccctagggttaggtgcggcggcgatctgcggcaacggcggcgagctccggtgactacggtggcagattgaggtggccggcgagctgggccgctagcagattcgagcagagaagtacgatggaggggagcagcggtggaagcggtggaatcgagcggttgattcgagcagcaggggaagaatcaagaagcgagatggatcaatcattgtacatgggctcatcgtcaacgcgtaacccagtcacaggcgaggccgcggaggcagatgcagcaacgtgaggatgggcggcggcggtggaggccgcgggctgtgcctacgtctgctcaggctccggtggctccgccgcgctgtggcgctgtgtggcggctcgcggagctctgcgtcgtggcgctgtctggcccgctcgtggccggggcggcggcggcgcccgacgcgccagtaccgtgcgccgtcgtcgccgttgactcctacgccttcgccgcgccgttcgtcccggccgtgctgctgaagcgcgcgagaaaaggctactaattacacaacgcctaagtacatatacgtgacagtttattaacaccaattatatgaaagctatgaacgctataaattctgtccaattctgtacttctgtgtgtatacaagccagccgattgttgatccatcattgaaccgatttggtgcctgaaagttgtgacgttaaatcatgtcgaccagcgtttacaagcaaatcggcgcagggggcattttggtactttcatcattctttctctctccgcttcagccaaaaataataaaataatgagaggagtgtccagcagctaattatcacatttttatagtgtcaacggaaagattcacgttcttcgggtgtctcacagcaaagaccacaatctttaagtgtcctgtagcaaattttgcctatttcttatactgaggctaagccaaaacttgaagttttttttaatagctactcctctcctctctcccaccgccgcaccgcgtgctgctcctctcggccactgagcttgcgcgctccatggccgacaacagccttggtgcgactatcattgccggatccgacagagaactcgatagctcttcttctttgcacgtggagagggaaaaaggtggcggggggcagtggccaacccttctcgccatcgaggggagtgggaagggaggaggcagggaggctggcgagcgggcggaaaagaaatgaggccagcgagtggggcatggagggcgggagacgaggagaccggactaccccgcgaccgtcgccttcagacatcgatcttggcgagcaggcatcagggaagcccggaagggcacggggatcgtcgtcgggccaaaggtggtcgtcgcagcagcaggggaggttgggctcgttgtacttcggcgggagcggctcggacgactgtggcaacaacggggatgactccgatgactctcctggcctcgccgcctccttcctctccacacgctcgtctagttttgactcaccgaccattgcccttctccctctccgtttctccgtgtgctctcgcacgtggagatagagaggagagtgggacccactaacatgtgggtcctatttttatttttccttttgtctggctggcatgtgggcccatattttaaaaataatttatactcctactttatattttgcttacaatgccacatcacagccaccacgtaggataatgaccaagtcaaaccagctatgtagatgccacgtcagtcagaaccgccatccaaaccgccgagattgctcatccacaccggtttatctgtattgcagttaagggatgaaaattgaactcgcgtcaagtaaagggcccacggggatttcggcccgcccgaaatgaacaagccctcggcgtcggcgctctcctcctcctcgtgagttcgcccgccgcctgcgccgatccccatccatcccgtgagctagcagaggcgccgtcgtggtcgccgtcgttcgtcctgctgcttccgccgcatcccggtgagcatccatcagttacgcgcatcctcttgctcatctctccctacccacgcgctttttcctccaatttgaacaccctttgtttctcttctagacctggaagctcttctcttaatttgccttaaacctcaatactaatagcagtttgtttgttcccccagatccgccactgctgaacggggtgctttcgccatgtcgaggctgcgggcgctgtggcaagcctccgttaacgccaccaggcgaggtagctgcctgccgcaaacctaattttgccgcgctagtcgtatgctgggtttatttcctcaaacgaaactcctttacctgcgtttgctcatttttaaggccatttgaaatgtttactggaaaggccatatgagatcctcaaatgatgaataactatggcataaggattttagacacgggatgggaattcaagtgtgtaacagctcagtactagttatgttgatgtttattcagacagttggaggtttcttctagcattttgatttatttaaaatggatgctgctggatcgcaagttggcttcagttgttagctatgacattctaagatgcttttaatcttcatttagagtaataactcattatgtttgtctatgtcataattctttcatcctacatacgaaatttgcagccattgtgtggaattcagaagacctaatcccaccaagtgaaaagtacatcttcaattttaattcaaaagatgagctgaaaaggtggcacttgtattcagattccgagtatggaggtaatgcctcactttcaagtttttctttgcacgaatattagttttcgtgattgtcctgaataactgaacggtagaatagactaacttatattgtatatgttgtgattgtgaggtactcatggaatattcatgttctaagactttgcctggcactggaaatgttcctttgtttttattctcagaatacatgggaaaaatatgcaaattcccaagggctcaatttttatatgtatatgttacgattcaaagtttcattgtgattctaattctatgcatagaacaaaaatgaataaagctaggaaagttctctttcagagaacatcagaaaaaaaagttttctcttgaattcttgtagctcttgcagctttctaacatagttcctggatattctgacatagttactggattagtcgatcacttttagctccattcttgtcaagaggcttcactgtatacttctctcagacgatacatttcactatttcagtgtaaatattgcatgccaataactcattgatttaatgagttttcccttcgtttttcacctacatttggtcttttactttgtattaccaagaatgttccacaaagggctatatctaatacaaatatatgtggcttactatctgctatagtgatccaaatgggaatctgcctgctccttgtgctttcattccctggatgttctacaacggatacatcagtgtagtatcaattggtagttgctaaaccagtggattagatagtctgggatgtaaacctccttcaatatgatgggtagatcgttaatgcttcagtgtgttgtgatatgctggtgccttagcctcacaatagtacctggaataaacaaatgtttatttctttgtgtcttttgggtgggtgacctttctggcatgttcattaaacttcactaatatttgttggcacattttgtaactgataggcaagctctttattcacatctatggaatgatttgattgaaaggaattgttatccaggtttatcatctgcatcattggagataactgatggtggtgctggtggggatacttcatcaactggtactctgatgttttgacgtcccctttttcagggtttccttagagtgcattttcagtacaaagagggaaaactggaaaatagtttatttatctgctgttatatatagcttatgagtacaaattaacctgttgaactatggagtgtcttctagtgttgttattctcatgaatctcatatgtccttgccaacttaccagataataccagcttgctgtcttggcttttgtaattggaaagaaagcggcctttttttcatggttttgttagatttcatgcctgattcacttaatttaatttttataagctttgacagttttgcaactatttttccaacatatgcattctggaaggtctcttttctggcaatctctctttggatatgtctgagggatcaacatggaagataaggcgtagtggtttctgtggaatgagatcaaagaaggtaaagtgatattgacttggtcattgctcaatatctgtagatgctattatgctgataaacccttatttctttctccgtttcagtttaatggtttcattgatcttgatgcatatgatactatagcgatgaaactcagaggggatggaagatgctacatatctactgtatgtatcctcatcctgagacagtattgaatgtgcgatatcaagttaatacgttgctatataatctgaatcttaattaaacagatatacacagagaactgggtgaattcacctggacaacaggaagataattcgtggcaagcctttgtgtacttaccccaggacagatggcaaatcatgaaggtaatttcaattcgaagttgaaagatatggtttttgatgatacgacagcacttgtcctttctttcagatccctcttgattcgtatctacccacatggagaggaaatgtgatcgaagcaaagatggaaatgaaccctgctcgtgttgtgggaatgtctctatccgtaaatgctgagggcggtgtacctggtgcaaagactggaccaggtgattttaggctagaggttgattggatcaaggcattgaggacactctgaatttgtggtttccacaaatcggtctttttgtaggatttctcagggctggaaatttcttaccggcactttttcatgtgataattgctgaatatcacgaggcatggagatgcgtcatgcagtttgtattactcctagtcaatacaatgggacatcgaaaggaggcaactgttcagcgcagatgaataatgaggtctcttttgcttttgggggaaatgaatatacaaatgtatcacctgtttcttatggctgtctgaacatacgttacttccttgctactgtgtccgatgaatttttatccattccgcatcaactgatacctgcaggagacggtttgtacttggcttcccattttgcggtggaactggcgagctcgtgcttggtggcggctttgcccgcctgctaaatttgcacgttttggtcaaacaacacatgcattcattttcaggtttccgtagcagcaaaaacaccatgataaattggcagtgcacagccgcaacggaaacttctcagtgcaatcgtgcgtggataaacaaacaacggtggatatttcaaaaacgatctttcaaacaaaaaggtcgatatttcaaaatgcattttcaggaactgtacacaagacacacttgaattagtccataatcagaatcctaactcaggcacacatggcgaagcttcctttcctacaagagcaatatttgctcatggaccacacgtccacaccatgacaccgcaactaattaaggggaacgaacaaaaatgggagcacccagtgcaagccgagaggacgacggacgggtgtttggcgaccagtcgtcgtccactcctctgcatgcatgtgtgcacaaacgacgggtcagccgtgccgggtcatccttcaatgaacccggtcatccgcagcacggagttgcgcaggtggctgaggtcgcggcgcgcccgcccggtccccgtccgcagcgagaacgcctgatccccctcctccgtcgaccgcctccgcgacaccatcacgtggggcggcaccatcgtccccccgccgcagtcgtcgccctggtcgccgccgctccaccgctgcgcggccctgggaatgtccaccggccgagagctcgccgtggagcagtggcgcgtgatctgctgctggccccgccgagccggcgtcggcgcggtcgccgtcgccgtcgccgtcggcgggacgacgtcgtgtggcgactggtgatccggccacagcacgtcggactcgtacagctcctctcccatcgtcgccatgcgcgcgcacgcacgcacaaaccaagctacctgtgaagcgtcgatgcgtttggggtttggacgtttgggccttggtagtttggtttagcttttctctctgtgcgacgacgagcgcccgcggggcgtatatataggcgtggtgcggctggcgccacctacgtgtcgagtagcttgcgacgtacgactagccgcccgccgagccgcgcgaggaaggaagagatgcgcccacggaaagggatccgggttctatcgggtccggtcgttcggatcggatcagatgacgaattcaattacggagtcaacaaaaggctcgtgtcggtcaatacaaccaaaataaacgtggctcgtctctttgccagagcggccgcctccttcttttactgcccgacatgatgatgaaacggaaattggtcgtacgtgcatgcgaggtaaggaaggtgcatgcttgccacctgcactgtacagctagtacataacacagcgggcacgggcaatgtgcttattactcgtgtgggtaagttctgacgggattaaagatttcatttgtgattacagacttgaacccaggttaaatcgaagactaacctcgggtgcctcagggtcatcatcgcggagcgtccacgcgtcctctgccacgcatgtactcctactcgcgtaatctcttgcatgccttccgctgggaagcaagaggaatctaggggttagcattcttaattccagctttacctttctcttaagcatctatatcaccgctaaatattgcaaatttattcgtggttccttgctagcaacgcacgatcgcgatctctgtttcgtcgtttgcgtgcggccaccgagtccgcacgcaccacacgcggatatgcgtacgcggcgcccggacggaagaagcatcaggctacaggctgggaaggcttccacgtacgctgcactcaacgcgtcctgtgccgaattttttatttataatactaagtaatatttaaattaaataattagtaattctctaggaggattaaccaaaataggatggacgatcattcaaacagcgtccagacatggatgctactataaacaacgtccacctttctggtgcagtcagaccatcactacgccaccaatacgctaagagaagtatctatctatctatcttctattatatactaaaagtccattaaactttctacaaaagctctcaagccgccacgtggcgctcctacaaacgctcctagatcagcacgaggagcttaaacatccaaccatcggttttcatttaatctggtggacccattatttttaaccactagatttttattttaagaaaaaaacaaatcaatctatctaaaaaaaatcccacgttactcggccgtgtcccggatctgtacgtccgtatgtccgatgtacgtacatatcccctctatgtccttttctttttctttcttatatacttagattagatgaaaaaataaaaagttcatgttaaccatatattttaagttgtaaaaatatatgttattttaagttttattctaaataacgcatctcattgaaacatccataaaaaatattaataattaacattatagactatatgattgtatatcacaattaaattggacttataattaaaaaacaatttaaattttgagtagcattttaaaaatttactcactccctattgtgtaatactgatatatccaaataacattattaaatttatcaagaatgtattttcatatattctatgtttctgtattcatattttttttggaaaattaacaaccatatatattttttacaccatgtggatgcccttttatctcttaagcttcattcggtctatctcattggataagcttatttaggacacgcgaaacaaagcatgccatcagcgtaagattaattaagtatcaaatattgcatatcctgtgcttatctaagaaaaaatatatagaaaaatggttctatacacccaggagtacgtactgtatatatataagggtcatcctatatataaaaaataaaatctagctacttatttatacataacccgtggatatattattttcaaccattattttatatctatatctacgcaagagatgtcataaaggaaaaaaaagaagaatgtgtacaagatcagctccatcgagtagttttttctttctttctttgtggctctgagattttcctcaaattgtgcatatgagtagcaaccacccttggcgagtttgtcaaagaattcacgcggccgcagcaccgcttcacgccatctcgctaaattttttggaagtatttttttactaatgatttataaggcaatcacgtttccttaaaaaaagcaatcacgagcgcatatataaacgtgtgctcacccatcatataaatacacatacacacacctaccctaagagaaaaaatatttgtctccaaaaaagggaaaaagtatgtgcttagtatttgctagaaaaaaacatatacacatatcatcgaaaatgctgcatagaaccacattatatctttttaattatgtcattctcatctatataatgttaataattaggacaaataattttgacaatatagattattccatcgtatattacccatgaacatacataggtaaatcagatgtataataaaagaaaaaacaaaacaaaaaatatattagtttatatgtttgcgaatgatggtgagagatcagattatatataaccgggacaattcgtaccgttcttattatttaagggtgtaatttagactttttccttaaaagtcttccacataaggatttataataaaaaaaattaatcaacactaaacttcctacaaacgcttttaagcctccacgtggcatcctataaatattcctaagccgccacgtggcatcctataaattagagaaattcttaaaaggacacaacgtataaccgttgatttttattaaattttgtagaccattatttgtaaccattagatttattagaaaaaacatacttatccctaggcccacctcggccttggcaattgcatgtacgtacttacgtacgtctgctcaaccccccccccccccctaattctttcaccccttttttcacctattttttctcctatttttaatcttttagaaaagaaaaaattgtatgccaaataattaagcaaatgcagcatctaaattataatgctaatatttgatctgcttatgtctttagatattttatattttaaaactcatgtcctctttaattcaactgtaaagagataaatgtcatattaattggggctacattttctgacttttgcgtgtcatttaagcaattttaaaactaaaaaaattaatgatatatatttttgtcatcgtatataacttgataataattaaattatatctaataaaagtaaaatgaacagatctatgagtaatattaaaaaaatagcccccgccccaacgttgtaacacagtaaaaagtacacatcttataattacttctaagatattatgtctttctcttaaatcagagaaaatacactcttaagatattacgtcgttcttttaaataagagaaaatcgtaaaaattctgacaagaaaacaaaacattcgaccatcagcttcgacttaaacatctgacacataattttagtttgttagattaatcatttagaaaaagaacatccgaaatctcccttcctccctgctcgcgtacaacgtgcgccattcttttctctctattttttatctccttatcaactgaaattaaaattatctatatgtaaaaaagacacaaatagacctccatctattacttgtatcttgtcaggcgtctaacgactttctactaacttaattaatttctcttaacatgcctatgagggctatgtacctatacaaattgaccttgatacttttaaaacgatcttattaggagataaataaatatttataagaaagatgatcatagcatcccaattacacatatgatctatgaagtcactaatcataataggtattcatctagcaatatagacaataggttaaaaataaatgtgtggccagttgaacatcataccaataagtatgtgggttacacctaggaatcttaacagtgaaacaaccttgaggcggcctttacaattggaaattgagcaaatgttgctagatttaaaacccactgtaaatagaaaaattcaaacattttctgagttctgtttgaatgaaaaaatatataaaataaaatacaatcaatcaaaaaattgatattattggatttttttgggttgtaagatatcctactggggagttaaatgtcctgaattttcttataggaaccacctcctttgtttcgacacaatattttctcatcaattgaaaaccgcatgttctcaagtaattttattttagaatttaaatgttacaagggtaattataagaaaataatcagcgctcaaatcacacaaaatacatttaactttataatataataaaaaatattttaataaaaaacacccacacttaaatattcataataaaatttcactcatcatataagaaggtgcccgcgcatgtgtgcgggctatctttctagttgaaacaaaagttgttcaacctagctagggtcagggatcaccggtgtcgtcgtattcgccttcgatcggggggccgtattccgtacgcttcaccctgcaaaccacgtcgccactgttactgtccttgttgacgccggcgccttggatttgtccattactcagcgccatcaatccagccacggcgtcttgagcggcaagttcgttggctgctcgccggcaacaggtgaactgcaagacatgcatgtatttcacattgatctacttatgtctttcggtgggaggcaacaggtgcccatgcatacgttagctaattaccattgatcagctgctgtatacattgtgttcatatgtactttatcaggataatggaattcaacggtctcccaggagtcgagcagatagcagcagcagcctccggggaggacaacaaccttcggcctccccaattgaaagccgccaatggcagcctcctctggaatcgatgcgggcggtcgtgagggcctcccgggggcgggcgtctgctacagcctctcgatgttgaggcaaacggtggaaggaggcaacggcggcggcggcaacctaccctagcgccgctgtaatttttcttccttttttttctttcgcttggttcgctgcatttgaagtggctacaccggtctggacgtcgtttggattagcgtccatccgcggacgctgtttacaggagcgtcctgatgcggaagctgtttagaatagcgtccttcttattttggtaaatactcacaaggaattactaattatttaatttaaatattattaattattataaataaaaaattcggcgtcctgtgacaaggaaaggggaaaaagggggacaaaaactaaacgagaagaaagcaaaagctattagctgtgcgagacatggccaaatgggagggtttaacttagcgtacgtgaggcttggagagtagccagatgtccagatagacgctctctatcaggcattttaattctccagtttccgtttcccttgaagcaatggttttgctctgcacttcggtagtggagtagtactttcagtttcagattctaaagatgatgaattgatgaattacgatatatgatggatggtgttcaatgctgatgcaggtcaagttatgaagttaatgttttacatttatctttaagctagacatgcgccagagtctgatggagcaaagcatttcagattttcagtaacaacttgggttttcttcagtcgcatttccaagccgaaaatggagatggttgacagtgacaccataaaagaaaaagaggtacttcatccgttttttaataaataataacactgttgacattttaacacatgtttgaccattcatcttattcaaaattttttatataaatatacaaggtataaatcatacttaaagtattttaaatgataaaataactcataaaaataaattataatatattatatactaaaagtccattaaacttactgtaaacgctctcaaaccgccacgtggtactactacaaatgctcctgggttgccatgtggctatctaataaattggtggatccactattttaaactattagatttatcttaataaacttttaaaacctcacgatccatctctctcctttccctaatcggccgatgtctacgtacgtaggtttttctccggttctatgccggtggacccaaaaggaaaagggccgggaaaaaaaaacggaaagaacagatttgtacgtacatacccggggagccaaaaacaagcaccactattcgatgggaaaaaaaaacgtgcataggcaccaacgatcgagtaaaacaaacgatcaataatttcaataaatcagtgaacccactatttttaccccaacaaaacaagtacactattcgttatttgacaaaaacaacacgaagaagaattgtacgtacacatgcgtatactatctggaataacaacgatcaatccaactatatgactatttaaaacatggcatatttattttatctataataaagaaaaatatatattacatcacttctacaaacacacctaaactatcacgtgacactctaataaattagataaaccttacaaattctgagaaaaaaatccaatcatcgatttttatttaagaaaaaaggaaataaaacgtaattatgatttagagaaggattagccctgccacagtcccacctaattgctacgagagaaacgtactgttcaccaaaaaaaaatgaaaaatacgtacatactacgcactgtctttccctacttgaatctttatgcatgcaagtaacatccaattgtccctaataaacttatctaaattagatgtgtatagtgaaaaatattatgactatatttgatattaactatatttcaatttaaaaattatcacatggaagcatatttagctctttgtccattaaacatcctataaacgctctcaagccgccacgtaatacttctacaaacgctcgtacaccactacttggcattttaataaattagaaaaataaaaaattatgagaataaacaaaacatctcgcagtcaattttcactaatatacggtggacccattgtgcttacgtacctccccacgtatttcctttctctcctattttcctctcttaattagatggaaaaaatattttacgataaagaattttaaacaactatattatctaaatcatatatagctaactttttaattagtgtacaccattatattatctactataaaacttaaaattgaagatccaagttaactatattattataaaaaaattcattacttcgagtcatatatattctgtggactagctattgttcaccgatccatacatttttaagaaaaaatcaaataaatttttaaaccttctgattaataacatacacttaaattagaacaatttaaaacattttaagtagtttaattaaaatacaatacccaaagtattttctaatagatctaagataaatgtatttataaaaatagaaagctcaaaactatgacatattcaatctatcttaaaaacaataatctcctcccatcctcctgctttacttacacctctaccctccccctatgactctcacatcctctcctctccaattccattatctctatttctattttttttaactaacataatgcagaaatagtcataactattgttttatttataactaaataataaatcaagatcacactagctatattttactatataaaagttaaaatacatcatttgagggtagaccctaccatttaccttacaaataaataacaacaaaaattaattgaacatatgtattatgttatactaaatcactgtacataataaaaatcaattaaatgcccccaaagcgctcataaaacacaatatattatgtcttaagattctaagaaaaaccaaataaattgacgtatccattattttaactattagatctatttttaaaagaagtcttaagtcgccatgtgtcacgtcatataaaaaacagaaaaaccttagaaattcttagaaaaaaatgaaacaccctttcatcggctttcacttaaatcatttaggaaaattagaaaaataaaatctcctacaccccctccttgccttcgcacgcacacaacattgtccgtcccctccctattttttatctattaaattaaaagagaaacgatca

SEQ ID NO: 74845 - DNA, 576 bp, Oryza sativa
  unsure (1)..(576): unsure at all n locations
catctcnatactngaataaacaaaatacgagaaaggaacnancaaaaatcacccccccccncaaaataacacatgtanntnccnnnnnnnnttnnnnaannnncgggnngggggggggggggggggnnnnnnnnnnnnnnnnnnnnnnnnnnnnnnnnnnngnnnngnnnngngggggggggggggggannnncnnnngnnnggggcnnnnnannggngngaannngnngggcgggggngggggggggcccggggggggagaaggggggggagaaaaaaaaaaaaaaaaagaaaaaaaaaaaaaaagaaaaaaagagaaaagaaaaaaaaaggaaaaagaaaaaaaaaaaaaaaaagcagagaaaaggagaaaaaaaaaagacaaaaaaaaaacaaaaaaaaaaaaaaaaaaaagaaaaaaagaaaaaggaaaaacacaagaaagaaaaaacaaaaacaaaagaaagaaagaaaaagcggaaaaaaaaaaaaaaaaacaaaaagaaaaaaaaagaaaaaaaaaaaaaaaaaaaaaaaaaaaaaaaaaaaaaaaaaaagaaaaaaaaaaaagaaaag

SEQ ID NO: 74846 - DNA, 675 bp, Oryza sativa
cttgctgtaagtcttactgttacaagtttctttcctagttcatcacgaagcattgctttttcacttgtctgtgagagtatggagtgtatactaataatctatgccaggacgagtttaatgcatcctaattcatctgcatctaacgtccacattttcatcttaaaaacaatccctgtatacattttcatcatatagaacatcacagaattcggttgtatgtcactgttgagatgtttggtagtttgttgtacaatttctgagatcctcaattgtgaaacaattttcttgattgtcatgcaggctgctaaaaggcatttgactcagcgtattgaaaggttggatgataaattggatcagcaaaaggcgctttctggacaaataagagatgatgtactttctccttaacattcatatcaatccatgtttggcattaacatgtcttcattttcacgcgcatgggttgaataattaagaaatgtctagtagcatatgcctatatgcaattattagcccaattatattttaagatgcactttttatttctttttagggaagtgaactgtgagaacttacagctaagtacattcttgttgtatcattttcacttttcaaatatctacttttttatccaggttactgatgcacgactgaagcttgagaatattggttcagaaa

SEQ ID NO: 74847 - DNA, 753 bp, Oryza sativa
tcctgcagcccacaaacctttgtactaaagcatgtaactgatccaacatgaacttggaaggtgatgacatcaaatttgtgttttatctttgttactgcattggctgtgatatgctgcagctccgccgacgtataagaaacaggacggctgaaagccaaacatgggaatcatgctttgcttaaagcattacagtggaaatctgacagccacagtgaaagctaaatacccaaaggctatcaaagaataccaggatcaacatattagccaccaaataacagcacacgccgaggattaaaaaacggacgcctatgataagagtggatctagaaacatctcatcacatcactgttttgatgcaacgtaaaaaaccattagcattcatttctccaagaaagtatctgaatcccggtggttcaaatgctcgccatcaatattaacatgactaacattaatgaaaaaaagcaacacctatcttcccgggggtgcagaaggcagcggcaatattagtttgcttccgttaatgagaggaacgtcggtacgtgagtctgatctcccttttcttttcacctcaaacatgaaggatcaaaatggaaagtctgcacaacaaaatatgctgtcaggcaacgcaatgcaacatttgacataccaaggttacacaaacaccagtctttcagcaactttagaagccagaagatactaaaatgtttgcatgcaagccaaatttcttcatatgaaaatttgaacatacatctc

SEQ ID NO: 74848 - DNA, 4458 bp, Oryza sativa
cgctgctgaagtcaagcttcccggtttagctcgctgttatcttttccgctgatatatacatacaacggaggtagccatttgcaccatatccataatatacaagtaggtagccattcgcaccttatccataccaggacgatccatttgcaccttatccatatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccacttcgatggtgatcatgtgcctggtcatcttgagcctcactgtcgactccgccaccgcggcacagtgcggctgctgcatatcctcttaggcaaaagcatgttgtttcggttgtactgctgctggtggctccgactcagtctacaagaacacttgttgtttcccatgtattctggccgattctggtaaattcactaatgtcactctatttaatgcatttcttacatgtagatacagactttgtagcatatcgtggactaatacatatgtgtggccttccatgcattttcctcaatgtgctttgttgatttcacttccaatctcacgacttcaggcatgtatcttgcaacacgaagacatcttatgctctacttccactacaaaattaactaatgcgctaatgggattttcatattttaatttcatagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattgttgaccatatggggcgatctatagtggatccatctgttggtctcaactctatgtatgtcgtgcatgtgtgcgctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactatgggacataattaagattgtcatgccaaaaattattgcaaaacctagtaggaaagcaaaagaggcgggggggggggaggaaacatgatcaatttctcggctactatcacattcctcgttttctcaggtttgggagacatatagccacactaaaggcagtaaacctgaggaatgacaaccttactcacaaggacaaatagtcgttaaaaaacaatgacatcactaaccatatctatttcagttcaccaaacatacatttaaatttaggcagtattacggagaactaaattaacaaacaacaaaccatacttcattgtcaaaacaaattgccttctatgtacttcacaaattctcacaagatcatatttgcaatttttcctaaactaattaaccaagagcaaatatgcagtggagcattccacatatatttcacattataagtacataatacagtatggtataatacacatatgcatactaggggcctacggcaaaagaggcaaagatcaatgtgcatgctaacttgtgtataatacacatatgcacagtactttgaaataagcataccaggacatatgcattagttcacaccattcattcttgcattcttgcactttcaacaacaaccagatctaccaagcattcttgcacattaaaccacaagtagatctaccaatgaatcaccaacttaggtagcaatgggggtaatcgggggggaaaaccttacctcgtcagacgacggaaggacaggagatggcggaagattcatcggctgctcaccatggcgcgcggatccctgaggtgtgggcatcacatctatcagcaccaacgacatcggcgggtgggggggggaggaactggggctctttcatagaccgatgtaaactagacttattggcttctatttagggagaggaaggaaaagagatagactttacctggcatggcttgggcctgcacggagagggatagtagttggcttggtttcagccaaaagatatgaagagaattttaaattgttttttcaatttaaataatgaccgaaattatgttagtattattaaaattatttctttagctcggaaaatttcaagaaaatttaagagagcataattaattattgagaagttaataaaactattccaagtcatattttacaaggtaaaattttatttcacatatcaacttgtaacatacaaggaatttcaccatggaaaaattttgtggaaaatttaaaacattttgaattcaaaagtttttggtgaacatagaagcatactagagcatataactccctaaaataaaataaaacacataatttttctggccaaatcaaaactaagtccaaaagtaaaagtttacaaatcttgtggtaaaaaattttgaaacaaaaattttgctttgaccataaactagaaacctaatcttctcggttttgcattttcaacctaactaaaaaaatatatttaagttaaatatcaaacaaattgaaaggtaggtatcaaaatacgcaaacctaaattgagataaaaagaacttgcttgtatctgcatattattcttttaagattgtttttggatattcttggtacatctcataataggttgcatatgcatgctttgtctaaagagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcaaaatgttaagcatactttactctatcatctggtgcaatggcttagtctaattcgaaatgtaacctcataaaatgagagccataagttaggtaaacagtattctggactgtggtcaatagattaactagtcaactttactaaattaccatggtaaaagcaaaagtaattaaactttggaacttggcaccttgaaccatcaaatccttgtctaccttgctgtctccctgtcaccccccctcccccggccttaattctaaattaaatggatgagagaaagagagtaatatagtttagtgtgatagtgccaacacatggaaaatttagagcttctagttctctccttctacatctctcttaaatgtgggaccaagtccttatggggcccactcatcatacaaccctagccaacacatcatctgctcttctctcatttaaatcttcttttatttctcaaaaggtgagagaagggtttaaattgaatttccacccaaaatgccactctaccactccaagccttctaggaaacatctatatatgggcctatttgttttccaaatacctacaaacaaccttggtgaatcatctctttgatcctaaattatattttcaaagagacaatgaaagagagagagagggagttaaagtccaatttacacccaaacttcaccatacctctcatcttctcctaggaaacatctacatgaggccactagacagccactcatacttggttgagtgaagtacaagtaggatcacagcctcaaaccactgccaactcctttaaatcgtttctacccctcatgttgacaactagctctcactttgcaccttcacttttaccattcactactacaaccaagatttttgtgtgagggctaaaatgatttttgggcgcgggtaggcggcccacacgcacctaggggtctgggaaaatgatgatttttgcgtgcgggtggcgcatccccacgggaaaacaaaaatccgaaataacataattttttttaaaaaaacgaaacccaagaatccggcagtgggcttccgcccgacggccatagtgccgcctgcctcccgccggcctccgcgccacccgccggcagatccgcgcttccctcccgccgcaatgccgccgacgcccctcccctctgccggatctagggagggaaggaaggggagaggaggggagctggatcccgcgtggggagatggcggccggctgccggatccgtgcggggacggccgccaccgctggattcttgcattgacggccaccaccgttggatccgtgtagggactgccgccgcccgccggatccaacgccctccaccgccgccacgtggagcaggcctgcgcgctcctactcccaccgccgtcgcaccgctgctgtcgccacacgccaccaccgctaccgccgtcgggaggagagga

SEQ ID NO: 74849 - DNA, 9686 bp, Oryza sativa
tgctgaattaactaattgatggtgggcatctgctttttatgtatcttgtcgccctactaaactattattcatgcatgcacaattaaactttttcttcttataaacgcattacaaatgtaggcgctcacaacacacgtgcactcacctctatgaacatatacgtacaccctatctctataagcatttcttgaagactggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaaatgcagtctcattttctttttcttgttccttcttcgaaatttcagcaattttctcgtatcaagaaaggaaaatttcagcgtgtttctgctgatgaagcgttgcatgtgactaagcaaattaaagcatctgtagtttctgaagccggaacctcagagcgggtggatcggcgatccaaatggggtccgaaccccatttgacctctatattttctcacacacgctctgcatatgtggctatatattttcttcttctcctggttcagtggttgagtacgtactttaagggattgatttttcttaaccctatttgattaattccttgtgatcaggcacagagactaattaattaagtaattaaagcctttaaaggaacgagaaagtaagaaacgtcctaatggcagattcagttcatattatattagcaaaagaaaagcagcagtatctgggtgggttagtggggattattatcgccgccaattaaaagaagagctagctagcgagctaagctaatcgtaggagcacccaatgggcaatgcagcaagtgatcgaatgggtaattaattgactaattaagcaagctttgcgattgacttgtggtgtgcagagcagatgacacacactttaatttggcttgcttaatggctaaggccaagccatgcatgcaaatgcatgtatctcaaggggtaaaaaaaaggtggcatttgcatacgcacttacacgtaggattgaaacatgcacgagagcaacccaatgtcatatatggctatatactcaggcatgtgcttatgtgcattggttgcatggggccatatatccatgcatcaaatccgaaggtgaattaagcagccaagaggcatattggttggttgcatggagcattcggatacatggcatgttcactttattatcatttttaactctattaaattggacactatcacaattcctagtaagtctgtaggctgttattttttttcccgtaaatgatctaaaaaaatttcgtcggtaatttttatcggttcacccatggtaaaataattttcgacagtacaatgtgttataatgtattttttttcgacagttttgggcttataggatagttctggtaactaataaactaaagataaccttaacattattatcctattaaatttggtattttcgaaagtatcttatcaagaaacactatacttagtctataaacgaaaacacataacactgccaaaaatatgctaaagctaaaatgtgtcaaaaatttaacattatcaaattttagtaagttgactttttaggacaaagtgaacgtgccaatatatccatttgaccaccctcatcatccatctattcattcgagatcgatcgattcgtttatttcgattcatcaagagcatctgcaagagacacatatcgcagcgaggaaatgacaaggaaaattaattatggagagattaactcgatatatccattccctgcaggatgcagctaacagtacactgaatatataaaaccttcgtcagaaccagctggtaaaacgccaccatagcggcatgcttatgagctgctttagctgacatcaactcttaattaggatgattaacaaaacagtaaatcgttttggaggttaaatatatgcttagtttgatcataatgtgttatttttttgaaccagaggggttcggtgagtaaaattccgaacccctggacctcctttttcccttctctctctgtcttttctttgttcgagatgcctcgtttttttttccttaggaaaacaaactgaacaaagcaagccatgggcccatatggcccaataaaaaagtgttttccccttaaagaaaggacccaagaaaaatgctgggccgtacgaaataatatctggcccatcgttgggcctacagatggtcacggggccagagtaattaaatgggcccttgagtatatggaaacttatctgctggtctcgtacaagcagacaggggcaaccaatttaattacactatctgattgttacatctgttcttttttttttaaaaaaaaagtcttgctactatcatgtaataagaacaataatagtctatctaggtactggaaataaaagtaattattgatttattggaacacataaagaaatgaatgcaaaataattagtactatagtaatatcgagtagcaaataaacagacgatgccccgcaaaaatgaaataaaataaacagacgatgagttgtgctacgtagctagcagatcaatcccctttgccactcacattgttggcgatagcatcataattaagcatatatgcatccacgagtttgaggaataatcgaattaacagtggcgtggttatcgacttatcgtcctttggtgtctgcgtcgacgttgacttcatcgctgtgtacgtatacgaatgcgcgtaattgtgcatattgctgtttacgttgaatttaaatataaaactatcaaaattttagccgaatttgattctaaatattaaatatttatgacccaaggagatactaggttgctgggcaatcacaatacacacacacacacacacacacacacacacacacacacacacacacacatatatatatatatatatatataaaacatcaagacaatgattcgtgcccatcctgtaaagtgagtcatacatatcgtgaaaattagctttagcttaccgtgctataccacaaccaaaaataaagcaattctctctcatatatttgatggacaagagctaatgcggacgtttttctatccattatagaaattgctttaacaataattaactattttagacccacttctataaaatcacaaatacaccagatacatcccgcttgcggtcaaagacacgtgactttgtcactgacatgtggaccctgacaaaaacatcgtgcattttactgcagaggatctcaattttaagatcatgcgtgtactgttcattcatgtttctctgcccaaagagcatgcatgttactgttcattcatgtttccctcacatgcgtaggtgcagatgccaactcgatggaacgatcaccttgggcgttcctggacctcaaatcatgcatatgtgtgacgtgtggtccgatccagaccaaccgtgcatatgcatatgctactgctagcttctcccataagaaaagccgagcgatcggtcggcaacccggcatccttttccctaggtggacatacaccgtgcagtcgtgcacgtacgctgcatgcagcataaaccgaccaagagacgaccttagaacatcttcaacagagttactatttttactatccaaatatctatttgatcaatttaccaaaagaattagagccggatttttctttcactacaataattctccgttacattctccaatctgacagtgcttttcatatgttggcatcctactctttttctttcctcacgtcttctcaaccaagtaaactcttaggctgtgttactcaactttccgtagtttcccatgcctcagttacttgtgatccgccgctccttgattccgccggtcttggtcgcttaattgcatttctgaaactagtcgagaaggcattaacaattatctaattaaatactatggacggtgtaaatatatatacatgatcaaggaaaaaaaagcaataaacatacatataatatatagtggtctccctatcatgagagtacgatgatactgtgcgagttttctaaacaacagtttagtccaaaccaggtcgccgtcgttagcgcgacagaaagtctagattagggatctccaacatcaactctcccgtgcatgcttgctgctttcttgctccacctaacaattatttatttggtacaacccaatcagtgactataaccaataaactgccaatgcacctagcactttattactactacctccatcccataatcacaattttacactatctactatcaatgtttaactatccgtctaattaaaaaaattataattaatatttttattattattagatgaatggtcaaacgttagacacataaatccacaactgcacttaaaataggatgggtagtactatattcatgatatattatggagtatataatgtgagcctcccagtgataatttttttaattatattatgtgtagtggcaccatctcaattgctttaagattctcttgattatatttagtgataatttattgttcttgatttatgcaagcactacacagacagtactgcattattgctactacatgtacatgcagtggtccatatacaaactgcattttttgacagtaggtggaaataaggacaggagaagaaaaaaattaatactactatactccactagcatctccatataaaaagccagcggaaacaacaatctgacaacagtttctgatcctgtgtgtacaacagtccagcatggcccacaagcagtcaggcccctgcacggggtggcccaccagtcagcaatggaacagaccgatgtggcgatggacgcacgagaggcatctcactgactgcaagttctaccgatcctgacttctaaagtgaaaactactgaaagtctgaacgtccgaaaactaatgcaaatgcaaacctggagactcaaattctgaagctaattcaaatggttttgcttgaaaactggaagcgtcagcaagaacctagaaaccgtgtttgcaaatgcaacacatggattctcaatttctcatactgaattcttgagtagcataatgttttcagaagaggtaaaatggacatgaagactcatcagaaacatcgaaattctcctccacacaacatcgatttcatgcatttaggaaggacattgatcttctgcgtattttgcagaataaagattgtaacaagaaagaatctttataaaactatctgtaataacttttttttctgtattttaatataaatatgtcactgccggcctgccgggcgaggctcgcctgtcagtgtttccttaaagagaacatacagatgtttcgattcgatcggtttgtcttgcttgttttctgtgatgcatttggcaacgatgttgtgatagctgtggagtcgaagctgctgtgtcgccaggcgacaagcccggcaacgataacatttgcctcacgaagtcgaagcctttgtatcgcttacaacaagctctttatcgatagctgttttgggctccgccatttttcctttttccatggtattggtagcttaggttagagtgttgtggttttcgtccagtttttccctaattaactgtgcattgtaaggtttagtctcgttttctccttaaaataagacaccttcttctttatataaaacgtcggcaacagcctgaccgttcgaaaaactactacttaacagttctgatctatgccagtacatctttctcattgacttgatttagggcaaatcgctggatgacgaagtgataatctaatatgttaattagctacgacaataagcgagcgcgggtgcctcaaacatgatgtcattctccaagtcatggccttaattaaacatactttctagccataatggaagcatcaactatatatatggtggatccctgatgatgattgctaacatgataaggccacgattaattgtcatcagaaagagggaactaaatcaattaaactgaaattttcacttgctataggtttatgggcttggtaggtggtgatacactagctagcacattgacaaataaccacgttgatctgacccatggaggtgaactttttccccttagatgaatggaatgaaactaatgctacatcacatccacacaaatgataaaatgattaattaattaaccctgtcactgcattatcataatagtaagtgctgctagagatagcgtggattttataattttgcggtggactctcggcggattttagaaactcgtgatggcaacacgtggtacatatgcttgccacgataacatgagtagtgccgcgtgtagttaacaagatagccacgttgtaggttatatcaatcttattgacacaactcgtgacaacactatggctacggcgttgtcatttgctatgatatcgagactatatgaccataaagggtacttccaacaaaagtgacacggccatgatggcactgtggctacgatggtgtcgttttttatgatgccgaaactatgactataatgagtacttccaactagagttgacgagagacacgtccattgataaatgtgatcaatggttatatgggtggatttataaaaatataaatgcatgagtatgattcaatatttggttatcaacgttccgctctgggagcgcattatacaataaatttatgagaatggcatacaataatagtatatatttacagcaatatatttttatatgcctttactatgttaagaattgtagaacaaataatgtgtccatatcaagatagtgaatggcacctggtaatttattccatgggaacacaaacattgtcttgctccaagttcttacatgttgccggaaaagtgccattgatcgagatggtaatgaatcatctcatcttgattggaacgattaaatcttttactaccatcatgatgtgatccattatttaatttgccagttattgttgtcatatatatctatggaccatctattgttatcacacaattttatgcagttaggatcagaaagttttaatccagtactcattatggctaaaaatcctcctgttttacatttgacgatttgaatattccgatcgatctccatagttttaaaagaacttccttatttgatgggtacttcttgttagataccagtatgtacttacacatgatttaatgacaatttgcatgatgcacgcagttgaatgcttctccccctcctacgtaaattggaacgggcagactttggtccaacaactcacatttgactttctcacaacgatctatcttctgtagactgcgtacttcgtcgccagccaatgtgagtgtcatacatttcaatgcttcttaacacgtagcagtaccgcacaataactttgcatatgccccacaaagtaacaaatgtctccaaacatttatgtgagtaattatagtttaatataatataaccttattgttgtcactacatttgaactctataaaaatgcaatgggaattggggagtgaggattggacataaaataaaagtccaatacccaacttcataaatattctgcaactcagtaattgtatgcatacactgtaaaatcataaaaaaatgcaaaaagaaacaattaatcacatcatccatatcaagttagaccatataaattaaagttgctttgacttttctcttattcaaattcatttaaatttgactgaatttgcaaaaaaaaaatatagcaacattttcaacacaaaacaaatatactatcaaaatgtattcaatgttatatttaataaaactaatttggtattataactgttgctaattattctataaaatttaataaaataaaaagtaatatgaatcagagagagtaaattacagtaacctgcatatgatttattttcccctaacctgcgcggagaaaattgtcgtgtagccaacccggggtgctccttgcaaaataggcgccccctatttgtaccataccaccgcgctacgcgtccccatcccatcccccctccctccccttcttctgctctttcccctctcccccacttctctcgtcttcctcttcgactcttgcagtttagtccactccattcccaccaaaattcctctctactcccaaattccccccacccctcccggcgaattccccccctccgccgctcgattcggcgctcgaatccgccgtctccgccgccaattcgctcggtccggcggttcgctgatccactctctcgtttttttgttttttttttaccttcttacgcggcgattcggggtgtatgagctcggtttcgcggcgggttggttgatttgctccgccgcgtcggagggcggcggcgcggggaagaggggggcatgtgggtttcgctggtctggatccgtgggtgcgtgggcgtcacgttcgtcgactacttgggcgggagggaagccgagtagatccttttacgcggtgtgccggggagggaggtggtggttgaggttgaggttgacgaggggttctagggtttcgggggcggggggccatggaggctgcccgggtcggggcgcagagccgccacctgtacggcggagggctaggcgagcctgacatggacaggcgcgacaagaggctgttcggctgggacctcaacgactggcggtgggacagtgaccgcttcgtcgctacgccggtgcccgccgcggaggcgagcggcttggcgctgaacagctcgccgtcttcctccgaggaagccggggccgcgtcggtgagaaatgttaatgctagaggtgactccgataagaggaagcgggtggtggtcattgatgatgatgatgtggaggatgacgagctggtggagaacggcggcgggtcactgagcttgagaattgggggtgatgctgttgcccatggagcaggggtgggtggtggtgctgatgaggaagacaggaatggcaaaaagatcagggtgcagggaggcagtcctagtggccccgcgtgccaggtggagggctgcactgcggaccttactggtgtgagggattaccatcgacgacacaaggtctgcgagatgcatgccaaggctaccactgctgtggttgggaacactgtccagcggttctgccaacaatgtagtaggttagtttaattcaaactactactgcctttcattctcattctataatttgttcatattggaatgattaggtagaatatgctatgcaagtttgatgcaatgcggctaaacagattctagaccctcacaaacttccaaccctaacaattttgtaagcattggattttgaaagtaatcctgatgaatatggtaaattaaattgataaaatgatagttaaagagaggagttggtgtgatctatcatctgtgcatgttcaatctagattggctgagataaatttatacgtagacttgtctgtattatatacttcctccgtttcacaatgtaagactttctagcattgcccacatacatatagatgtgggctgcagga

SEQ ID NO: 74850 - DNA, 559 bp, Oryza sativa
ctagccatgccctctgaaacacagatacattacagagatatgctagtcacagatacatcacccccccaattaacatcccagatccatcttaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtactcgacctccacaacctgtcaataagggaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagataaaggcgcacacttcgcctctgatagcggggggggggggggggg

SEQ ID NO: 74851 - DNA, 27017 bp, Oryza sativa
aagtcttacattgtgaaacggagggactattatggaagtaatgattttggatcgtaccttttgattttgaagaataattttaggtatattttttttccttctcatcctaaagtcaaattctcaaattcatgatgatatgatatttgtctgcaccttttgagcttagagtgtaatgattctttaactcaggacgtggtttattaatttgacatctgtcacagcatatgggcgcagtggtagtaaaatgaaaaggacaccataatttgtggagcgaagattaaaatgacgatgcttatgttgtaattgtgaaaaacacggactatcagtcataggcaagatttagtgatgatgctggaagaagtgatcaacgtagtgccatgctaagagaaatcgttagggattaactcttatgaaagcagtgaatacaaccgaaaaggagtcgtattgcacaacccatttgaatatacgatataaaagaaaatgttcgaaagtaaatatattataaaatggcctatgcccttctagctgtgcctgtatatctaagatctatgtggtactgccgatggctcagctcaaaattacagttgtacgtgtcataacaatcagactgctttctctcgtaatttctttggattattttctcttcaaagaaaatacttttttatttccaacatctgtactgaaagtctgaaattaattttttttggggaaaaattagttgaagttgacaaagccagaaacatttttgctaagatattttttgaatcgtagaatttctgagaccatttttacatttcgtaattgctagaactagtacgcacgtttttcatggaccagtattttcatatattctttttcgtctgatgtaagagaacatttggttccttaatgtcctcatttgtgcatcccacgtccaacagtaatgctttcttttgctcacccttttatgtgtgtgggttgttcctatgcttaacaccactgtcaacttttagaaaatattgtgaattcttcttgggcactgtcaattataatagtttttacagtatttgtttttcatgcatattttttcataaatgtttcaaaggaactggcactctgttcaaagagtaccgtgtgattacatagtgctaatactatttacaatgtactgtgctatggtgccatagtatgcattttttttttcaaaaagatatgggtgaactctgtaattactgtacatgcttacatgttccttttacagattccaccctcttcaagaatttgatgaagggaagcgaagttgccgccgacgtttagcaggccacaacagacgaaggaggaagacccgccctgaagttgctgttggtggttctgcatttactgaggacaaaattagcagttatttattgttgggtctccttggagtatgcgccaatttgaatggtaagtaaacatattcttatttgaactgtaggtaatgtttttatggtacaataacatagatcctccatctgcacgtatgtattggtgagctggtactagtatagtttgttttcaattgcgtacttgagtttgactttatctgaatatgtttctgagtgaatttacttggtattgattgaaataagacttctgatgttttcaagtaaggtagcttttatgttgtatatggttcttgtttattggaaaggttgttagtggcatagtttctaggactacaaagactgtagtgtggtactagatgagttcatagttaagtcttatattcaactcccagatttgcttacaggaaatttccacctttgtgtcaagattgcctatcctatgtcaagacttcacaacagcacaattctgcaatcttttagccatttgcttaaatgtagagcctcccaaaataacgtaggaatacttctagtgcctagactggactattatgaacatacttggtccatgcaagctagttttatgataatactcacaggactccacaattgtacttgcagctgacaatgctgagcatttaagaggtcaggagttgatatctggtcttttgagaaacctgggggcagttgccaaatcattggatccaaaagaactctgtaaactcttggaggcatgccaaagcatgcaagatggatcaaatgctgggacctctgaaacagctaatgctttggtaaatactgctgtagcagaggctgcagggccatctaactctaagatgccttttgtgaacggtgatcaatgtggcctggcatcatcatctgttgtaccagtacaatcaaagtctcccactgttgcaactcctggtgagatgcacaacatttctagcccttcagtgaatgtttccaaatgaagattttaagttacactagtggctttttttcacagaccctccagcatgcaaatttaaagattttgatttgaatgacacttatggtggcatggaaggtttcgaggatgggtatgaaggttcacctacaccagctttcaagacaactgattctcccaattgtccatcatggatgcaccaagattctactcaaagcccaccacagactagtggcaattcagattcaacatcagctcagtcactgtcaagctcaaatggagatgctcaggtttgcaaatttgttccttgcaacttaatgtaaagaaaactagtttcccaaaactaaagggatcgcttcaattttcaaatgctcacgacttattggtctataataacatccttatcttttgataacaagttaacaagaggtacataccaaataaggaaataactatcttaagtgggcattagttcaagtgggattttgaactggaaggggattttagtgcacttctacaagggttggagtgctgtcaaacatgccttaatttatgcagtactagatatgcttcagattctgttttaaggggtatataagtatgaacttaactgtacattttgaacttaaaagttacacacttacacgtgcatgacttttcagtacctttactagaaaaattgttgcagatatcatcaagaaccaaaaacattaagtctgcagagaaatttgaacagaatgcacattttcccagatccaaatttaactgactcatctgcaccagtgaaatgtctctaactaattcatcgcatctgtttctcacataaatgccacataaacaaggtgaactgaactaccttttgatcagtataaagaagtgcatgaagaaagagaatttctactgataacaacagtcggtctagtacatacgtattgagatgccaaatgccagtattttctattttgtaatattgcatagtggatttgcacctcaaatatgttgaaatgcgtgtgctctctctctctctctctctctctctctctctctctctctcacacacacacacacattgattgtcattatgaatgcttgcagtgtcggactgataaaattgtcttcaagcttttcgagaaagttcctagtgatttacctccagttttgcgatcacaggtaaattatgcattccctcagcaacgtggaagagtaaatatcgtaaatctaacacttcaatcctgaatttcagattcttggttggttgtccagtagccctactgatatagagagctatattagacctggttgtattattttaacagtatatcttcgcttagttgagtctgcatggaaagaggtatgatttttcaactaattatttcatgtcatgacaatgatctttttgcttaatgcttgatagcttgatgttttcctcttatttactacagctctctgataatatgagctcatacctggataagcttctgaatagttccaccggcaacttttgggcatctggtttggtatttgtaatggtacggcatcagatagctttcatgcataatggtaagcccgaatgcttagttagcgcagtgctcttcaagttctattatacatattttacatcggaattttgttattctcaccactcctttatatcactgcaggtcaacttatgttggacagaccacttgcaaacagtgctcatcattactgcaagattttatgtgtgagaccaattgctgctcctttttcaacaaaagtgaatttcagggtagaaggcttgaacctagtcagtgattcctcaaggtactttgccagtttgcatctacagtttacatatgtttgttcttgatggagacataggttgatgtttgcttaagcttacttgtcatctaaagattgatcatctcatgttttcaggctaatttgctcatttgaagggagttgtatattccaggaagacaccgataatatagttgatgacgttgagcatgatgatattgaatatctgaacttctgttgtcctctccctagttcaagagggagaggatttgtggaggtacagcttttcatatgtctgctgttttcatgtgtctgttttctgtcacaacctttgaatttactagaatgccatcgttaatttcaggttgaagatggtggatttagcaacggcttcttccctttcataattgctgagcaggacatatgctctgaggtctgtgagctggagagcatatttgagtcctccagtcatgaacaggcagatgatgacaatgccaggaaccaagctttagagtttctaaatgagctgggctggcttcttcatagagcaaacataatatctaaacaggataaggttcctctagcatcctttaacatatggagattcagaaatcttggtatatttgccatggagcgggaatggtgtgctgtgaccaaactgctgttagatttcttatttactggactcgttgatatcgggtcccagtctccagaagaggtggtgttgtcagaaaatctgctacatgctgccgtgcggatgaaatctgcccaaatggttaggtttctgctgggatacaagccaaatgaaagcctgaagagaactgcagagacattcctattcagacctgatgctcaaggcccttccaaatttacccccctccatatagcagctgccacagatgatgcagaggatgtattggatgcacttactaatgatcctggactggtattccccttatctataatccttaggatatggttttaagtatttgctcgtattctatgtgccttttgcacagaaatatagacttccgttgcaattgatgttgggcacatcaacaacggtgccgtgccatgtgcactatagatctttctatcctagtttttttaaaaaatgaattacacttgaatatcctgtctaatcttcctgctgctacctgttattgcaggttgggatcaacacgtggagaaacgcgcgagacggcgcaggcttcaccccagaagactacgctcgccagaggggcaacgatgcttacctgaatatggtcgagaagaagatcaataagcatcttggcaaaggccatgttgtcctcggcgtccctagcagcatacaccctgtaataaccgatggtgtgaagcctggtgaagtcagcctggagatcggcatgaccgtgccgccgccagcaccgagctgcaacgcctgcagccgtcaggccctgatgtaccccaactcgacggcgaggaccttcctgtacaggccagcgatgctgaccgtgatgggcatcgccgtcatctgcgtctgcgtcggcctgctactccacacctgtccaaaggtttatgcagctcctacattcagatgggagctgttagaacgtggaccaatgtgaggaggagcttagaatggaataagtgtagttgtgttttacgtaagtcgagagcttagtgtgctggctaagatcaaaataacagtactatgtgaggaggatgatcctttgtatttaaagcaggatcgtttcgtttatataaaagcttacataccgtcattattaattattattgattagttattattatttatattatatttaccgcctaacatgtaaacagaacatatgttccataaaattcatggtgtggttgtagaattcattctttccagagcttcttgttggagccatgcttctggctgctttcggttcattctagacttctagttttgtggctacaagattttgtcggtgttgtattgttgtaaactcggaataaaacttttttttttcgtcagcgttgtattgttgtaaactcagaataaaacatttttttcatgcgctttgtgagtgttgtattgttgtagactcggaatagaacttttttttttcatgtctttgcgctcctttttttttcttgtctatatatcacttgagatcaaatgttgattcagaaacgatgctgaatctttcccaacatatttgttgtccaagtgcactggacgctcaaaatgcgtgaaaaccaggtcgatttgaaaagtttctcaaagtactatcatgatacttcctatctcggagcttgttaatggtacgctatacgcatcggcataattgtaatatcaaacccaacggtaactagtgagataggaaaagatatatttcagcactatgtatcattcaaaatgtgattcaatactggaatttcacatggagactgctctcatattgaaatttcacatggagatatagcatgctctccggatgtttttggcttgcacacctaatttttcactgaactgatgagcaccatatgtcataaattatacaaccaaaatttgcgaacttaatcaggttcaaaatggaacatgtaagcttctttttcatcctgataaagacgtacattttgcaatgagtaagtgattctctggagaaatatttgatgggacgtagcttacaagatctgcatctaaacccttctctctaagccataatagcctaccagtatcaataatatctttacacataaaccccaaggcagctctctcccctgctggtatacttcggatgagtctatcgattccgctgacctccacatcagacttctctgcttttccgcacctgtaaaaaaacgtagcgacaaacatattaagcttccgtgacaccattcgagaatgattcaagaaaacgaactgtaccatgtttttgcccatacatgatgcatcataacaatttaaaagggtgatacttcccaccaagatttgaacagatgatcttttatagctatcagaatgtagaagaaaactaaggcttagttcaactaatggttcttacctgtcttctacagatgagtcttcaacctctaaagaggaatccggggagctgtgatcaccatccacagcccagctgctaaaccaagtcatggtatggaaatcttcctctgtaatccctaaccctgagaggaatgtcttatctgcaatgagaacaggaacattattctctaagaagaaaatctaaaggttttactgcaattttcaaaggaggacggtataatattatataaagtagtcaaagctgtaagcgacataatcgcacgatacatcctaaacaaaaataattagcagcattggctggcaaaaaaaaatttacttgcatagtgattccattggcacagatggtggcagcaggtggccaaagcaaggccacatagattgcttttgccatattctttttcatgtgcctggttataccgttcatgaaggcagcacatcatggtcatatctggagaggacaatattcattatatacaatcaagcaatcagttaatctcattgtcatgtattatacatcagtttgtcggagtataaaatccatgaataaatttcatatgttagaacttagaaccacctgttgcaggtccacatagatgctttccaattgctagataatgaagtccactcaatgcctctattccttgaaggttcaaatcttcaactgcattgtgtttatgtttcttatgagtgcttatatctcttactatctcaaatcacagggtatgaatgtgacaattcgttttaagaacacagagaccacccacacatgcatataagtgaactgataacaaacacatttggccttcagcaccaaaggtgcctaaaaaccacttcaaagaatgaaaagaaatcttactatcaattctcaaacgcttcaaagtaacgccttcattttgtcgcaaacttcgatcagcctagaaagtacagagaaaaggaagaaacagggcaacaacagagcagtcaaagaaccaacctaagctgaaattagatttaacacaacaagcactttcagaaaataacaaaacaataaaagttttactgcaaatcatgaggaatacagcaacaatgtgtcgaaacaaactcaaacttcataaggcactagacacagataggacagtgcattaaattcaaaatcactgtaaacaacctatacatgccttcatacttaaagttgagacatcttaaacaacgaacacaaaatactgaattaactattgttgagcataatagcaagccaataaattgcagatatattctaatctggcacagaaataagtaatgtccttctaaatttctacatgaaaaataagctgaaattgatttcaaaaggtcgaataaccaatggcaactgtccatgtttgacaagctcaaagtagatatcatcctgaggcaatatgaacagagaaactgaccttgagcttgtatgatcttctctcaaccaagaaaacattcctaatcccgtagcagtctgccagcatctgagtcaagtaccctctccctgctccgaattccaccactgccggagcatttttcacaccattctcctccgccacctcacctcccttctgcagcaaaccaaatgcctccatattgccaatgatggatgcctgctgcgtgacatgcttttcctggtatggcaccttcctgcccaacacaccagcttaaatcactcctcactacaaaatcctcaaaaaaatccaacccttacaccatcaaaagtggtaagcacacacacctatcaacctggttcctcatccaattgtcgcaagcatctgtaacaagaaatgaatcacgcattgccatggccgccgacgcatgcgccaacttgatcttctcaatcaaggcgcgcaattcatccttggtgagcttgtgcaccaatgcacgcttagcggccgaggtgacacccccaccgccttctcccccaccggagttgatgcccttggagtagaacggctgcgctgcgagcgccgcggcctgcttcttgagggggcacttgccgacgtgcgcctccaggttctcctcgagcacggtgctgcccaagacaaggcggcattagcggatagggacgctggtgatggagatcacttggcggtggtataggattttggggggtcttactgcgaggggtcgacggggcaggggacaaggcggcggaagggcgcaccggcatcggaggcggaatccgggaggtggttcccacagtacctgaggaggagggggaggaggcggcgatgggggttagggttagggttagggttcaggggttaagcaggaaggtaactcggagagctgcttactgagaggttgggagcggagtgttggcgcagtggcggcgcttgttagggagccagaagtggcaacggcccggaggcggaggaggcggcggcgacgagggcttccgtttcgccggagcacggcccatctctgacagcggcggcggcgagcgggagacgccggaggcggagagggagcagaagtgcagacccccggtgtgaacacaaccgaaggggaaatgcgtgacgtcattgctaaatttgcatcttatgaatttgtttttttttaaaaaaataaatttcgagtgaattcgaacatgtgaaggtgtcctccacgtttgacacaaaatcagattatcgtaccgctacatatcccttataaatttgacgttaaaaaaatattactagattactccctccattctcatttatttaacaccgcgcactaataaactaaccaacgtcaaatgaaaaaaatagatacttcctccattctcatttatttgacaccggttaactaatccacgttaaaaataaaaagagatagagggagtagattgaaaaacacaatagccatttttcattcgcagagcgatactagaactaaccgagaagagacataaacacaaattatgtcagacaaatttacaaattcaaaactcaaaaattgttacatgaaaacatgctccactgagtccaaaaggttgcatcatgatgagatgcaatggcaaccaacatataatattacaaacgaacaaacacaattttacaaaccacatgctatgacaccacgtcaccattgatcgcctaataagaaaaagggatcatctttccagtcaaaacgcggtaaaatttatcgtaaagatatgtttttcttttaaattaaattaatggcgtcggtccgtgtcacaggccgacggactggagcacggcgtagttgacggcggtggtggcgccgtcgacgacgaggttgtggccgctgacgaaggcggcctggtcggaggcgaggaagagcatggcctccgcgacgtccgccgccttgagcaccttcccgcggagcacgttgtggggctccgccgccgcctccatctcctcggggctcatccccgtcagcccgcagctcagcggcgtcgccacgccgccgggggacacgcagttcacgcgcacgccgtgccgcccgagctcgccggccgccgcgcgcaccagccccagcaccgcgtgcttcgacgccgtgtacgccgccggcccgaacccgccctggcacgacgccacgctcgccgtgcacacgatggcgccgcgggtgccgcgcgacaccatggcgcgcgccgcgtgcttcacgcacgccgccgcgccgcggaagttcaccgacatcacccggtccagagccgcgaggtccatgtccacgacgggccccgtcgggagcagcacgccggcgttgctcaccatcacgtcgagccgcccgtgctccgccaccgcggcggccaccgccgcctccacctgcgcctcgtccgtcacgtcgcaccgcacgtaccggcacccgccccccgccaccgacgccgccaccgcctcgcccagctcgtcctggacgtcggcgatgaccaccgtcgcgccgcacgacgcgaacagccgcgccgccgcctcgccgatgccgctcgcgccgccggtcacgatggccaccttgccgtccatcctgcacgcccccgctcaaatccatcaaacgaattcgacccaaaccaatccaacatcctcaaatctaaaaaaaaatcaaacgaaaaaaactactagtagctgcgagtgactcaccttgtcttcgacatgatgcaatgcaaaagctgtttcgtgtctgccttctgcatcgggatgtggttgtttatatagtgctcaattcgcttttaaaagtcgtcaactatgccaatattttactcaaaagcaaaattctttttaaaattcagaggaatgggcatatatatccgtacacgacgagtataaaatactccaaaacccaattctattattaatccaaatcaacagaatgccacatccttcaaaccttcaattcaatatttcatcaattaggtagcagcacaactaaaaaaaaaacgaaaaacgagtatccaagaacacggcgtttccaaatccagtgagatcatcagacagacaaatcccagagaaacaatagacatggaagcattgaaaaactcatcagagtttcagttttataatagatggatgaagcggagaagacgagctgagctggagaagacaaaagcggttgatccaagcacgctgtcatgtggggaacaccatgaaccctaatcatctcgcgttgcaaatccggtcccaatgctcatggcgctttgcttaccatcactgtcattagcggatgagaagatgagcttaacaagatcaattcaagaacagaaaggataagaggaggaaatctagagttggatttgggttgggtcgctgccttcatttctactgctaatgattactccacgacagggtcggctgcaatgcaatgctgcatcctgatcctgcaagaaactccatgcactgcatgttcactttcaggaaaagatgcagtcaatcgaacgcgaagcttgccgggatttctgttcttgcttgtaattgttgctgaagcattccactctcgtaagtttgcttatgactgataagcgtgaaaaaataaacaagcaaccaaaaataatttatatgcaaaacttttatatttacgaacttagcgatttaaaagctagtacttaaaaataaactacaatgaaaaaacctccaatcaactgtaaaattaagttttaaaattctgatttaggctgtgtataactatattgtcggtgcctgtcttactaactttactgttaccgttactgttagatgctgcctgttggtgactgattgcctgacagaagaaaagaaaagaaaagataatagatactacaggtattgttcagagaacgacaatagtgaattgtctgtaatgtggtatggtcaatggccgcaattattggatctcacgccagttttctcgcactggcatgtttaattgtttgcactgctgctaatgctatctcccaaagtcaattagcttcagattagttattggctctctgaccctgctgatatgacagctcccttggtttcatctgccagtaggatcatttgcagtagtcaaagcacaagacttttgcttcagaattgacttctatcgcactgaatgactgaatgaccatatcatttgaagtttgaactactagaagaatgcaatgttttcagaaggagcacagttccttttcctgtgcaaaagtttgattctcggattaaagaattacacagtagcagtgtgctttgtaagtagactttcaaagcagtatatagcacttgaactgagttgcatggatggaccatacatgtgacaggaccagcagacatctttcagaagaaaataggggaaaactaacacacttggaattgaatttttgcaaattgaagcaatagttcagatagatatatatggaccagcaaaggtgagctgttacctcaatgtctattggttattaccagccagagtttctttgcatttaatgacgaaatgctttgaaaagcactcagactatggaaggatttgaaacaaaagggacatggtagttatgcactaaaagaaattaagtaaaccaaaacaccaacactatttggttgttgtctactagtaccaactaccattttttccacattatacgtagacatagtaactatttacacagtgttgttgatattatcttcgatatgtccaaaaatcggttaagctaggaccatttagaaaaatcattgaggctaactaccttgacacgtcttgatcaaatagctgtgggatttattatcctatgaacacaggttctttgccttgccacttatgtcagcagcgacaacgtatatacattgtattgtactatgtagccttattgtactgttcaatgttcatgcattcatgtaagtagctgttagtttgccactgtcggtctaaacgaatcaacgtgttggaattgatggatgcgactctgctcactggactcaatgatcaggtttatcctacacaattcatctgtctaaatgattagtaaattatactccctatttttttaactaaccaacgtcaattagaaaaaaaacaacagaggtagtataatattactccatccgtctcattttaagtgcagccatggtttttcgcgcctaactttaacagtccgtcttaattgaaattgttttaaaaaaaatttaaaacataagtcacgagtaaagtactattcatgttttatcatctcataacaacaaaagtactaattataaaaaattttcaaataagatggacgatcaaagttgagcgtggaaacttatggttgcatttaaaatgagacggaggaagtatgatgcatttgacttatagtaatgtatagtagggcatacatattgcaacgggtatagataactgtagaattcacatcttccttggtgttagtgtatagataactgtaaaattcagatcaatctaacattgtcatgacaagtgacgactataagaagcaaactttagtttttgctatgaaaactttttacactgcttcctagtgagaataggagaggatgcaatttagtgttggtaagaaaaaccatggtagtcataaaagatataatataatgtcataaacaagacaggtgtgggctggccgctataggctggccttctagttctagggctaatgggctattgcgtcaataactaatcaactatgttgtcagcccttaggtaaccacattgccttttcttaataaaaccgttcaatattttacttggaagtaaagatgatactacaaacacgactttgtttgagctttgtattccttttacccatacatcttttccttctcttttaagcatttatatttgtattcagaaatattttctggactagatagagtaccaaagatgttgttatacctaaaggctttctatggaacatgtgatttgaaaaaatgcaaaagaaaatgaaaaaaaaaatagaggattggagtgtcatatatggacaaatcctacataaatttgaaacatagtaacatactatgtttggatggttcatgggactatgaatttgatataatcataaaatgggtatgccaactcacaagttttttcctcatccatcccaaccacatttttctacctagacctatccttgggtatccctatattcatattcatattagactgagtttatttcaccattttcacaacttctattttctcgttttcatgcacatgattttcaagctgctaattttcaagctgctaaatgcagttattttttttgcaaaaaaagagagaaaagttggcttaagacatcgggcctgttcactttgatgccaaaaaaaaccttaccaaattttggcattaccattttggcaacttgccaaaattttagtaggatttcttatatagttactaaaatttggcagcaaactaaatgtagccactttttttaagtgaacaggcccatcatgccaatccattttaagttttttaagctaacaatacaccgttttgttttgcgtgctgtgggggagaggttcctaaccccattgtgcaacacaaccttatttggataggggatagataaaaaaaatatatccatttaaattttggatatagtgagggtattactcattttgtccattttatatgaacccatttgctatgtgtaaaatttagacctaaaatttttaaactaatgttcatattaaaaaaaactgattaaaattcgggagatgatttattatatagaggagcaactttgtataaattttgaaccatttctacatggtcaattattttattttattttttattctattttttaaaaattatatttctacttggactttatttttatatttaaaatttgtattgtctcttcacttacccattgatgagtaatactcaattatgggatggataaaattgagtatgaataagtgttaccctttatgcttccctggtggcagatcaataattatgcattttatcaaaaggaaaaaaataaattaacatatagcaaaagagaaaaaaaataatactattaatcaataacaaaaacttacttcctctgtcctattttaagtgcaaccatgaatttccgtgtccaactttgattgtctgttttattttattttttttgtgattagtatttttgtttttatgagatgataaaacatgaatagtactctttcatttccaaattgatcatcatataatggaattcaaaatttctcaaattgattatcatataaccgtatggatacagattttatcaaaatacaattaatgcaacatgggagaatatgtacatgctaaggtgtaattggtatagtgtttaatcgatgcatgtattataggagaatgtgtgcatggtgtcttgattgatgtgatttaaattatcattggtcttggtgtataaagatatatgatgatcattttaggaaggaggagtactttactcatgacttatagttttcatttttttaatttttttaaatacgatatatgattaaagttagatgtactccctccgtcaaaaaaaaagacaaaccctgggtttccgtgtccaacgtttgaccgtccgttacgcataaagtattaatcatgttttatcatctaacaacaataaaaatactaattataaaaaaattcatataaaacagacagttaaacgttggacacggaaaatcaaagtttatctttttttttattttacggagagagtagaaaactatggcgacacttaaaatgctgacggagggagtaagacagataccaaaataccaatatctcatattctcgggcatccttgcgtaattgtgcccaagaaaaaaagagcaaatcgtggcgtcgtgcagtgcggtgcgtcgaggatattttccccgcagaaatcctaaattcccccgtcccctctcggcgtcgactcctcgtgagtgacttcgcccgccgccgcctgcgccaccgccgatccccatccgtcccgccaccgcgagcgggcgagcagcggcgccgtcgtccgtccgccctgctgcttccgccgcatcgcatcccggtgagcatcccgtcctcttcctcattcatctctctctctctacccacccactttttttttcttctcgaatttgtattaaccctagcttctgttctagaaatttgcgttagactcagtactaataacagtttctttgctcccaaaatttttcgtgggttcgactgaacccccatgtggccatgtccgttgttagatccgccactgcgttatatcctcgtgtttttgattgggtggcttatcaaataataggtttctgaatgtattatacaaatatcttgtgcaacctacccttttatggttgttattgcctttatttaggtctttgctttgatactcttttagtagaaaaggcttgcgctaacctcgaatcagtattctgttactaatgcttttaggtctttgctttggtactcttttagtagaaaagggcttgcactaacctcgaatgaaaattcggttactaatgagtcggggcatcgcgacaaaacactaaacactgaaatgtaaaattagctctgtcctattctggtgtaaattagttaatcaaaatacacttctgttgtcatcctaaaccaactattcttaattctcagccatgacttcaatttcatgtttctcttgtgattggttggggctaaaatttgttcaatacagtttgttgctcaagggatgaatgccaacaatttactgtcactcattgatgtaggttccgttaacacacttttactatgtctaatggatgagactgcattaagtaatcgatataccctctaaatatgctatcctttcaatgtaattcgcacccgactacattaacctgctgacagtcacatgcaattgtctcttgctgagtgcatgtactgcatttgagtcccagtgactatttatgtgcttagagattaataaacttcttattatatggagcactaaagcatggcacatattttctagtaggtttattttatatccatccttatggcatgtctttttgtacccataggtactgttttaccaaggaaatatggacagatttgtataacattgcctaagctttgaatctactttgaaaccatggcccgaaaaggaagtcaaagtaaaagtgttctgaatcatgcttcacctaaccgacaaaatgcagctaattgtgaggtactaaatacaccagaaagtgatgtgatggatggtgaaaatcgaagttcacatgttcaaggtggttcaaatgtttctggagtaaactatggccagaaaacaaaaggtatcaagaagaataacagaagcaatggcatttcatcctctggcaaatcagatgacagagcctcaaaaaagcagtcagtggacaccaattatgatataggtaattcaggagaaaatgacaatgagttatcatccagcacttccaaagcaagaagagatagcaagagatcatcacggcgtggatgtggtaaaaactcatcgatagaacaaaccccaatgccagtttttgcagaaaaagttttggagaagaccaggtgcatagcttgcatggctgcatccatttttagggcttccgtgatgtatataatagaagaaagcaaattgctacttgagagaaataggccagcaatcacaactttcatggctattgtgcacaaggggcatgactatgtccgcagcaaaattaagtatacttatcctatttgtcgggcatggatgtttagtgctggaaagttgatattgctcttgttggcagtttggttcaactgcaacataaggggcttcgattctttgctacgcctagggacaaactcactccttacagtactttggtgcagtacactatcagtttttgcaatgattggactaaagaaaatgctaatattaatggtatgattcagctatccttttgccttttgagttgcctctgctgtgaatgtttactaggctatgttgcatgatgcaaccaagagatattattgttgtacagttcttgcctacagttcggtttttctccacaaaacaacataactatgatgaaataatgcaatgagtatagattaatgggcattaatagtgaaagtttgaattatgaaatggaaatagatgctcctgacatattttcgaaaacattcatcaattctattctctctgtgacccaggtaattgctgctgctgtagttgcctttgttggtcttggttttgctgttctggttatcgcagtggctgcagtggtgattttgtggctgtatggaagcttttggacaacaagcggcatcataattctcggaggtaatattctacagtttgtttactattagtcaagtatatccagcacttgagaatgtctaagaatgctgtaatatttcttgaatcacaggtgcttcctttttcctgaagcatgaacgttttgcattgcttgtcacctgcctatattcaatgtattgtgcaaaaaactatgttggatggcttgggttacttttgagcctgaacttatctttcatttcaagtgatgttcttgtgcaactcctaaagaacaatgtagacaataacaaatctgctggctcttcaaggaactctgagcaaaattcaggcaaatcaggcttctttggagaatttcgacaatcatcagcagataatacctcacagtccgagtatgctcaaccatcagatcggggccctggcgatccttcaactagtggagctgagaaagagttgacctctgaagatgaagtgtctcgtttactgaactgcactgatcactattcagcattaggcttccatcgttatgaaaatatagatgtatcattactcaagagagaatacaagaaaaaggtgatactataaacattaaccatcattgtgcaccagactgttcatgttctgcaaagttgtagtatgtaaagttatttgttaattaaatttaataatttcgcaggctatgttagtccaccctgataagaacatgggcaatgataaagctgctgatgcatttaaaaaacttcaaaatgcatacgaggtttgcatgtatttcttgttgagttaaccgcatatctgataaatatcctatatattaatgaggccccaattcaaaatacacaggttcttcttgattctttgaaacggaagacatatgatgatgagctaaggagggaggagcttttgaactacttcagacggtttcagagtgcttctcaaaaggtcttattagatattcctttttctgagtgttcatttgtgctttgctatattttttttcctaaatcttctttctttaaagtagttccaagcagcatgctgagaactatttgcaactgctgatagcccatgaactttggttggctcttatcggatgaaaactgtctagtttagctggactgaatcctcaatttttgttgtccaaatgattttgaagcgcatgtggaatagcttgcattgcataactaaagtaattatatatatatacatatctttaagtatcaaacaagaggatgagcctgcctgaggtcctgggtgaaactgaattggtctttgtctgattcatgttatagattaacagtttgtgttactggagcaggattcttgttatagctcaatggtagattcatatgcggcatttggcaattgtagttttggcagttgaaatggtgttatacttgcaatcttgtcaagcactgcatctgccaaaagcaaaattttggcttaccaccatcaaatgttttttttgttctgtagtcaattcactaaagatggtctgaaggaagtgtcagtatgcacacatggttttacttgtaccaatagtattttagtagtatgtgctgcaaagaaactgctcttttggattgggcatattcttcctggtttcctatcagttgctttaatctgtcctcttccttgtaactggttattcttctggttggcttgatattcttttcttatttgttttctctctaattgctagaaaggaggaagtggtatttttcgacaagggtttagcccttctgaaggtgttgatgaaggaccttatggtttatcaagaagaatagcctgcaagaaatgtggtgacttccacctgtggatttatacaggaagagctaaatcgcaagctagatggtgtcaggtattttcttttggcatgtggttgtttttacttttgataccatgcttcaaatctgttatgaaacttctgtgttttctgcaccataggactgcaatgattttcaccaagctaaagatggggatggatgggttgagcagtcttttcaaccagttctatttgggttgctgcacaaggtaatgtcaggttattcgagcccttgcccaatactgaaaattcagcttctttttgaactaagaagaattatttgtgtggtaactagcgatcaaaaatgtgctatgactgtcatgtaatgttgtttattgttatgcagcctgaattgcctcatgcatatgtttgtgctgaaagcatcattttcgatgtcaccgagtggttcacctgtcaggtaattcagatattcttcaatgaaatttctgattcgttcagttgcttgtttaatattgctccaacatggtggcttgttttgtacataagggccttatctattttattcttctaacaatgttcatgcaagacaatatacagcaagggttgcatgttgaatgctcatagctatgatctctggtctgtacggtatacaatacactatcatgtagttctgcgctttaaaacgtatacagatgctatgcaacatgagtactatatgcagtattgccgaaatgctaaattatttcatccactgaaagctttgttttaggtcattaaaactgtgagcagggacattaaggagaacaattattattgttttttaagactaacgattactaatatcaacttgaagatctggcaaaaagtagtactgggggggggggatttctctactctccatgtaaggcctttgtgttatggataggaaaacattacactattcacagtaacacacaaacacatagactggttgaggtgcccaatggagttatccaacaatgtgatgcaccgacaaattgtctctgcctattgagcagagagaaaatagagatttatgaattgatatgcaactgttctgttcttcagggaatgagatgccccgcgaacactcacaagccgagcttccatgtcaatgccagcttgttaaagcagaatagtggcaaggggagcacctcggcgcagaggggtggagggatccctaatggtgtaaacatggatggcggaatcgatgaagaggagttcttcgagtggttgcagaatgcactgcagtctggcatgtttgaatcgtttggcgcgcaaaacgagcccccttcccctggaagtggaagcaatgccaagggtagtaatagcagtagtaagaaaaagaagaagggcaagaagcaatggtaactgaagaaggtccgataatggcgattcttctttgtgagcagaaagaagtaaaacatatggtgtttgttcggtatagttatgcaggaaaacaccccaataataggggtcctagatgctcaaccatcctgactcgctttaaggcgatgccattcaaaatcatgattcatcttgctgtgatttttcatatggagaattagaaatcagaagagaagaaagggccatgtatgtggcaaagattgttggaatgtaaagcgcaaaatatgttgagcctacatgattgaattgtttggacaggtagcgcaagctacaatttccatacacttgtcatcagatatattacattgttgctgatgtctcgttgatacatagaaatctttctgcccttgctttacgattcaattgtgattttacccctactttttagggtttgtgatttgcccttgtttttctgaaataaagcagccgtctagccttggttttgatagaagtttggtgggtccggaatttcagatttaaacgaagatagaaaatgttattatcatttttgaatgaccattctacccttacccttggttcaatgaaagaaccaaatccccaatccctatcccgatttccactccaaaacccggcggtggcggcggctacgcgcggcagggaggagcggcggcggggccagctgccacggaatagcgcgcggcggagtcgggcgcgggcagggaggcgctgcggcggcagcgtcgcgcgtgcatggaggcgcggcgcggcggccggtggccccgcggtcagcgcgcggcggagaggagcggcggctccgtcagccagccagcgagcgagcagcgagcaggtagcttggcggcgggatggcgctgttaaaggatgtaggcaggcgcggcggcgacctcgggctggagcgcaggctagggacgcagggaggcacgacttgctgccggcgggctggcgctcctaacctcttgccggcgcagggacggaggcctagcgctattgaaaatacaggattaagagacataatggagtaaatcttgtgcatggtggaaatctgctgcaaatcccctgttttctttcccattttcctgtcttgtatctgcgagagatttgtttggtgaatggtgatttcttcctgtgatgaatcttgttggtgaatttttgcacccgatgcaagttctttgaaaatgctgcagaaatgatgttaaattcttccaaaatttgtcaaagtttggtcaaattcgaaatatatacgcattatatcaagaaaggagaggcaaatgtgtaagggtatacaagtccttctactgctaagttgacgctgttaagtgatgctaacagaataggggcaaaacagagcttcgtttgaaaaaagtgagggcaaaatcacaaaccctaaaaagttagggtaaaatcacaattgcaactcaaagtgaggataagaacacaattgcccctagaagaaatatgttactacctgcctaaagaactgagaatataaggtgaagcagcaatcgaatttcgcagttcattataacttgatatgagcatttggatgagtacaaccagtgtgtcttacacttccccttaattaactgcgggattaaggatgctaattacaagccacgtagtggagtacacaacagtagtagacagtagagtagttgattagtaaattaattgctcttgttgttgttggcgacgacgccatcgttgccggcgagcacgaggtacttgtccctccgcgtgagcgccgtgcaggtgtaccccagcgtctccgcgatccggcgctgcacctcgttggccacctccgggccgccgccgccgccggcgacggggtcgaggaagtgcacgacgtaggccggcgaggggttcatgaggaggaagaaggggtcgagcatcttccaccccccggccgtggtgccatggaacatggccacctccgagtgcagcgccacgggctgcacgtcggcgccgagctccgtgaagagcgggctgaagcgcagcaggaacggctcgcggcaggtggtcccctccgggcacaccaccaggccgccgccgccgccgccgcgccgggagcgggagaggtgggcctgcatggcggcgcggtcggcggcgcggtcgcgggtgaggcggaaggtgcggatcggggcgaggatctcggagaggcggctgatgctgtaggtggcggcggcgaggtcggcgcggccggcgacggcggagacatagagcgggtcgaggagggagcggtggttgcagacgaagaggtccaagaccgcggcggcccgcagcgtggaggcggcgatgcagcggcagtggatgccgagggcggcggcgatcggggcggcgagggagaaggggaggacgacgacgatgagggcgacgcggaggagggcgaggggcacggccagcggcagccacacgaacatggccagcgtcgccgacgtcgtcggccggaacgcgacgcggccgtcgtggaagatgaggggcttcgcgtatcgccggggatggaggggacgccatcgccgccgcgcccactccgacgccacgtacacctcctgcattcattaatgtttgccattctcacttgattaatctatcttgcatcttcctttctactctctccctaaaaaaaaaaaatcaacttctagagcttaaattttatcaaaaaaaacttgtacaatcttatctattctcagcatgtaaaatgaaaagttttattccttcgatactctttacctatctatcaccattactattttttcaataataaaaagtattttgttcatttttactctgcactaactttatatagggatgcgagggtttgattttatatgggatggagggagtacacaatgtgttcagtaccatcgcacaacacctcaacaccatgaatgcgtccgttttaacccacagtaaaagtatcgggatcaatagtaaatctttagcccgattaaaaaaaatgtaatctttatattaattatttgagcgtgtaaatatttttctaaaacacggaacaaactcagacgtacacaaaaacgcgcacactctatccctgtgagcatttttaaaaagactgagcgacattcttaagattgataaagtcatcgcgagcgtctctctatccctataatgaaaagaatattaattataaatgcgagcacgtgagctaagtctaggaattgaacccgaaagacagtttccaccacaaggaacccacgcagttacaaaattactaattagcgatcgactgcgtgtctggtcagtttccgatcatgccttttttttctatttttatacatacacgcataatttgtacatagaagtataaagtttatatgcgtatgtgtattttttatacatctaaaaagtatacacacaatttttctaaatatagaaaatttgtagatgtatatgtgaagtttatactttgtatacatacatataaatttagtatatatacatgtataaacttggtatatatacatgtacacagtttatacgtgtgtatacaaaagtacagtggtggagcaaagatgccatgaagcccagacaagtattagcgtttttcagtaatcaactaattttttgggacatcaaatgctatctacagccgagacgccagcgacagagcctaagcgaccgcccgacctgcccttgagttagctctaccactgcaaaagtatgtacaaacgtacaggggatgtaaggaggtgaggtgaccgtgctaggcgcgtggcaagccatccatcagcagcccctaactagttgagctacgctcatttcgtaagatgtaaatatacatgtacatgtatttattaatcacgtagtagtatatactattgtagataataaattttattctgtttgtgcacaagcatgggcgtgaatgagaaatccttacgaatttatggttgagaaagatgtgtagtaaagagtgatcgacaactggtagttaatcggtagattaattgaccgatgtcttaatcggttatgcagatttatttgatcggtacgaatattaatttgaccggtgtcttaatcggtcggtagattaattgaccagtgtcttattgttggtaaaactaattttatcaacactgcagctgatcatgcatactacctccctaaataaatttattttttatcaatctcacacgtatcaataggacaaaaaaaactaaaatagttctattttattaaatcacaatataattgtttcttattttatctagtttcaatgtatttactattcacttttacaaactctaatacaatgattgctaaaagtaaatttaatttggaataaactggaggagggtaaacacgatgttattttaggacagcggaagtaaatatgtaggatgcatgtcgggtgaataatacgatttgattcacctgaataaaacagtgctcttaattatatctgataagagtagtaatataaacgtgcaacgtacgtcgattcataacgaagtgatgcggagctactgtatgcacgggtcttttcttaatgatgatgttgatgtgaacagagacttataattaattgatgaaaaaaaaatcgatcagtgccatatatacgaaaatacggttcatatgaaaagaatggcaggggcattttagtctatatgaaaaatacttgaacaaagacatcctagatgtactgcgtactacataatgatatggtttaaactttgcaaaataatcattatatcacccaatttcatcctttgtaatgataaattttaatagggtattttttataatgacataaatccaattaaccttcttaaatatgcatggttatttacatactaccagtatgaacagttgaaaaccatttgaagatagccttaaaagaagcatttaattttaaagtggcatatatataggtactacaagacaagaggtgaataaactgtagctctgctgacaaaaattcagtaacatgccaattaccgttctgggccgtgtgtacgtaaactgagatttcaatgaaaaccggcattcataccttacccataactcgctatatacagtccggc

SEQ ID NO: 74852 - DNA, 582 bp, Oryza sativa
tttgggatctatgtgactttccttgacctttttcaaccccttctgaaccttcctcaacgtaaacgctctcctccggaatgtcggaaactaaagcaaatgaacaaaatcaacaaaacagtacaaaaacaagcataaacagtacatttggatatttttgacatgtagatctcgattttagatgaatttagcaacttgaaccactcgaatccgagttacgatgatttagttatgaatttccgaagtttaatcgattttcaactaatacagaaaattattacgaattaaataaaggattgatgacgtcacgatgacatcatcgccgaccatggcactggacgacgcgaccaccagcgatagagggctcggccgggctatccgaggacacctacgcgaagaggacgacgacgcgaactcaccggtgcaagaaataacgaagtacggcgtccggtgacgaggaccaatggcagctcggctcggctcgatgtcgacggtggcgctccggcggtctttggcggttgcgaaggggcggacggggtgctcctccaccgtgcgaacccggtggtggcgacggacggcgatggc

SEQ ID NO: 74853 - DNA, 527 bp, Oryza sativa
tccactgcagacctctctgccgctcaccctctctgccgaccttcccgacgccggcctgcaccaccgccgccgcactcactctctcgaccgccgccatccatctccaccgccatctccaccgtcgccgtctcgacctctccgccgccatctccgccgccctctctgccgccatctgccaccctctacaccgccctctccatctccgcctcgacctctccaccgccctcctggccaccgccctctccactggtgccgcctcactcactctctcgaccgccgccgggacctcctcttagtcgccacgccaggaccatcatcgccgccaccgggatctcctctccgccacctcctcctctcgactgggacctccacagtgcgccggccgggactcgtagtcgccgtgcgccgcctcctctgctcgtcgtctcctctccaggtacccctctctctctgatgccgatgaatggaatggtggagttaatggatgaatgaatgatgcaatggaatggatgagattttgttcaatg

SEQ ID NO: 74854 - DNA, 878 bp, Oryza sativa
  unsure (1)..(878): unsure at all n locations
agagggacagctaatatgtantggtaatttaatttntactttcacatttattatatgttacgcagggatgagtaggggtaatttncctgttcactactcaccccccaggatgatgtcagtctgcatccagcacngacggaaacagnntaatngaaggaaacacaaagaaaaaacancaanccaattncggacggccgcgaacactctagaaatctttctttatgttgggcccataaaaacctgggcccaaatcttaataggccgggaggcctttgtgatgatcgggccggatccaggcccataaaaaacctgggccaaaagctgtttgacctcctcttcctttctatttctttcacacagttacctttcacctcgggggcgggcggcggccggcggctaggtcctgacagcggagggagcaagcggggaggaccaggcattgggaccctggggcgggcgatctacacggcggggaagtggatccgcggcacggggcaggccatggaccgccttggatccaccatccagggcggcctccgcgttgacgagcagcgtaagcagcagcagccgccgtctctctctctgacaatttggcagttgttattgggaagaaattggtaggaatggattgggggtgactggattcgaggagtttcgaaatgaggcctaattatcgtcggttatttggaagttctgcattccaggttttcaactagtgatcgatcttagtgtgtgaacactgttacagtaaaacaagnnnnnnnnnnnnnnnnnnnnnnnncatactgcccattgggggagtgtcacattggcaatttggcatggccaaatttggagtggttaggcgattaattcttggggcgtaacattatgaaaat

SEQ ID NO: 74855 - DNA, 992 bp, Oryza sativa
aacgacatggactgctcggattgtatccatattggtttccttagttctacttggataaggggacatctatgggtataaatacaaggccccctaggatgagaggggacacgaacaatagatcaagacataagatcgatatacaagccaacatacgccaagacaagccgccggacatcgacatcagagatatgcctagatcgaccctatctggtacctacagaggccagccgtagggatctagcgctgtctctgatctcgctgggtacgaactcgagaaggaagaataccctgttgtcgactacgagtcagaacttcagaccgccaagtcgacaacagttagataggctaccccaaatattgtactggtgtgattatggtgaataagaccaataccgggcttcggccaacaggatgtaggattattacctgacaattcaagggcccgaacctgtataaaaatctgcgtctccatctcttttactacaatctcgcatatatcctagtaccaacgatccccatactatgcaaacaccggaatcgcgacatcaaacatcgacaacttggtggcctacaagagttggtagaaatgacacataagatataatatgatatagtagtaaaaatatagctaatatagcagtggaattggtgatttaattaaaacaatctacagctgctaaagtgtatgcgtagatcgtctataaaaataattgtttatttacaacaccaaatcacttgtattgtaaattaaattcctagcgtttgcacgttcacactcagattactctctatgaaaaaaaccgatctaataatttatgataataaattatggtgtacatgtatcatgtaatttggaaaaaaaaaggagaattaggatctggatggcatcaatcgagctcaccgaggcagatcagtctccatgaaaatgatcacaaattatgatgcacatgtattttgtaattagtacgaagggtaccgagctggattgccaa

SEQ ID NO: 74856 - DNA, 1095 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagt

SEQ ID NO: 74857 - DNA, 615 bp, Oryza sativa
tgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagcccgttttgctcacggatatcagaccagtcaacaagtacaatgggcatcgtattgcccgaacagataaagctagcatgccaacggtatacagcgagtcgctctttgtggaggtgacgattacctaacaa

SEQ ID NO: 74858 - DNA, 1714 bp, Oryza sativa
taacatcaggcgctttccatgcaggattcggtctctccccaaaaacttttggttcccggtcaacatcgcatgtgtgctcccatatctacaataaacaaaataacctagttaaaaatcctggagaatgagacaggatgtagatgattaaacgagtgtcttagagttcacaaaagaagacaaattaacctaatgtaactaggaaaagcaccaaagtacctcaatatcaaacatctcaagtgatggtgcagcttcaaggaggtttgttgtccataacaattcaaattcagaaaagatgctatgtatagatagcttccttagattgctgaatgcacggaagagttgttttccttctggctttatccatagctaaaacaagaaacattcacgtcaaaaaaaaaaagaaacattcacgacaaaaatgaaaaaagaaacatgagaattgatgttatgcatggatgagcgtacatttgaattagttaaacaaaattaaggcatgcatcagctttagaaatgcatacatataatcattgaagtattgctacttaacattaaacatttgttcttgctcatgtgaaaatatactagtagtacatcacgaacaactatatgctaatgataacagcagtccatgaaaaaggatggacttaccttttctccttggaaatccaatgttagagtatgtatatttgtagtaccacttggaacctcacttaaaataaatccttcatgtttatttgttgcaccgcagataagagatacttcctgaagattcgggacaacatcgaatgacagcggggcataagggcaaagccaagtgtcccaatttagtcgctccaatttgggaaggcagagcacctcaagtttctccaagcagcatacatcaagttcaagaacaatgatgttcgaatttggtgcacttattttccatatcgcattcttccccacatcacaattggatagactcaggtatcgtagttgattgcagcattcaaacagatgatggtgcaagtcccaacgggcaaaacatagattgtaaagagagagccttgtgaggcgagtaagcacactaggatagccactgaaaaggtctttcacagatgaagcttgctgtagaatgtgcttatcggtgcaatctacaatctcctcctcgtccagaacagaaaggtccatatcttttaaaatgccaacctcaattgccttatcaagcataggaccgacaacacgtgagtaattattgatcaggtaaagctttagttgaaacctattgatgggaaattcgctccgagctatagtcaataagctcctgatccctttggttagagatgccattgcttcatccatatgttcaaccttgatgcggttcggttgtgggacaggtagaaaatccttgacatcaatggtgaactcagggagcaaccaaggcagatgtttccagcgtgttgacaccacacttgtccttacagccgagattatgtccactctccccaagatagacagtaaaatgtcatcagttagcattgagagccgatcctcatgatccatatcctacaacaaaacaaacatcagagcacacatttgtcaaaggagccaacagaatagacattataacataataagcaacaagagctagtacaacttttcttgattctaaggtatgtttaccaggattctttacattataatgaaatattgtgctctaattttttcccatatg

SEQ ID NO: 74859 - DNA, 966 bp, Oryza sativa
agggggatttattttctttagtttttcttttagtaaactttgttaattgtttttgttgcttaataattatttccggagctctgaaaattcaagtaaaatttgagggctccttttaaaccaaggagaatttaacaaaaattctccggaccacattcgaatttttctgatacgtattttagtgtttgccaatttcttttcgaattttaattaattctattattccttttagaaaataatttttaattttgggatgaatttatcaggatgtgacacttgccccataagtaaaccgagccaattcatctctctctctccatgttactgcacctttttttcttactatacatattcttgcagtaacgttatcaagtaatcgcggtaacacactatgttactatgaaacttataatcgttactacatcttgtagtaacggcgttacatgattgcagtaacgcatagcagatcagcagtaatacttatgatatagtatcgtggagagccaaatttttaaaaaaccaatctttgaagggtaatatctctcacatcatgtactacttttaaaaaccatttgcaccatgatgttagaaaaaaagtgcttatcaaaagtagatccgtcatgattatattatgactacatttcaatattgttactgcaagtaagacatgatgttactgcacgatgaacatcgcgttactacgttgttctgagacgagagctgataagagtggaggtggtggggaaagtgaagggcgggtttgaccgagatggggagctttgaccgaggtgtggggtgggttttgccccctggaggtaggggggtatagaatagttattctatacccgggtgtagaatagtttttctctctctctctctctctctctctctctatatatatatatatatatatatatatatatatatatatatatatatatatatatatatatatatatatatatatat

SEQ ID NO: 74860 - DNA, 25678 bp, Oryza sativa
  unsure (1)..(25678): unsure at all n locations
ataggcatgcaaatcaaattaaactctgtatcatatcactaactactactcccccgttttatattataagtcgtttatttttttcatagtcaaagttactaaatttatagaaaaaatataataatattttaaatataaaataaatatcaaaatatattcaatgttaaattatatgaaaataatttagtgttgtaaattgctaatttttttttctataaatttaattaaatcaaaagaatttttttaaaaaaaaatcaaaagacttgtaatgtgaagtcagggagttctggctttgatcatcaacactagatacggagtagtagctacgaagagatatgcatgcataacgctgacgtggagtaaagtagtttgcatgtgacgacacatgcatgcatgtagagtgaattaggaagtagatttttttccctcgagggacatcactcgttttgcgtacctatagttttaaaaaatacttttaagatagatcactatataatatatcttttcgtaaacatattagttaaaattcaacttatataatataaaacaaaaataacaaatttgactatgaattacgtgttcacttcgtagttaaatttattatttttgtttttatctatataagttgaatttgaattgaagtggcaaatcatatactgacctatcttactaaatttttttaaaaattttgatgactttttaagtgatatcccctttaaggattatttgagttttccgagtgaattactccactcctaccttgcaatagttttggaagagctgatggaacgagttcccgagtccggcgatgccgacgacggtgacctgtccatcaccgtcaccgtcgccggcgccgccgcgctccttcatcccgatcacctcctccatgtccagcctctgcatgacctcgccgtcggactccgcgaggccaaggtaataccccctgaacgccctcagctccggcgccacgacggcgtcgacggcgaggtactccttcaagaacggctccaccatctccctcggcatggagctcacgcacaccagccgccgccgccgcgccgccgcatcgaacacctcggcgctgacgtcctccaggaacagcttgggcatcaccgccctgcccacccggaaggacggcgacccgtccttctccttcctgactccggcgaagctgaccatgaccatgagcttggtggcccggtcatggccgagcaggagcagcacggggtagagcagcagcaggaggaggccgcggaagagccccccggcctccagcgcgacgagcatgaagtacgggaaggtcgacggcgacatcagcaggccgccctccaccttgcacaccgtcacgtccgccgccgccggcagctcgtccgacgacggcggccgcctgacgacgtgcggcggcggcggaggaggatgcgcatggaggacgaaggatttgagccgcctgacgatcttgttggagtggaagaggagggacttggtgaaggccttccacgacatggctgctacaactcgttcgatcgagcgcgaatattaaagcagcatgggcaaactctaattaacaactaattaagttagctagttgtattgggagctagtgttgcacctgtactaacattatatatagacggccgggcaggggcaccgcaggggagagggagaccagtgagagtaactatctctgcaattggcatgcttttggtcattgtgtttttatcaaatcaatcatatatttatgaaaagaataaaatgtatattactatatgaatctatttcatatagagattggtttcttctgtacggggaggattaaattttggatactcgtggcacgcttttcaaactgttaaatggtgcattttgtgcgaaaactttatatacgaaagttgctctaaaatatcatattaatctatttttcaaatttataataattaaaactcaattaattatatattattaccatatcgttttgcatgaaacacttaatttttatcttcatcttcatcctcagtagattcaaacaccaccgtactaccacgtatagaatcacactacaagctaccatgggtgggacccacgtgaataaaaaagggaaatagagattgatcactttctttgtgagcgcaatgatatctgacatgtgggttcagtatacttttccttaactgaaaccggatgctaccactagtgcctgtcactacgcttaattcaataaggagaattttgcaatgtatacagtcggctctatcaccttctttctcctatggaaccctttctaaatccaacaatgcacgtgctatataacatactcacatcctttgctccaaacaacatatagagtaaaaattcctaaggtttagaatactttaaattccttcgatcaggtcaacgaggagccctaaaatacattaatgtcaaggtaaaaaggtagagaagttaatagtgccaggtgtctgcaaatcatccaactaacaatatttaggttgcgttcgagagatgacgtacacataaagctagaaagtccctagcctttccacgcnnccaccacttttcttaaactattaaacgatatgtttttggtaaaaaaaatctatacaaagttgctttagaaagttcacattatctatttttaagtttaaaataattaatacttaattagtcatgtgttaatggcttactcgtttacgtttattttcattttatcattctgttttctctcaaacatagccttagacgccaaaattctttatcgggtaagttttcatctacatggaaggcaagtttacacctacatgaaaggcgtaatgatgtatgagagaaagagactcgattagtataggatatattgtaaagatgaaaactacctatatctagacgaatagctttgttgttcctttcctagctatatgcagcttaggtggaagttaggcacaattaagtcatcaataagatattatatattttagaggatcctgatctaacgcaacactgtatatttccaatatttttgagatatttttaatagacctgtttatgagtagctaggttagtacatcgacatttcactatatatgtcaaagtctgaaatgacatattggtttattagctgatgtctcacattttgttggaaagccccttccctgcacacagttagttgagccttagctacatggatcgatttccagctttaaagtgattaatacagtggtaaccatcaacacggaaggatggttaattaattggagcatacatgattaaattgccaagctggtggcaggcgtctatctatctagtacggagtactacgtgtccacttgtacagggctgtaattaattatatcagcgcttaatttcactctgttaattttccttgaaaaagtaaggttcactgttgcaataattactactcctaattagctgttcctacaacgacatgactttcgctaatttacatttggagtatatatactttggcgacacaaaacctcatgaggtttctggtagagtgatatgatatctcattggtggggtattgtatattaattattatcagcacgtctttgtatatagtcagcatcatgttggcgatgtacgtagctgattaacgatgaagatgcacacagattactcccacccaccgccgcgtttctctcactttaattaattgtagtatttgcaaaataaaaaagaagtgcaaaagagttgcattgctagctgtactattgataactacatgtacatttggctaggtaggatttatgtttgccatttacactgttataatattatcaatgctagctaatcatatgcatggaggcctgcagttgctccaaatttccattattcacaatatgcatgctatctagccatacaaaattcaacaagtccgaatgcatgcttgtcgttcccgccataaatattttatgcttaagataaaattgggtaaacttttaaaaattccgataatcaattttatatttaaataaatttgtaaaatctaataagtttataatattatgatagtacttttgaggcaaatacacatataccttttttaagctaagcatttgaaaatttactgatggtcaaaatttaaaaattttgatcgaatcttattctgagggttaattttttttgtatgtcctgccgtttcccccaaaacagagggcagcctgcgcactgttatatatatcaaatgctgaacatgcttgcaggctacagttcctccaaatttccattcacaaaaacagtctgcatgcatgcatgttgttctaggcgccatacaaaatgtcatcaacaggcttaatcaaaattcaaaagttatctccggtcattgacgcccaggataagatttgatcgcactttaaaatcccagtaatcaatttcatattagaaatgtttgaaaagtctaataggataatagtatttttcgagacagatacagcataccattttttaaattatgtatatgagagattttgttatttcaaaagtttgacaaaagagagtatggatgtgcttacatctaggggcgtaaagttttagcgtgtcacatcggatatactatacgggcatacatttaaagtattaaacgtagtctaataacaaaaaaaattacataatccacctataaaccgtgaaacggatttattaagcctaagtaattcgtcattagcaaatgtttactgtagcaccacattgtcaaaatcatggcgcaattaggcttgaaagattcgtctcgcaatttacacgcaatctgtgtaattagttattttttgtctatattttaatacgtcatgcatatatccaaacattcgatgtgacatagtgtaaatttttgtgaggggatctacacaaggcctatatacgcactggtgctaatttttcaggtatatagataaaattagagatggcggcttatgatatgatagatgaatgtgatttgcctcgatctgcatgggatgggcacaagggactgggtgttccaaccgatctgattggcacttgcagtattaattccatcgaccgaactaacactaggtttaagtagctacagagaaataatttaggtgaattaaatatattgttctggtctccagtagcaggtcaggccaccttttcgtcgagtgaaagtcacaggcttttagctgataataaattgggccacctttgataaccatccgaaaaactagtgttttaaaaaaaaaacccatcgcatgtgccaacatatggattatggcctatacatgttattttcatatttgatgatattttgcaactcacttgtctctaacatggcattttccatttttttctcaaataaatttcaatcatttttcgtcaagctttagtcgcgagaactgaaaaataaattcatcgatgtccaggtaatgctgcatatgcaccaatgtaaggatttcttttcccccaatgaatgtcaaattaattgaatgtactccctccgttttgaaacggaggaagtacattttaatttgcacacgtacttacacaagagtctctgaaaaaaacgtgatattaatttcaaataaatttatactattgtctagggcagaaactgaaaagagaggacaacaggaaggccacacatacttttcttgttacaggacacattgaagttgtattacaccggagcagcagaattgagacctaactacacgtggattttaaacatgacaaagtcagtcagaaaaataatcaataaaactcaccccttcccttaaaagaaaaagtcagtcaaggcaagcatcacccacgaaagagaaaaaactcaatccaatatttcccttcgccacaattttcttcttttttttttggcattgatatcgattaggctcatagtactgtaacttaagcaggcagtgcatgtcattggatgcaaatcagatggtacagattgcatgctgtactgtgcatagtactgtagcaaaatactgtagtgtgaagcactgtagctattactactgtagcgctcgctctgagccgttgatcgtaaaaatggatggccaaaattgtgtgcagttttatcttataattacaagtgtaactgagtgtaactgcacccgatctcaattctctaaggagtaacatgatatctttagggagaaattatatcctcacacggtgaacatgtcgatcatgtctgcacgtggataagcacgtaaccttaatcatgcaggcgtaaatgcaaattaggaacgcattaagagaaatgtttttgtattgtgtatgtattatctcgactcgatccatttctcaagttgtgataaaaattttccgatgcattcattgcaagcagcaaaaccacaatgacgaccaaaaaaaaaagatctgactggcgaacgaatttgcgatcatatgggaaatcaatgtcaaactacagttagttagtttcctttcatttatgcaaattaaacaggagagttagtttgcttatggtgaacagtgcctgtactaacaaacacgctgcaatggcataactgatgttagttaaaacataaccatagccttatggtgcacgagacgcctggaagaacatgacggtctctaggcacagcaaaatcaacagtacacacgaagatgacacctgaataacttgaccaaagtccaaaggtccactgcaagtactagaagtatcatcgtatcactgtataagaaaaaaaaaaaaaagcaacctccatcgacaccctactaaccactgatgcatcattgttttgaagtctctattggttgtgtcccggcatagtaatagattaatagacatgatttattgtttctaataagtacttgtataaagatacattgacgtgtgggtggacttaggtcatgtaggaacctgcgtgcttgcgtcgtggcgcttctggtctgaatcgatttacaggtggcgaaagaatggtggattggtggcctacagcttgaatatggctgctccactcgacggcttggacgcgaacacgtacaacccaagatccttctggttgatcactccccggtcgatccttgatttatagtacgtttcctgcaataaaatgtatatcttgtcagtgaggatcacctccaataaacagagttgggtgctgctgtttcacttgaaatatgtagactatagttgtctgcgtggattatgtatgtattatcatgcatatatgttgcttattggataaagacaagagcttacagatttaatttacctttaaattgagaataaactgcgggacaatgccttccttaaccaaagcgactgcacagccaccccaccctgctccagtaagacgtgctccgagtgctccgttgtctctacatacttttacaagctcttccaactcgggacagctgggcaatggaatatgtcagtatgctataactttttttctgaaagagaggactgttttcatgacatccgaagtgtcaatacgagttttaagtatcaatgtgtctgctcaggaacgatacccatcgtagttaaagtacactactaaaaatggtacctgcattcatataacacactgcagctatagtgactttcattcataagatcgcccagtttttgaagcatatcttccgcactgcagaaaaaagatagcaacagttagatctctcaatttagaaataaatgttcgtatacgggctgctaatcgtccatgacagctgtgaggataaatgtagtaagagaatagttgggaagaaacaaacaagaaaataaccagaatatgcatggtgactgcaattaatgaacgtacctgagttttgacaatacagtatctctgaaggcataaacccgccttgcttccgagtacacatgaaaggcacgctgaaagtaaacacacattagaaacttataaccaattggcatatcatcaaagggcacagtcaaacatattcctgagttacacaaaactaaagcgaacttcagcaaaaaataatgcaaaaaaaaaagtaccacgcaaaaacaaagagacatgtataatagaatgacaaaatatctttaaaaaacagattttccacagaagagttgttctactgagtaggactgcatcaaagggaaatcacctgaaataacttgaaatgctttgctgctcttagaacatccaaggaagtttgagagctctggaagatagatgtcaggctttgacctgtaattttctctatttcttctgttgtatatgattcttcatgtaatagtttctgcaaaattacacaataacacaatcagatgagtacatgataagacagaacaaaaagaactttccagcattacttttataaaaaaaattatatacacccaaacgctaattacaacatattgtaaccaagtgtcccatatgagtacaaaataatgaaacataacttgcctaacttgtaccgatcatctcttttctcgaataaatagatggaacgtacgtatatccttcatgagaggataatctaagttcctgataaaattttgtaccttcacggcaactccaggatcagaagaaccctcttttccagcaaaagagacacataacccctcaacatcagagagggtggtaacagaggagacagccttttttgtttccatccctagtttgatggcaagaacaatctgcaaaaatgcaaaacagcaatattaaatgaacaaatgaaaaagaaatatcattactttgttggtgatatagcagccagctcaaatccagttccaaagtaaaattttaaaattgccctagaagctgaataaacatgttaaggtcacttgcattgtgcagcagcacaacagaaaggaatctgggaacctttgaatattcttaaaatttcaattcaaaattaaagtcaatttacagctgccaagtcacacatgtgcaaaataaagatgtctgaaactagtgtttaaacatgttcagtccgaaataaatcacttactgcagccaggcgacattcaacaacacggttgttatagtttgttgcagctgtctctgctttcttggactctgccaggcaatgggcaatcacaaatgtaccgcctggaggtagttgcacatcagtggcatggattggattgaaatctatcaactcagcaaatccaggtttggccatgatagatatagcctgggaaaatataatgaaatgttaacagacaacagggtagttcaaaataaaaaggccaactaaaatatgttattcattatataaatagcattgcttgtacacacagtaataatatataaaaagttctgcaaaatttattgatggtcatcctgtcatgagttgattttgtaatcaatacttggaaccacgatggttttttgcacgtaagcatgattatattaacaaaaagtttcagaagaacacaaatagtcaaaggattatatgaacaataagcgatacaatttacgaagtagtatatttggatgtccatattacaaacatagtaatatctcgtccataagctaaccccaacaaatgacattttcctttagacagatgtactttgatttacatgacaggtggcataataataagttaaagtacaaaaagaactgagtattaccataatcagttagaaaactatgaactatttacctgatccatgcccccagattgtgttccaatgtggcgctcagattgacaggtgaattgtgcaacttctttctgcatgatttgaatggaaaaattagaaaaaaaaatctcttgaacttttctgaataatgaatgcaaaaaggaaactgaaattacagaagtttgaacttagactatgaggtgaacatgtcaggctccagtttaaacttagagccaccaggatcaattttatctctcaagtttgcactgttcaagttcttggtgtaccattttctataacaaatacatacccattatgtacaaaagagcagttcttttttccccaaattttatggtataaaatcacttcagcaaaactcaagattcatcattctatccatccatctcacccttatacagtgtttcagttgtttgcaatccttttcagaggagtttggtaggcttcatgcctcccatacgaattaaaaaattacttcactatcagtttaggcaattaatattattttgttttgtggacagtactggcaataagggagctatgtgaagataatggcaagggagttgttcgattcgtagcaagggatacctttgggaaatttttctcaagaactcccatgatagcaattgttgctgaacagacaaatgctgctgagcttgaaagtccagatcctacataagagtaacaacacgcaatcatgtcaaacttaacatgcttattatttggaagtgaaagaatcccaaaacaaaatatcaaaaatatacctgtaggaactgtgccatcaacaactacatcaaggccaacaggtccacccatatctatcccttttgacctacaatactcataaactcccttgtatctgcagatagagaattgaacagacaggatatgttcgttttctttttcttgtggccaatgaagtgtatgaaaaagtgaacaaatttcgctatttatgcaacattatacaatattataagaattaacttacccacacatgaaatagtggccccatttgtggttttttatgtcaatttcctgcatgaaaaatatttatcaacaaccaaatcaatatatcaaagaaataatcaaataactgaagctaagaaaaaacagcaacttcagacggatcatggcacaattccgaagccagagatagcattttccatttcatattattccaagtcaaatagaattaagaatgaagcaatagtactagtatatgaaaatccatttgcaactgcaacatgatggcccccatcgtttggcttattcggcatatttgaaaacgaaaaataatttataaataaaacttttatattagtgttcttagcgatttaaaagctaaggctgaaaaataaacttcaatgaaaaaacctcaaaatcaactccaaatttaagattaaaaattcaaattttggctgataaggctggatgaggctggatgcaatgcagtattaagcccccatcgaagggctgaatgggagtccacaaggaatgtttgcaatccatttgaaggccaccagcctaaaacaaaacaaaggggaagcatggacttccacaccattatctctgtgggccacaagcccgcggggacaacaaattaagctcacgggcagggcaacgaaactgtatcacgggcttcttgttatgataataaattaattaatggggtaataacgcaaccacccacccatcctaaaatagtaaggagattgtctctacctccaccgaaaaaaaatggaatccgatgcgctacagaaaactctctccctttttctctttagaatctcaactaaaaacattccccgcgataactgataaggacctacgttcttcaatcaatctcaaccaacgaacgaaaaagcaaaaaattaacaaaatccactcaaactgagcaggattaatctaggaacaggggcaaagcagagtagaatgctggcaaaattaaccttgtcggggtcggccgggtagacacagatggggtacttgtcgtcgacattggcgacgcgcacctccttcccctctgccctcctgatggcgacgatcatgtcctgccggatggccatgggcaacaccgagtacccctcgtagtcgatgtgctcccctatcagattcacccgccctgcacacacacacgcacacgcaatccatccttgtcagatcaaatcaaacgcatccaccgaaacctagagtggtacccatccatctatcaacctacccggagagcgggcgaagagcgcggggcgcgcggcgtagacggcgtggaacttgtcggcgaggcgggccaagcggaggcgcgcctcgtcgagcggagagccgtcgccgtagatcggctccagggaggagaacgtcgggacaacctccgcctccgccgccgcggcggcgcctcctcctccgggcacccgagccgccatcgctggtgctctctcgcctcctcctcttccgcttctcgcgctgtctagcgaatcagtcgtcgtcttcttcctcacgcctcgtctctatccgttacaagtcgtatcacactctatgtgattgcggggtggcaacttcgattgactactactaaccttaaccttaaccttaacctccctgggttatatagacgggggacgtgatgactcaccgtcgcagacaggtggtcccggacttatggctggcccacacgtcggtgaacgtgtagtttcggactcggaatggatagatgggaagtgggacccacttggcagtgagagagtgcagcgggcggttttgtggggcccaccggtcagtggcactggatgggcggtggggtggacacatggcgagggcgtgggccaactgccgattagttccactaactaattaattattatccgattatgggtgattggattttgcttatcggcgtcatcggtttatatcctatcggtatcaaaacgatttgccacagaacacgtaatacgattcggcgtccagataactttatttatcatcatcaaaagatcgtttagaattcgagtaagatttatcacgtcgttagaaatgtgggtccatatttgtgttctactagtagctctttagcttctcaattattctctctatttcacactataagtcgattgatttttttaaaattaaacttgcaatttgcagtaaaatataataatgtttttaataaaaataaatattacattaaaatatatttaaaattggatttaatataactaatttagtaccttagataatgttattttttataaatttagttaaacttaatactttaaaaaaaaacagacgggagtactaggagacacgtggactcggtagcaacccaacatggtgcgcatcgcgtcacggctgcgcgcatataggcacagtccactctccagtctccatagagggaggcaaattactacattatggtgtttagttatttaggtgtaaaattattaactatacagatacatatttatacatatttaaagtattaaacgtaaactaataacaaaacaaattacagatttcacctgtaaactgtgaaatgaatttattaagcctaattaatccgtcattagtaaatgtttactgtaacatcacattgtcaaattatggcataattaggcttaaaagattcgtctcacaatttacatgcaaactgtgcaattggttttttatatttaatgtctcgtgcatatgtataaacatttgatgtgatatttttgaccaaaaattttttatctaaacaaggccttagtcaaatcatattggtgcattatttaaaagtataaccagcgttcagtaactagtacggcatgtgtatcatcaagtcacaggcacctagcatgacttgtttttgttaatcccaccttccgtcagcttcaagcttaagcagctaagctgcactttccgtcgagatacggacctaagttttgttatcatactagtattatacaatcgctatttttaaatagatatattttaaaataacatttaaccattcatactattttaaataaaaatatgtaattatagtaaggtataaatcatatttaaagtttctttaatgataatacatgttataaaaaataaatattatttatataattttttaaatagaataaatagtcgaacataacatcaaaagttaatagcattatctatttacatctagctaagcaagttgcaatgtgtactatacagtcatcatgcgtacccctcagaatctttttgggacgaagagagtatatccgatcatctgctttcccgcgtcactaagtttctctagcttcaagtagagtgaatctagcagctgaaactataccaaacatgtcctaacactggatgggtcaaacatagaatatcaaacatagaatatagtacataattgaaaaagtttgaacttcctattcaaacgcatggaagaagtttgaggctttgagccgcatgtgtacaagctcattcgtgaacacaaaataaacgcatacgagacaatgttcacaaaaaccgctataacttacattgtttttttcttttcacttttcttttgttaccagatagctaattctgctggcaaattgtttttacttcctcacaattgacaaccgcgaaccacattacaggacagagatgcaggcgtgcatcatatgaacagaaaacacatcagcgagaaacactacaagatcatcgagtcagatacaaagatgctccattccattgctaatcctgaatagttttacgattgatataccataaacttattaatattgccgcctttcttcttctgcaatagctaccaaatccagctcaaggatctcactcgcatttttgggctcttgtgatctcccatactggaagaaatttctcgccttcaatatacgcttcaatccgctggctggtatttgcaatagcgaccgtaaaattctcattctgaagagtatagagatacattgctcgttcatcctggtaattcatcaccgggaatttttaataagaataggaacagaaacttagcaggcatagacaagtctagtaaagaaaaaaagaggctgatgctacatgatgcacaaaattacaggattagctataccgttttcgtgtgccgaaacatgtaagtatcaggacttgctacctatgagttcgcaggaatgagaccaatagtgactaagctgagactttggcagtgaaccaggtaagtttatatgcaaaaactatcaccacagaattgttccgtaaaatatcccaggcagtggcaagtgatgcgtattgaaaaggtgttctcgattattaggtacatgtgtaagaattttgttggttaatacctcagggagttccatatattcatcaggagatatttgaaggaactctacggctgtttgcccaatgcaccaggcaaaaaccttttcactgtcatctgcaatggtcaagtgaagctgaaagccatgtgtacatccactgatatggcatgcgcacttacagaaggaacactgaagtccgcctgattgatcactcacaacacacccacaaagattgtggaataataataccttcaaactgttgacatcgatgtggtcaagtcgaacatggcatatctgtttattaagatatcaaacacaatcaggatattaggaacgacaacacaaatgaagaatgcaaagttcttaaaacaaacaaaataggtaccagaaaatactttctaaaatgtcactgataactctgcgattccatctaaaagaactaaaatgtaaatgcttcagaagatgtcacaataataatgaagacttacatgtgttctattagttgaatggggaagatctgacaagagtgacaaattatgcaggcatgttgaattaagaagcgctggcagcaagcttatgttaacaaatagagaccctggttccttttcagtccacgcgacttcaagcctgtcacaccaaatagtccaccaaccagaatttttcaccatcaagcaattattgcgacatttaaattgtgagcatatgaaattaaaaggaatatagtgcttacttgtttgttgaactcaaggtacaagtcaaaccagacatgtacaccatatgaccaacacctaccctgcctagcgacctgcataaatatatctataaatggatcgaattgaagtatagtagaggcagatgagctggcataggaaatgacaattttgtaaaaaaaaaaaaggtaaccttatctgaagaacactaaacaaaaatgatcgaatttagaacactgaagagtcaatgccacacttttaaatggaccttaatctttaagaattcattacccacaggctgtcaggcagaacatggcatcaacataaaaaaaccagtgaacataacatcaaatctttgtataagaccatgcagacttgcatacagtgtacaatttaggtacctcatgaattttctaatcagaattcatcagttcatataacaacagctccaatcagaaaaaaaaaagatatggtatagacttcagaacatcgcgcgttcacaggaaatagataaagaggatgcacttggtttttcttatggcaggatgcaattgatttggtgcaatataaaatgaatatcaaaggctcagcattgatttgataacagaaacagaaaatgacaaaacaatcagttcttagatggaagaaacttgatgaattcctatttcaatgatatcctgctcagtgcaaaagcaaattggatatttatttgccaggctccaaactgtttgaaacttagtacgttgaccagctttctatatttaaacctagcacacattaactcatccaaactaccaaagcatatatgccaggatattgcaaatttgacactcaacactatgatcagtacaagaagaattttggtttgtatttcaagtcaaataatcccggtgatattttaagtcaaataagcaaatcattttcagacaaaatagggaatagacagtgggaaaactagatcattgcataagtacaaaaactgataccagagtccaatgaagttaagcttcatcaggacaactcctgttgcatcttctatctccaaataaaagtaagtgcctgatgtacttgctttgcaaacacttgttaccatgccaaacagactaactccaaccattttatcatgaagatcacttacgtatacctaaaaattagacatgttatagaagcacacagcaatgaatatatcacgggaactttactgcatgcatgataattgataaatacttttatatggtataaaagttgcattagactaaaaacaaacatgatccacagaccacggggcaagaaagacagcatgtgtgtgtgtgtgtgtatagctactatatggcaccttaaggtgctacctattaaacggcacctgacacagtgatttagacccaccaactgcgcacacccccaccccccatcctgaacccacctatgttgacgtaatagttaaattctgactaccatccacgtgtcttttttaccgtgtgtagtcttttctgcacctatgcttcattgtacactcatcagagtggagtaaaaaaattactactgacttttacctaaggaaatagattattctacgtgttggtgaatttttaccatccatacagggactaattgtactactgcactgcaaccttttgtttgtccctgaaaatgctaatagcaaaaacgaaaaatacaaaatactgcaacataaaatgaaaactgcagttaagtaaaaatataactaaaggatattggtacctaaaaatacaattaatagaaaaaaagaaaaatacaatactgcaacattcagttaagtaaaaatttaactatagaaaatacagttaacagaaagaaaatgaaaacacagttaagtaaaaatataactgaaggatgttggtgctagtttctgataactctagtacttgatagtaattttttcactaagttgatttgatggtgtgggacccatgggaaagtgacacatggtgagaggcagttatttttttactgtggttgagaaagagaacgggaaggtcgatcgggtggtgagaacggcaaaagaggaagcgaaggcgctgaactggaggcttgaggcccgagggcgctacctattcgatggcgcgctacgcactacgtagcatgaccgtgtatatatatatatatatatatatatatatatatatatatatatatatatatatatatatatatatatttcaatgatttccctttatttcaaggaatcaagaatttcaaatgctgctataatagtagatgatcatgaaaaagatgaaaacaacaaaatgatacgggaagcatgaaacatagatacttctgaaaacatatttctaccaagtaaaacagcagaccacacatatgtttatgttactagatatattacacctgcattactaagaagcccatggaatgagagcacaagatgcacttaaacaatattaccgcaaattatatactaataaattactacacatattagtcagtaataagggatcgagtgctagttttcagatgattcattcagcacgttaagataaacacaatagtattgctttgttgataatgaagatctgaacaatataactcgatgcagattaaaccatgaatagaatcagtcgttatatgctaaaccaataaaccttcagttcccaagcaagtaagcaacataataattggtacgtttatctgtaaaaataaactcagaaaaatgaagttcaggttacttactcgaaatggatatttgctgaaatcaactgaaccatgcaaatcacgtggtaatgttacttgtgaagccatatgatcacttggaacacatgacaatcgagacccttgactccttatttgagtaggtgtaagaagtacctagcacacaatcatttccatcttggtcaaaaggagtagtgcaaaaagatgtagcaccaagatattcataccaacctgttcctcctgctgagcaataggcaccaaataaacctgtgtagcactgccatattcaaggcaaagttcctgagactcctcatgattattgtgcacataatttgcaataaaaggtctgtgcagtgcaagcatgctccctacgctaaaatagaaagtttagtttacaataacttgaatgagacatttggtacttatattgagtggaataaacctgaaaagatttgcaagcaaaacctgctccccccataaaacaaattttatttttgcatcatcattgtcaacaagtacaatctgctttctttctgtagatccaaatggttctaaagactcgatcttttcgatcctacagggcaaagaaatagcagtgttacaaatcgttcaaggtcaagtgatttggttcattctattcaacttatattctcaactggatagataagctcttcttcttctttttaccagaaatcatagtgttggtaactgaatgtgttgtgctaatatagccacagcagtacacatagggtgtgttcagagggcatttttgcagcagcagctgcggcggcagaagttcaaaattgctgcggcttgaagagactatgtacagcagcagctgcagcagcgatagctgccgaacagggcgaatgtaaaaaatgtcaccattaaaaactaaaaagtacaatatatctaatatacctggcataaaacgaataggaaatattgtttctgttctcatctagcatcatagatgagaaagaatacatgcaaaactgtgcggcaagtaacatggcatcttcatcttcctcctgtataaattaaacatgagtcgaaactaaatagtgtgtgatatagtacgagaaaaaaaattgaaccagttgcatctagcactccacagcacaaatgcaaaattttaacttctactagcagcttaatactagtattgaatccttataagaagcaagaagttagcagctagtttactgagggctgagtaaagaacaatgaaattgtttagtgtttagaagatatttttgtaatctattatcactgtgaacgatgaagaaccatgagggatgaaagtgaattaaaagaaaaaagaaaattgacccaagaaatgacaagctgaaaacaaaaaacatgttgtgaactccacttccttataaacctaaatgtgtttcttaggtacctcatcaagtaacatcaccatatattctgttggcaaaatacgagcatggcctgatccctccatagctgtacgtaggcaacatcccgtgagcataacttctcgacccttcttcaagacatcatgctgtccaatgtagttgtagtacctaacatgaaaatttagagtcagtccagtaacaattttaccttcattcactgatggatttctaatgcattattaagtagcattatctaagcaataaatagtcatactcagatctaccttcggtgtagatatagatcgatagtcgatgtgctccacatgtctcccaaggtaagcatgtatatgtttgtacctacaagacagtttaggaggtaatcgaagaaaatgcaagttagcagccatatataaagtgcaagttcaagcgattaattttatcagtacatttattcaaggatcatgttggaaaaaatgataatccaatgatcaaggatattcataagatttaacttgtgcccttgttgaggaaaaatgacatagagaactaataggcattctgtttactactaaacatccctgcagaggacaaatattctgatacaatataaaaatagcttgtaacaccactcataatcttaatgaaatttggctggcccaggctaaaaaatataaaaatagctaacagatatagtttctttgtttgatagaagcaaagtataagcataccaggaatgacaaacacatcaatgacaacagcttcaaggacactcttaggagataggaagttcttctcatggatagaatcgattgtgatggtattaggaagccgccttcttctatttcttgtttttagaagattggtcaattcaactttcctctttgcggtcagagacttgctttgttctgtccaagactagcaaaagcagaaaatatttaaaggctaatccacatgtccaatgcgaaaagaaatggtgaaaaaaaatgcaatcatggatttgaaatgggtttgcatttgttagtctgtacacaagcaagaagcatggattgccaaattgtgttatccttggaaaaataatataagccacttgcttgagcggtgccagaatctatggggggtgattagtgaataattgcttatgtatgcccttttctgtttcgatatagagatcacattggttcgacattcttcgatatatccggaatcgcattcagaacaaatttgattctaacaacgagcacaaggcacaaatagaaactgtaacagcttggagaaagagttgcatcctcgagatgtagtttgaattcaagtaaaaatgtctaacctggaagaggtcggagagcaggatggcggcggtgacgccgctggaataagcgcagcacgacttgagcacttgcgccaccgcccacccccacggcggccgcgcaggcgctggcccggcgccgggggactcgtcgccgtttcccccggaggaggaggaggagagcatggagatggcgtagtcgacgaactcgaggaacgcgcccccatcggcggaggcggcggcagaatccatggaaccctagacaggaggaaggcgggggagacggcgaaggcgaaggagacgggcgcgaaaaagaaaaaaaaaaacgagatggagaggagagtgaaggaaggagcgcgggaaaagagagatcacggatacgcgcgcggaagatactgctgctattttacagcgagtttttgggtcttgcaacgttggacaccgaaatcaacgtcttaaaaacaaaaacaaaacaagaacagaaagtacgaaataattcggagcagtttcttataaccgtgtaatattcacaagcacaaaacttaattctctctctcagtattttttaagctaggttttcctacctacaaaaacccatggtccgtaattacaatcattttgtttttgtttgagataaatataaaattttaaaccatttcaattcaggtcctgtttggcacagttctagatctcaaatccgcagtaaatttgaagtttctatattgaattatagtggctcaaaactttaaatttcatacaaaatgagaataaaatgatttatcctaatgttatcaatgtaatctatggatttgtggagcaagaaaaaaatcttggatccagaactgtgtcaaaaaaggcctcaatttacggactccaaatccagtgtgaatctgctaaacagagccaacccatctatgcctcctcttgtttcaagttatccaagtctcaacttaaaaaattcaagccgaagaggactgaaactaaggcagtcacctatgcatatgattatgagtgaaatgcaccactaataccacaacctgtaaggtgggtgcaatttagtcatccatcttataaaatgctcaaacaagtcactcatcatgttttaggggtgcaaataatataaaacatgcgtcttgtgggttgttcgcaatgaaattatgtgctatgttaatttattttgtaaacatggtcacacgattcataaataagccaacatgcaatactaccaatagtaaaatccaattaaaaataaattttgttattgactgccaagcacaatatggtcgtgtatatacatgaaaaatatgagcgttaatttgtaattttaacgcttgccctgcccacatggctaaaaaatgcatgatgttaggacaatacgatctccaatttgaaaacaaataatccatgtgacaatgtatttggtaagatttacaccattgaaacaagatgagtgacttaattgagcaatttgctagatgagtgactaaactgcactcacctcgcaagttgtgataccaacggtatattttactctatgattattatcaagtagtacaaataatcactaaactaatgatcccagaaactgtccagtggataatcaagtagagatcagcagttttgtatgctgcagaatgtggtgtcgatatccgctcagaaaaaagaaaaagcaaatgtggtgtggatagacaaaccttttttcctcaatacaaaagaaactagcttatgtaaacgagaacaaatgaatcaattaaaaaatacatgataatccttaataaagctccctcaactctaggcaaagttccagcttcaggaatatgcacatttatccgattcgtttgaggggaaaactgacaatttagaaggtagtcagttttatgtgcaaaagccaaagggaaaaaagaaaaaaaaactgctgcaggaggttgtgggctgttcacaatggtatggttgatgaaaccatcagagtagcgattgttgcccacagaaactgatcattcatggtaggattagctcataatcaatgatctaaagcacatctgatggatagagattgcccttgtgaatgacctttagctaattggtcataatttatgaataagacgatgacagtgatatcgtcatggaaatgcctgcgaaccttcttgtcaatcttcataaggtctgaataacgcatctcacgtttccgtgctgcttcatggagagctgcctttatgagccttcttgcacttccctaaatttaaaaaagtgttaccatcaaatagaataaattattatcctattttaagtcgttaggcaacaaccatgaaaataattaccatgctagtaggttgaagcgcatactgaaccaaattttctacagttattactagtacaagaaaaccagtgtatcaaattgtcaacagcaccaattatcttaatactagctaggttagggcatagcaggaaatgcaagcatgtgaatcatcaggagcaaccatatagaaaacaaatatatagccaggaagacaagtaatagactgcagtcattacactgcagcaagtaatatgtccccagtacttatcagaaaactggagctccttacatataagcagtaacaattcattattggtatggacctacaataaccctgtccagtatacatcatcagacaatggttatcatgaccagactgttcctgccagcagcccagcactacaggagagcaatgatccattgagaatggtatttttggcccattgctgatacagtcacaagtcacgacacatgattaaataaatggaaaagatcacagtaataggatgatcctattcctaactgcaaagcattcaaggaaacagccggcgatgtcaatatttttttccagcttgcaggttgtaacccagtggataactgtggacactggacatggattgcatgatagtaaatacttgcatccaaagccgcacccatcaccaaacaaaataactgaaaatttcacggcgcatggcaactagattttatgcagactatgctcatttagttaatcaccaatcaagtatatcagcttaatactttctgaatttgttgttttagaggatacacatagcacccaataagtgtctagtctaaatattgcaatgcttggacaatgctacccaaaatactaatgtctagatgcaaaacagaacttgaattatactgtcaccctgtggaacaaaactagcaatacagaggttcaagatctgaaactttaatgcatacatttgattgtaaatattatagcaaaatacatcaaggcattatttccaggtgaaataaggttccaaggttcaccgttcatgtcctgaagccttaacaaaaaattcagtgggaaaaactccggtcataaaatattgcaaattgtttaagatcacttgggccttgctcgtttaatcctcaagaggagggaattggagagtattgaggggcaataattccacaccacaatatgtgtggaataaattccctccaaatccccctcaatccccttgtgagagggattaactgaacaagcccttaggcaacagcagagaccagaatgtgaagcagtagataaacaagttaaatgtgcagaatcttacagctcgttgatggttgtgcacaatctcaacagcctgctgattactcaggtgttcccacaaaccatcggaggcaaatatgatgaagcaatcacttggttgaaggcaacgtgcgatgatagatgggttggcactcaatataggcctgctgaatggttcagggagcctgaactttggtttgatctgttccgtgttatactgactatgctttagatatgcatcgcctaatgatctggacacctgcattgcccaatacatttactgagaagtgaaaaatatatatattacagatacaatatcctgtttcagcaacaggaaactgaacaatgcgataaaaaccaacctgtatgatgcccttgactctccaaaccccatgtttaagagcaacaatctgaggatcatctgggtgctgagccatgagctcctgcctgacatcctcttcattggcgttatgctcactggacagttgctcggcggtaatctgaccagcgcgaccaaccttcttcccaagaacggccctggaatccccgaggttggcgacgaagagcgtcctctggtgcacgactccgacgaggcagcacgtcccgacggtggccatgtccggctgcgcctcccacatccgcgagacgaccgcgaggaagccttcctccgtggccaggaacgcgtccctgatggcgtcggccgtgacgccctccggcccggacgcggcctctgcacggatcaaccctaagtcgcgcgtttccggcggggcggcggcgggtaggaagggcgagggggggcggtgctcacctcggaggttggggaggaggtggtcgcaggcgaagcgggcggcgtcggggccggcgtggccgtcgaagacgccgatgcaggtggcggcgaggggcggcgggcccgactcgacgcggcactggtcctcgagcacgtggttcccctgcacgacggcgacggacagctccccggcgtggcaccgcgcgaggtcccgccaccacagcaggccatccctgccctcagcagcggcctggtccgccgcggccgccgccgacgaagacgacgacgaccgcgcgggcggcgccggtgacgtgggccagaccccgccgcacgcggagagcatcctaaggagcgcg

SEQ ID NO: 74861 - DNA, 9467 bp, Oryza sativa
gtgtggttgctccacgtaaaacacagtgttatacacggtatccgtcgcgttactgcacagttttgtgagacgagagctaagaagaggtgggtggtgaggggagttaataggtgggtgtgtctgagctttgatagacgggagggggctttgaccagtgtgtgtctgaggtgggaggtggtttttgggccttaaaaaagagggggaggtgggtgtggcccttcagagagagggggtatagaatagttattctatatatacaatagtcttacgctatatatatttcgcgcatatatatatatggaatacatatatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagacaattcatttgctcactagctagctacgactttgacgccggcattatgtcaaaagaagaaggaccgacgttatgaattgtcgatccgttgtagtagaattcaccctcgggattaaggacttcttcgttgatgaatctcatcagttgttcttgaacagccgtgatataatccttgtgtgggagattgtccctcatgtgaatacactatcattcgaaaaataatgacatatgaatatatgaaattaataaacagcaaatcgatacgcaatgaaattttgaatggtttatatatacgtataccgagctctcgtgtggtgtagatttgggttgataggaagtgggcatactcgcatacgtagtagccgcacaggttagttcccaggtcatgctttgcacactatatgagaaaggacaagagatttaatatacacttatattaactgtaactagtaatcatatataattagcatatgcatgatttaaaattgttaaaaattctaattatcatatgtaaataccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacaaaaggttcgtccgagtatcgaaccttgttaaggtcaaccgttgtcatcccactgtcatcaatcgttacgcctccaccaatcaacctaactcattggcaccggaacagaggaaccttgagaggtccatagacaagttcccatatgtcctcgatagcaccgtaatacgtgcaagttgtaccatcgtgtcccatggcatcgatacgagcagcactgttctggttcgtgctctttatgttttggtctctcgtgtagaatgtgtacccattgatctcatatccttggaatgtcgctatcgagccagatggtcccctcgccaggtaggcaagttgttggctaatcgtctcgttacccatgagatgttgtcgcagccacacgggcaatttatcaatgtgatgccgtgtaatccatgcatcggacttaccgatgtttctggcgggaactagagccaagtgctcctcgatgtaaggagccaccaatgaagattattgcagaaccgtgaaatgggctttacggaataaattgttgtataccgtcattactgcgttccttctgagagtcccctttccccgtagtttcccttcatggcgtgattcaggcaccccgattgggcgaaggtcttcgataaattctacgcagagttcaatgacctcctctgttccataccccttggcgatgcttgcctctagacgagcacggttacgaacatacttcttcaaaacgctcatgtacctctcgaaaggaaacatgttgtgtagttacacaggcccgagaataccgatctttttgacaaggtgacaaagcagatgcgtcattatattgaaaaatgaaggtggaaatatcaactcaaagctgacaagacattgcaccacatcattttgaagggcttccaatctatccggatcgatgaccttctgcgaaattgcgttcatgaaagcacattgctttgttattgttgcccggacattgtctggaaggataccctgaattataactggtagcagttgtgtcatccacacgtgtgacagtcatgagactttaggtttgtgaacttcttctccttcgtgtttattattcgctttatattcgtggaggacgtacaagaattctgaatagggtaactcccaaaatatagagttctttttccacatcaccacgtgaccatgttcgctatcaataggctggctgctaggcccctttccaaacactactttaagagctttcaccatagcaaacactattttctcactgcgatgtttaggcttcgtacggtggtccgccttatgttcaaagtgcttgcctttcttccgtacagggtggtttgcagcaaggaatcgacgatgacccatgtacacaaccttcctacagtgcttaagatatgtactttctgtttcatccatacagtgagtgcaagtcttgtaccccttgttagactgcccggataggttgctaattgtaggccagtcgttgatggttacgaatagcagcgctagtaggttaaactcctcctgtttgtcctcgtcccacacggggacaccttatttcttccacaacagtttcagatcttcgaccagtggtcttaggtacacatcgatgtcattatcaagtggcttggggccttgaataataatcggcatcattctgtacttcctcttcatgcattgccaaaattttggcaggatttcttatgtattaaccagatttggcaacaactaaacgtagatattttttggtaactttggcaaaaaatgatatggttgaaaatggcatcaaagtgaacaggccctaattaacttgttgacagctactccctccattccaaaatataaagtataaccacccttaactcaaagaccaagaaaaaattattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaatagagggagtagtacctaattaagcatgtgtgttaatttattattaactagtaatctgcccgtgctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagctaaagtccaatttacacccaaacttcaccatacctctcatcttctcataggaaacatctacatggggccaatagatagccactcatacttggttgagtgaagtacaagtgggatcacagcctcaaaccactgccaactcctttaattcgtctctacccctcatgttgacaactagctctcactttccacctacttttaccattcactactacaagcaagatttttgtaacgatttttgcgagcgggtaggcggcctgcacgcacctaggggtctgggaaaataatgatttttgcgtgcgggtggcgcacccccacgggaaaacaaaaattcgaaataacatatttttttaaaaaaacgaaaccctagaatccggcggtgggcttccgcccgacggccatagtgccacctgcctcccgccggcctccccgccacccgccatcggatccaagctcccctccggccacaacgccgccgtcgcccctcccctccgccggatctagggagggaaggaaggggagaggaggggagctggatcccacgtggggagaaggaggctggctgccggatccgtgcggggacggctgccaccgcaggattcttgcgttgacggccacagccgctggatccgtgtagggactaccgccgcccgccgaatccacgccctccaccgccgccacatggaggaggccggcgcgctcctactcccaccgccaccgcgccgctgctgtcgccgcgcgccgccgccgctgccaccgtcgggaggagaggagaggagagtggagagaggagaggagaggcgtgagagagaaaggactgagaggagaagctctgcgtggaaattttaaagtggaaaaagggatagaggggaggggagaggagagaaagaggggaaattttaaagtgggttagagaggaaagagggagttagtattttttgcatgcggctctcttaataggtccgcacgggaaaatcggcttattttcgcgtgctgtccatttaagaggaccgcacggaaaaatcgatttttcccagaagaaatgagttaccgcacggaaaaattgatttttccgtgccgtcctctttaatggaccgcacgcgaaaatgagctggttttcccagaagcaacgagataccgcccgcacggaatctaaaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctagagatgtccatcgagccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccagaaaacaggttttaggggttttgaaagaggaagagaggggtatgtccaattccaccataagccaaccattccatagtatccaagagatatgaatattcacaaagtctaaagttataaaaaccacctaatgttgtcctattaatcagcgaagcatctacctaaattcatactagtggaaccatgaatagagtacccactagttggggttttgtttattctagggtgaaataggtaataataacaatagcaataataatgtcttaacaaaggtaaatataaatggctaaataaaacagtgataaagcggtaatgcattaatttaaatcaaaataattttataaactgggattcaatatgctcaaggatgatgtgacttgccttgctcagagagaacggccttccgaaccttcggcgacacccgcgaaccacgcttctggaacctccggaacgatagaagctacgcgaagcacacaagcaaagctacaagcctataaagaagaaataacaatacataaaaagaaagcacacggttctttaggttataacaaacattaggagacttgaacgggtcgatttagagttcgtatgaccaagacatggtcatccgaagtttaatgctgttacatggagatttacggattattataattaggctttgcaactataaaacatgtggaagcgctagcctggaaaagacaggaaggctgcgctgttgacatgcggaccccacatgtcaacctaagggaccacagtagaccgagtacacagagacggtccacgggtcgacggaagcggaccccgtgtgccaaccgaggcgagtggccgacaaacggactccactagacaccacgcgggctgcacacgtggaaaccacgcggctaccgagcgggcacacaaacacggtcaccacacgcacccacgaacgattaccgacaccggtacacaggcaccggggtcgacaaccgcacaacgggcacgggcgacaccgaaaggacgaggacggggcagcgaaaggagagagatccttaccaccacgcgacgaggcgtgggaacgacaacgacaaacgggcgcggcggagacagctcggggacgacggaggcgaacggcgagggaacgacttcggcagcgatccttggacgaaggcgagacgcggccggcacaaggcttgacgacgcggagccgaggacgaagacgatgacggggctgctgcacacttgacgaaacgcgggcggcgaacgcgatcggcttgacggagggacgaacgccacgacgaggaggaaggaggaagacgacgaccgacggggaggcgatgagggcagccggcagcagctgcacggaggtgaggacggcgtgggacacgccgcagcgatgcccacgatggtggcagcgcagccagacgacaagccgggcgatcgacgggacgtcgacgacgagaacgaacggagacgacgacgatggaccgaggaggggtttggacaaaggggaggcgaggccgagggcgaccttgccgttgcgatgccggacgtggttgtggcgcagcaagccgacgagccggggaggaggaaggggcggccaaagggacgccggcgacgaagaggatggaaaggccggcgcgggcgacggcggtctccagacgaatcaaagagcaggccggggtggaggtcgacgcggcgacgccgaaggaggagacggcgcggccggcccgcacctgagcggcgcggcaggggcggctggaggtggtacagtggcggcaacggcactggacgacggcgggaacgcgcctccggtggtcaccgcgcgaaacggagggcaggccggtggagaggaggcggctgcgacgctggaggaggcgacggcacggccggacggcgctcgggcgaggagggagaggcggctggaggcggccggcgcgggggaaagagaagggcgacggcggggaggggtgatacgaccacggggaggctcgggatgaggctaaaacgatagaacggaggatggggattccattttataggagaggagagggagccggccacgggggaggtcggaacggaggcgggaatggcgaccggcggccatggaaagcggccggggtagacgcgtccgttcccgacgattgagggcg

SEQ ID NO: 74862 - DNA, 69964 bp, Oryza sativa
  unsure (1)..(69964): unsure at all n locations
gtgtgcgatgcgagtcgagtgcgacgcggaggtcgcaatcggtgtacgagaagggggaaaaaaatagaaaaaaaggaaaaggtgaggtctcgggtcgggttcggtgcgacgcggtgtttgtgcgcgcctgcctgctgctgactcctccgctccgctcttgagggaattggacggccgtcgtttttcttttttttttccttttttttttgtcgatgagtagtgtaaagtattgggagtggcctccacccgtatatgatacgatgatggcggggtcagcgtattgtacgtcgttgtacctatgcgctcacctgtctcttctgcagctcattaacaaattgtgatcttatttttattttagcattggcttctgtcgacatctggaatttattttagatattaggtccatcttttttctactcttgaataggatagtatgctgacagagttttagttcgtccccttctagatacaaaatcggaattcttatcattcaaagataagaaacagaaaaggtgatgcatatcgtttatctgatgaacttacgcacgttcctataaaaaaacaaattgtatgcataaaaatacaattagtattgcttgatatctttatttatttagtgagtgaattacactttaggcatgtcgaaattttactttagactacctttatatcatttttttctttttgtcagtttttagttgtttagccttcctcgcagcaaaaatatttgccttcgcatagatggagaagttcggcagtatgccgaagccaatatgcttacaatcattgatgtgcagtgaaaaaatgttcgcggtagcaataacaaaaatatctgatccaaagaaaaatattggtaaaatggtggtccaaaataaaatgttaccagcaaaagatgacctacattccaattcactcttacttatttaaacttttattatggattattgttgcatgcttacactagggtgaatttgagagaagaggaaaatagaaatttgagaagatatgcaagacgaaatagagtataaactattttaaacttaaaaaatggattaatatgattttttaagcaactttcgtatataaattttttttaaaaaatacacggtttagtagttcgagaagcgtgcgcgcagaaaataagacaaactttctcacaatctacttgggccgtacgctgctaagataatttgtgattgatgtcatagtagtagagaaaaccattaacatatgtcgcatgtgcactgaaattaatattaggtgcaagtaattccattctcgacatgaacaaactgtaatatataaagtgttatgttgatcgttgttgatgtttaaccatgctttgctatgacactaatcattttattccactaaaatttcatttcaattttcaaattattatatctaatcgacatgctatttagcctccttcaaaattcacagattacaaaatttgtattaagttcaattccatctgaaaatacaaagacccttcacgccctcgcacgaatctcaaagccgaagaagggtaacataccaacccacacactgccccgccgttcccagatcttctcctccgttggattgcgcacggcagaagggaatttctagggtttaggcagcgagcgtggtgggagcgatggctgcggcgggcgacgagtcggcggctgccgctgcggctgcggcggcggcggcgggcggtgccgccgcgggggaggcggcggttgactccaaggacctgcagcagcagagcaaggcgctggacaagctcaccgaccgcgtcgaggaccgccagctcgattcctcccgcgtccaatccgtacgtttggttcatctccaacctcaatcccttctagattactcatattagcggcctcatcagcgtggaacatgtatagattgattgtcaatccgttcagtggcaagcaacggagtgaagagcagagctggataatttagatgtttggtagactcatgatggttcactaatgtctattggtagactcacctcgtaatagccttgcctagaggaatttcgtgcattttattttttaggtccttgtatttcagttgtcacctaagtattgatccaataattacacatttcacgtgcatctttaacctgagtaagaacagtgtggcattttcagtacaaaagcctctaatcccgtgtcattgctattgtcttcatgcacctactacaagcactgccatcatcacaagacgccaaactgtagcctgtagagcgatgagcttaagacttcaaattctgtttgtgtagaaaagatcctgtaatttgtccatccctgttacagggtatgttctgcacataaaaatcaagacacacggcagatgatcttgaggccagaatgatgaaatcctttttgcacggtggtgtgtgtgagcctgatttttttttcaagttcttggtgggtgataatgttagatagattaatgggtattttgcaggacaaatcaggctgatttgtttttttcatggtttttagctataatttagtcatgcttggcttaaacatgagcttattttgaatctgactattttattggaatgccaataattttccagatataaaggtcctcataaatttctaattatggtatcagtaatccgtgtttagcccttgacacatgatctgcttacaaatatttaagggattatgttgacaccaacttgccaattaagaaaggtgtttgtgcttaatcgtctctttcttttgcaggctatggcagctcttgcttcttccaaagaagctgattggaatgccatgagattgaggtcagtgtacaaaacacccattatttctccattctgacgattaatacattccctaggaattacctattcctctaagcaggttttatggtgattgcagtttttttcctgagtagatgatgttaggttgccctttattatggtgaaaatatactattaagacttaatgtaagctaaacgactagaaactgtgtgtggaggaaagcaaacatgaagtttaatttgaacagtagctttgcttgccaaaaattttagcttcatctaaaagcgttatgataaagccctggggaaggaaaaccagacgacttgcaccagttgcagtcttgatacctcaatggggtagtcttttaacctgatgaaagaacaagcaaacgaaaaaaagaatcccaaacagtataagcgcaacaagaaggaacaactcatgcatgttctaagtggatatctcccttttatttcttgcaaatcttttgatttagcctgattctgcatgatagtatgatgctatttcttcaagttatataaaccctcttgtgaaatgaaggcgatgcccttgaataggtttgtgagctttctcatcattggataaatgggctgaccctggtttactgaaaacatagtttgcatgtcgtatacggtatattgttattagttacatgtgggaatgtctttgctcttcaccagggaaaaagaattagctgccatcaagatcaaccctgctgatgttgaaattatcgctaacgagcttgaggtgaccaccttaaatcctcatcagatgattgttttataatgttttcaaatcctgttctaatatatatttgaacacacagttggacaagaagattgcagagagaacactacgggagcacaaaggcgatgctgtagctgcagtccggttcttgcttcgctgattcttacacattttgcaagatctatacaccatatgaagcagctgtagtttgctattgcttgctgctgagaggaatttctgtatccacaatgaaacgatcatatttggcatctatgtagaactttttttccatgatgttgcaaactggtctctgttgtcttcttgtaaaacttggttcactcaggagtttattgccgtttatccaaggtctttctataccttctcaagatgttctgattttttttggatatcctaagctctggttctgaatgactggaatgaccatagagcaaaagaatagctgatagattatccaagatgaagagaagatgacatttaattgtttcgtacttgtatgcttttattacaacaaaggtgaagtgccttcaaaggtaagaaacattcatctgtaccacatgccaaattgtatccatttgattgccctgcatcattggcacctgcctgtttgctaccacattgttgtgtactgacagcttcttgagtttggggctgcaactttgcaattcaatttctggaagactgtctgaaacgaagcattgagatatccaattctctatactctttgtattgcctagttgtcttctgtggaaatttgtgagttaactcatactcccttcgtttcgaaatgtttgacgccgttgactttttaatacatgtttgaccattcgtcttattcaaaaaatttaagtaattattaattatttttctatcatttgattcattgttaaatatatttttatgtaggcatataattttacatatttcacaaaagtttttgaataaaacgaacggtcaaacatgtgctaaaaagtcaacggtgtcaaatatttcgaaatggagggagtatataagtttagagagctgtttacgctcatctcggagagatcacctgatcaacaaatacttacgttgctctgacagttcaattttatcaagatgaccttaactcgaatttctgattaagattctttcctgacatgcgggcccaactcatggaccccttggcccttgtgcagcgagaccttcaccggccgtacgtggagggggataactccacgggagcatccacgtggcacgaggcttctgcctcccctgaccaaaaacacgtcgctttatacacgcgtcgccctcctattggccacgctcccgtatcccagtgcactattggacagcggccgtgggccatgccatcccacgtgtacacgcgcggctcgtcactccccgtgggccaggtttgtcagtgaaacatcctcccgtgcgggtaaccacaccgctccgccctttattaagcgcggtgcatttcgcgctcgctacccatctcattttctcaggtggttttctggttcagtggagaaaaaaaaaggttagaattagacttctttggaaggttctagaggtttctagataccgccgtcccggggggtgatggcgatccccagaaggtcggcggccgccgtcgctgccgtggtggcgctcgcgtccgtggccgctgtcgccggcgaggtcttcttccaggagaagttcgacggtgagtcgccggatctaacaacctgtgtcgtcgtgtaatgtggatccagtagactggtaatgcgtttgaatttttttcgttggttcgttggatgatgacgttgatctggtcagtttcttagcctgttcatgatgcatgatcccgttgtttccgtggaattcatcagtggcatttgcgacgaagcgagtctgaggaattctggagttcatgtgccatctcgtaaccgttactgttttggcctcgcgatccacagctttaggatgttcccgtttgcggtttcaaaaaaaagatgttcccgtttgcgtggcgcaccgtttttgcttcgcatgaatggatccatttagttttttttttttaacggaaggatccatttagtttcagtagtctcagtagcgatcgcgtgctttctacgcgttcatttctcagatctccggagaattcgaagggaaaataggatttcctttcgtgaaaaattaaggccggggttcagggtttattacttgattttttgagagattatttttttcctcttttccctgatcctgttggtggatatgtagaatattaaaattggttggtttctgaattctgaattgtgtgtgaaaacagatggatgggaggatcggtgggtcaaatctgagtggaagaaggatgacaacagggccggcgaatggaaccacacctccggcaagtggtacggcgacgccgacgacaagggtgaggatcgatgcacacaccacgctgctgatttcgttttttcttctttttttttttctgttcaggcatgtgcgaagttactctgcttctctgtgcaggtatccagacgtcagaggactacagattctacgccatttcggccaagtaccctgagttcagcagcaaggacaagaccctcgtgctgcagttctcggtgaagcacgagcagaagctcgactgcggcggcggctacgtgaaattgctcggtggcgacgttgaccagaagaagtttggtggcgagacgccgtacaggtgatggtttaatttgatcacttcgcattcccctctgtgtgctcatttcagagcgcaacatctttgattgatcagtttcttttgaaattgcagcatcatgtttggaccagatatctgcgggtatgccaccaagaaggttcacgctatccttacaaagaacggcaagaaccatctaatcaagaaggacgtgccatgcaagaccgatcaactgacgcacgtctacaccttgatcatccgtcctgacgccaaatacagcattctgatcgataacactgagaagcaaactggaagcatctatgatgattggaacattattcctccaaagaataagagggatcctgaagccaagaaggtaacttagagataattcactggttgttctgacttctgaataggctgtctatgctcttctatttttacagaggtcataacttatatggtaatatgttactgtttgcagccagaagactgggacgacaatgaatacattcctgatcctgaggacaagaagcctgaggttgctttcctttgtttgtgcaactttagatgatatttctgtctgaagattaattgagtttttactaataccactctactgagattctgcatgaaaatgggtggcaatactgcactgtatgttgtgagcttgctgctactcagatagcagcagagtacattgcactacccattttattttgagtaaatctaaccacactaccacagcacagcattataaatttctaaactgaactatatatactgttattttcccttgatgcttctctctgatggtttcttttacttatgaataattgtcgtttgaagggctatgatgatatccctaaggaaattactgacccagaagcaactaaggtatgtgttgccatttttattttaaatggacattttccattcttctcatacaagttcgatgagatgcatcaaccagtatgcgatttcacatcattttgtccaacatgcaacttcacattatgcaatctgtacagcctgaggactgggatgatgaggaagatggagaatggacagctccaaccattccaaaccctgagtacaagggaccatggaaccaaaaggtatgagtgtgactgaatagttcatttactctagacaagctaggttcagcatcacgattactcactaattgcatgaaattttgtgtgtttagaaacttaagaaccctaattacaagggcaaatggaaggcaccattgatccccaacccaggtatacaccaaacatattttttctagaaagaaacaaggtaatccagcgatttgtatatgcttttatcgctcatgtgaattcctttcttgtttgtgcagattacaaggatgatccttacatctacgcttttgatagtttgaaccacattggcattgagctgtggcaggttagtgctgaattccatgaaactgaaattaatttctgtagttctgttgaaacattaataattcaatgtattggtaacaggttaagtcgggaactttgtttgacaacattcttatcactgatgaccctgagtatgccaagaaatttgcagaagaaacctgggccaagcataaagatgtgtgttgtcttatctttggtgcacattactgttttattttgtttcagtttctagttgtgaagaattaaatcgtgatttgtctgtgtaggctgagaaagccgcctttgatgaagctgagaagaagaggcttgaggaggtaggcaggaaattttctttttctgagccatatcttgctgttgcttcttgtttgaactatagatgcagaaaataacctgtaatacatgacagaactaacaaaagcatttttcagctctaacttttaattgttccttcttgctaggaatctgcaaactctaaaatcgacgacagcgacgacgacgctagtgtaagctccagaccgcgctagatacagtatacactaaccttgtgctaaacaccatgccataatttgtatgtcaggatgatgaggatgaggcggacgatgacaaggctgatgtcgttgctgagcagaccaaggacaagggtgatgagaaaccgcaggacatcaaggtctctgctgatgagaagccaaagagcagcaaggatgattcttccgctgcgaagaaggacgagctttagatattttattattattagatgataatatgtcatgacgaagaggcaactgaatcaggtgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaagaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacaaactcccccttaatttatttcttgcaaactccgatgagctctctgtcgcggacaaatttttctttggataaagccttggtaaatatatctgccaactgctcatcagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgctcttcatatcgtcaagacatccagcccagtcactgtccgtgtagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctgccttatcagctccatctctagccttttgcttttcatttggcaacaagggggttgtaactgacttgcagttatccatcttaaatttcttcagaatattttcagcatatttcctttgtgatataaatattccttcatcactttgatgcacttccataccgagaaaatagtggagcaagcccagatcactcatttcatatgtatgcatcatatcttttttaaagtcttgcatcatcttctcactattgccagtatatatcaaatcgtcaacatagagtgagacgattaggatatccgtacctgttttgttgacatatagagtaggctcacttatgctcttggcaaatcctttctgaataaagtacttgtcaatttgactataccacgctctaggcgcttgctttaatccatataaagccttcttgagtctgaataccttattttctcccccttggactgaaaacccttcaggttgttcaacatagatttcttcatcaagataaccatttaagaaagccgatttaacatcaagttgatatatcttccacctcttttgagctgctagagcaattatggtacgaattgtctctagcctggcaacaggagcatatgtctcataataatcaatcccaggcttttgcttaaagccttttgccacaagtcttgccttgtatttctgaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttctggagacttccagttccatgtagcactctcatcaaaaatcgcatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttgttactgccttggtaggacttctatttaaaatataaactgcagtattaactgcttcagcccagaaagatttaggcatacctttgtcttggagcatagaattggccatatcattgatcgtccgatttttccgttctgcaactccattttgttgagcactatagcctgccgttagctgtcttcggatgccagcattttcacaatatttctcaaattcttttgagatatattctcttccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagcgtgcactagttccaatggtgcacttgctctccaagctccactgtggggaaaagaagcccggatttgttttccaaatacacaaccttcacatgggtcagacttgagagtaataaatggaaggccttgaaccataccttttgtcctgagtagcttcaatgctctgtaattaagatgacccattcttttgtgccataaatcggaaatatcaacttcacttctgagagccatttgagttgtatgattcatccttaatagaaaatttctattcttctccatatttattttagcgaccagacgattatttttacggtccaatattttgcaagaaaaatcttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgcaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctgaaaataaccacggtctcgcattggaaatccatttttttgaaaatttccgcgaaaccttgagttttgaggcctgaagctcaactttgactgaaatgcattttcaatagagctcccttcgcgctgaagctttctttcttcatgagattccaacgagtctttcgacaagtctttcgactcctcagtagcagcaacaatgtactcgtatttttcaggcagactgattaaaattttctccacaaccttctggtcgtttatatcttcaccatagaggcgcatctgattaacgatctcaataactcttgagaaatagtcttttaccttctctgactccttcattagcaaattctgaaattgtcttctcaaggtttgaagcttcaccgcaagtaccttctgagatccttgaaactcctccttcaacttgtcccatgcttccttggatttcttggcgccaataatacgtggaaatagactttccgcaactccttgttggatcaagaacaaggccttggcgtccgacatccgatcctctgccaaagactttttctgttccgccgtaagagtttctccagcggaatactcttgatagccattctcaacaatatcccacaatccttgagatagcagcagcgtccgcatcttgatgctccatatatcataattttctcctgcaaatacaggaaccatagactgcgccattgtggcgcccgaacttgaagccatacttgtagcttcaattgacaataccgatacgccgtgctactctgtcacgccctactcgaacctgggcgctctgataccagttgttggtgctaaatatttcctaagcaggggatcagagaagaggagcagagaagcttgtgctagttttaactggtttctttacttgcttgcttgaggactgaacagtacacttgcttgtacgttgggcagcacaccatcatcagtctatacacatgcactggctttctatttataggcttgataaactgatatgtaggaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacatcaggaagttgccatttcttcctttgtgtgtgtgtttggtcagagtgattagaggaaagtccatgaatttttagcactactagagacattgctgagaggaaaaggagtaacgcaatctcttttttatctgataaatggaatatccaaaagtcattgagcagctagcgagttcgtctcataactctgcatccgggcggcatacctgaatcttaatgggacttacaaaatttcctactactattgagcaatcctttttattctgatctagtgaattcaattagacgcacagaaataatcaatctgtctgactaaacaacacatcgaggattagtgacagtaattacgagagttctgtacttctgttcatcgcaatgggaatctttacatctcgaggaccaaagctaggtagctagctactccctccgtttcacaatgtaaaatgtgggaaatgctagaatgacttacattatgaaacggagtaagtacgaataaacatctaacaagtcccatgaagttagtgttggacagctcgtcggaggaattctcagaggctcatccagccacagcggcgccgccttgttggtcaccggagaagatgatgtcatagaactccttgtccgagaggttcaccagctcagccgtggcactgtcgtaagcatggctggacgcagcagtagtggcagtgtcatcgtgttcctcgtactccgggcaagggccaggctcaacggcggcgacggcgacggcggcggcgtcggtttctggcgccggcccgaactcctccaacgccgacaagaagaagttggtccagcattgcggatccgagcgctcgtcgaacccgaggctcttgcagaactcctcgtccccctcgtgttcttgcacgaacgcctcgtgttcttgcacgaacgccgcgacgctgtccagctggtcagtgctcaggtagccgccctgatccggctcggatgctgcagcggcgtcgacgtcgacgtgttgctccgacgccggcagagttcgccgcggcgcgctgctcgctggcgcctcggggtggtcggactcctcctctgccttgcgcttgcgccggacgtcgacgacacgggcggcggcgcggccctcgacggtgacgacgcggcggaggacggcggcgagggcgcgccgtagcgcgacgtgcggggcgagcggtagaccttgcagagcgcgaggtggtcggagccggggaacgagaactccaccatgagccacccgggcttgacgacggcgcccaacgccgtcttgatcttgtacgagaacttctgcagcttgccgccggcggcgctgcccttgacgtccttggggcctccctccgcgtgccagcactcgccgcagccgccgccgacggtgcgagccttcctcgcgccgcggctgccgagaacgcgcactggggtgaacacgtaccacacccggccatcgccgtcgccggtgccgggcgccggggcgaggccggcgacgagctgatcgggtggggcggagtacacgtcggcgacgtggaagtaggaggtggcggcggagggcaggtcgtcgaggctggtccggacaaggtagctccggaggtagccgtcggtgagctggtcgtcgctgggggagaacaccaagcccttgccgatctcagccatggcgcgcggcgagagttggcacggacgtgaggaagaagaggtgaaggtgaagaaccctagctagggtttgacttcaggtgaagcgggtgtgtggatggccttcatatttataaggcgttgattttggtttctccaaaaggtttggaactcggtgttacactcggagtcggactcggatttgtgaaaatatggcgggaaacaaagggtggacgtaacgtggggaataaggaacacacaagctgttaattaacaaggttaaggcaaaggctgggctaccctctctccaccccgtggcagctggttttagaactagtggccatcttccaggtcttgcttgcctaagcatcttcgcgttggtttcgactccctggtactcctggtctcttggcagctgtggaagtaacggaactttaaggtttttgactataagctctctttggtctcaatggtgctagagtccatccactcatagggtcatctatggtctttagttggcgttgccgcttttaggaacttgttgggagtgtaacgtggctcggccccttcccgctgcctacttgcttagagtctatgttttagccaccgtagtttttctaagcttcatcttttcattttgttttttctcccttcctctggcataagctggtctggctgattgcgttgtgtaactataactattttcttctaatatattgacgtgttgcgcattcgtgaaaaaggttaaggcaaagaggtctcttacatgatgtaattgtttaagacaaggttaaggcaattaatacggagtggatgaggaagaggatgtacgcgtacaccaaagagtaagtataagtagttaagagaaaaagggaaaaaaagttatttacatcaagagtcatattattgtaaatttttactattgtcgatttgtaaattaggcgggaagagctgctgatctgttttgatcaaattagcaagtttatgaacttgtgcagatggctttgttcgctttgcgagtgaagactgaaagagtatcagcttaccatcattgacagtcgcaactgagtttaactaaagagtattagtttattattatttcaataactgaagtaaatctattagtacacccgttcacttatgcttgtacattgcaatctgactaccacgaacgcaatggcatacacaatttggtgccagaaacctgagttaattcgaaagttcagagtaattttaacacttcagaaatcattcacataagcgagaatcgaattacagcaaggtcaccattcactcttggataccgaaatacacagattaaacttgtttcgacatctcatgcatccttacagataaaatactatctggtagcgattacaaaagttattttcaatcacttccacgcagctttggatcaagaggtgcacaaaactcttgtcctggttccttagaaacaaatatatattgtaatccaggtgcatatactcttcgacctgaaagaaaccacaggtcacaaaaaaaggccgccatggatcattcatttctttgaggaacggaagcctccgaaacccatcatggcagcaacatcagggtctatgtcctcctcaggttcattctgggcagccagctctttctgaaaccatttgacatccagtttattatgaattctactgattttcacagccaacagaactgtaaattaaggaaagcagaaaatatcatgaattctactgaatttcacagccaacagaactgtgaactaaggaaatgtcagccatctgcatgcatggttgcaattacctttttctctttcttcttttctttgcgttggcgcttcctctcctcatcctcttgctgctgtttcaatattctctcatccaaatctgaaggtgtagaacacaaaaggagaatgtttagataatacttcctcataaggctccctttgcagctattccacataacagtttccttctcaagggcaaagataggggaaaataaatcttaaggacaaagatagaacaaaataaatttgatatttatttttgttgctttttctcaccttgttcactaaagctacctgggtctttcctcttcttaagtgactcaaaccttttctgaacctgcagccagaaagttacttaaggaaaaaaaaaacaggagaaaaagagtactgactacatatttcaagttcccgataggaatatcgagaagctaaatatgcaaccattggctcacttgtctcacatgaacaaatccataatgtagtacacatatgagtgagcaagacttgtaaacaattggaacaggattgttaattttcaattgcagatctgacaaataggctcagatattatacctgttcaagtgatgctctctcaacacgcatagacatgcccaatgctctctgatctgtcaaacattcaaaccacgaaacattattattaaaaggtttgatataccaactcagcctaaaccagaggtctcagaaagtcagaatacttacgtttcttgccatttatatggtccaaatagttagctgaatctttaacgacacattcacaaactttacaatagtaaccagcctgtcaggaagtagagttaaaagcaaaattttaggtgataaatttaacatgaaaaacatttaggcaatttctagaatcattgaaattgaaactagaattgttaataatgcagctatcgagaacagacatcatggacagatgaatcacaggctgaattctaaattttttttttctgataaaaactctgtttcaaaagcaaaatgaatgacagtaagtgaattccagagggcatgtaaataaataattaaagctcaatgaaaatactataacatgtcctgtgggatttctggacgaacctgttgactcaaaggtgcaattggagttaccacctggagaaaaacaacaaacataatcggttatgagctcaatcagaagggcattcatatttgtaaaaacagcttgttgatcataaaagaaaataatggtaagactacaagaacaaaaaatcgggagacataatcatgcagcatgaggaagcatggaaaatctatgctaaagcaacagaagaagacttattagaaagcaaagatgatctagcaaacctgagtcttgccaagacgggactcaaggtcaacttcatagtccctatgcttcaaaggttgcctttgcacaggagggcccttttctgtcatgtatagttgaaattaatttagctttacaagaaataaaatgcatccatccaaatctaactgaattgaagtacatagcactacatacccttgcctttccgcgcttcttcctgcatcagcaagagaaaaagaaagaacaaagttaacaacaggttgggcgaaggaagtattaagtatatatttttttagcttcgaaaatgattgtggaatgtaaaatgaggaccttctcctcccgctccctctgccgagctcgttccaagtactcctccttgtcaaatttcctccggaaagtgttatcgacaccaaccggctatgcatcaaaacaagcaaaaggtcagctcaaatgcaccacactgccttattttatgagtctctttgaagcatatataagtaacttacattgctagacatgttgctctgcccactgccaagcagctgctacctaagaagcacaagcagaagcagcaatgagaaacaggtataataacagaaaaaaaatctctccccctaaataactaggcgaagcggacccagggaatcacgacgacgagtgtgcctaggttgtgaaatcaagctgatctgagcattcgaatcatagaaaacatgcactgcatctttgaattgtgaaatcaacttgatctaggcctacaaatcacaaaaacaagcctgatctctgaaccctcactgacttcgatttcaatctatccatcagggagaggattagaggtagttacccgagtaaaaatgtgataacaaaaaactaacctggttggattcttggagagacggagaggattagaggagagcccttcctccttgctggtcgtggtcgcggccgccgcccccgctgccgcctagcgccacagcccgcttgccgagtcgcctctgggtgtaggccgtcggcgttagggggcggggggctcaggcctcacggtggccggtgggtgcggagctgcgccttctcgccgccggtagcccggtcgccggaaccctactttttttttccctttccttttttcctttttttctgtttttcttttgcaaagcgttagagactaaactgggcatgagctttgggcctttatgggctgtgcaagtgttagtgggcttctcagacctttctcagagtagcatttaggcccaaaaataatcgggatcctatgtgctcatgtgaattccgttggatcagaatcggacgactgctgttgaggttggcgtttttttttttctgaagagacctcaaaatattagagaaatccttctcatatttcaagagtgaggcaccatgggataagaaattgctttattcaactatgtcaaagcgcaaggaagaaactagactataatcgtctcatagatgtctgatgtctcatttgacagtactaagaaaccaccattgcaccagtaaattacaggtctaaacagacacagcacaactctgttcaggtaagaacaacatccatccaaagatgatgatgataacaagtgagaatttgagtatctatcagtacactcgtggattccattgctactagaaacatgtatctgactgaatctgatatgagatgcaaactgcaggccacagccgaggcttcctatggctccaccttggtcaccttctcccactgaccatctgatgcctccttccacagtgtgatatcgccggagccggccgccacggacagtatgtttccggtcagtgaccaggacaccctccatgccggagcctcgaagtcatgcatcaccttcccttcccatttgtcgccctctttccccttggtccagatgacaaccttaccgtcttcagaggcactggcgattgtaaactttgcgaggcccaaaacaggtgcccaggatacatctctaacgcagtccgtgtgcatgtcggagggcagaacgctatccagcttccagctgccattgacaaaagcccacaccttgacaacacagtcgaagccaccagagacgagcttctggacaagttcccctgagccaacaatggaaccgagtgcggttgctggagcccatgagactgccatcaccccaacagggtgtgcttgctcaattgttgtggagtcccatcctccatccgggcgcatggtcatgacagagatgctcccgtcggaagagccacaggcaaggcaaaggccaagctcatacggagcccaagcaatggagttgagtgaagacttgtggttgtcgaatacgtgagcctgagaccattgcccagctgcaccctccttccaaactacgacacggccatcgtagccgcaggatgcaagaatcgaaccaaacttgggatgggcccatgcaacacgccacacaggtccatagtgtccgctgagggttgcaagcagctgggatggcgcggatgcacctccaatgctgctgatctgcacggtggagtctgaggaggctgtggcaaggctcttcccgtagtagtcgatggcagaatcatggaccatgtccttgtggtcaagctctatcttgtttgacgacatgctgccaacttaatccagactcaaacttgaatccctcctttgtagtcctgattgtgattaaaatgaagtgacaagtcaattcaccaacacagaccagatggaacaatttaattgcagagaaatgaagtgacaagtcaattcaccaatacagaccagatggaacaatttaattgcagagaaatgaagtgactaagtcaattcaccaacacagaccagatggaacaatttaattgcagagaaaagcatccatctaagaaggaccttgcacaacagcacggacaatagaacatagaggcatcaatgccatcgtattagttcaattcattacacattagcttcccaatgattgttttcagccaacacctactgcaatataatcaacagaaggaacaaaactggcataaaaacgtatcaggctcactacatatatggggtaagacggttttgatatgtccatggatcacaactggtaattgcacattgcagccttagcttgctgcctgcagcttgcaggatcacaagaagagagattcacaggggcggatccaacttgggacatgagggttcagccaaacttttgggtgaacaaacaaactgttactttgtattaaggttaataaggctctgaaattaagaagaagaagaagagcttcttccagatctagaagagaagctagggttaacgaacgcaagcagagagatgaatcagaaagaggatgcggggatgctcacctcaccaggatcccctcccctgctcttctcgccagatggagatcggcgccccctcccctgttcggccgcgagatggctcaaggagcggaggagacgacgagatgggtgattttcttctacgccaagggaagggaagggggagatagtatactcgaggttttcactttaaaaatctttatgatgactccaccttttatctcaaaattttcacttaaaaaatatttatgatgaccccaccttttatctcaattttttttcaccctaaaactagctatactaccttttttttttatggacgtaactacacagctagtggtagctggttccactccatctataagagacaccatttacctatacttcaaatacaattttctattaaactactcatctgatctacgatctaattacaccgttgtgttcgtaataattaaatctttacaacaagatctcacatgattatattttgatgaaaaatcacaaattacttttatgatatgtctaaattatttttagatttcactaagttacttcttaaatatataaaagtaaattcagtgaagcctaaaagtaatttacatatattatagaagtaacttagaacaaaaacaaaggtaactttggcatgtcatttgaagtaaatacgttatagagataaaaacatgactctatgtagaaattaaattaatcagtacaaattatgaaattaactaaaaataataataaaagtaatcacctcggagcattataaatgtataggaagtattttaatcaaatctaaaagtaacttatatatatgataatttgttcaataaaaaaggcattaattaaagttactttccttttgttataagttacttctataatatatctaaattacttttagactttactgaatttacttttatatgtctaagaagtaacttagtgaaatctaaaagtaatttatacatatcataaaagtaatttgtgatttttcatcaaaatataatcatgtgaaatcttgttgtaaagatttaattattacgaatacaacggtgtaatcggattgtaaatcggatgagtaatttaagagaaaattttatttgtagcttagacgataggaatatttcccctacttgcttaatggattagtactatagtaaagtaagattcttcaagttaatacacatctggatagagttcgcttgttatgactaaatcgagagtactctcgatttagattttgcgtttttttttgtgtgtgatgacatgtcaacggtactcatagaaaaaaaatcaacaaactcggaactactcagaccaccggcaaccactatagctgccgcttcatgcaccaccactctttctccatgagacatgttttttcttctccccatcgtcatgcacgctattatcatggtcgtcattgaggctggggtgtcgggcttgaagaggctcagggaggctaaccactatagttgccgcttcacgcaccaccactctttctccatgagacatgttttttcttctcccccgccgtcatgcacgctattatcatggtcatcattaaggctaggggtgtcgagcttgaagaggctcagggaggcaggaacttacccggcgaagagcgaagatgctagatccaggctcctccttggattccccaactatcaaagaaaaaaagaaaaaacgagagagaagtgtggagagtgattgcataatcactggacttgaaggtggagcgatggtagagtcactagacttaacgtcattcttgcggtcacggccgagcccgtgctgcccccgatgctaatgcatatgagatctacactctcatcatctgtactctcatcatctatgataccccaccagattatttattaaccctaaatagaagcaagaaactgaaaggagaagctaaagatgcagtggaagttacttcaattgaccatggggtgaatggagaatggggacaatgtttttgcaaggattaacatgttacaggagggacagcatcacacagcagatggtagtaattattttatccccacaggtgctccaatcaaatggcacatgaacagttcaagaatggttcatcatgacagacatcgacggtcaatcatcagataaacaatgggcaggttagtagcaacattatcaatctttcgtgacaaaacatgcacagttgcatgaccgaactactaccaatttacaatttgtgagaccaacatatggaacaaaaaccttgtttgtggctgtcaaactggtatcattagtgggaaaagaacacctgctacaaagaagtgtcagacactagaagtagatcagcaaccatttcatcgatcaaggaaccaagcaactctgttgtaatgtcaatgccagattcgtatgactccaacttgaaatctacccagctccccagaggactactcatttctttgtacacgagttcatccaccatccactcctcagcaaccttcagatcagtcatctccgcatagatttcttcagctgtgagcttcttcagaattgccatccccaagaaccatgagccgtagccggcattgaaatagtatgcacatctcacactcagtatctcgtttacacattcgaagagcagcctccgattcattcggagtgttttgccctctgctacacccaccgccagccgaatatcgccatttaagtcttccagtagttgtagatccaggatatctgagttaatgaatcgctccaagcccgagcaaatttgaccattaagaggactggtgtttaatatttctcttatgaaatcaatctcctgtctgcaatccattcggcttgaactgctgctatctgatggggggatatccgtcgtagtcacagtgattgatgaggctgtgtcagaatactccgagaaagcgtcagcttccaggaatttactgaagcatgcagaattagacgttgttgcaccttccgttgagctaaatactttggttcctataaagagggaaaatatataagattttgaggaagacatacagctaatgctccagcaacaaccaagcacctgtatatttaccatttgcgcttctccagctctctgttgagctaccggtttcagttgaaacagaagcatcccatgttgaaaggggactgaggtgaaggcgctctatctccatttgatccatggcatcattatcatacttcacagattgagatgactggtgaaagagagggaatgttagcacaatgaccaattctcaaccagtcattgataaatttactcttttatatatttagacgcagtaatcattgtttaggagttacaataagtgtcccacttcagtatagcagcgagaagcttcaggtgtttcccttgattcatccgtgcattccaagtatgccagtttccaaaaggtaaaaaggcatatggaacaaaataaactaggaactacccaattatgcatgtaagaataatcaaaggcacaaaatgttgggtatacagccagggatttcctaacagaacacaatattataacctttaagaacaacatagaatccctaaactaattgttaataaaaatctagattattaacatcccaaaatatcaacaatatacacttttacaccaaaggtcatgcaggaaaagcatatggggtaaagacgtacagttggagctgatgtaatttacaaacattagcatggtggtcaaaatcattaatatgccaaatatgatagggttatgatatcaatctattgctcttatttctgaattctgatggacaacatattctttggacaaactttttgatgttatcaactgagaatcaaagtattctctgacttgaaaataaaagataaattaaccatatcagtttctgcatttatcgcagctacatgaagaaaagataatatgcctaattaactactccctccgttccaaaataagttcatttttcacctatcccacatataccaatacaacatcgaaaagactagaatagccctactttatcaaatcccaatacaattattccccactttatctactcccaatacatttatcccctactttcacaaactccgatgcaatgattattcaaaaataaacttattttgggacaaatgggggaggccaaaaatgaacttattatgggacggagggagtggttaatattttttccatgctcccaacaggtgaaacacagaatctgaataaccttttcaggtatttatcatatgctcacagcaatggaaatgacatgcataggagaaaaaggtgggcatgatagcaacagaattgcctgtgattccatacctgaccactctttgatgcaagatctgtctgggtgaaactgccttttccatccttataggattggacggactccctatcataatcagtagatgcaatgctcgatgtttcacatgctgattgtgaatcttccagaactgatgatggggcatatatccgaacatctttggctggcttacagtagggtgacctaaccccagaagtaagttctctcaacttctgctctaaaaggagacccaaataatcaccatcaattgaatcaaatttagcactcgatgtctcgcttgaatttggtactgagctcgcgtttttcataaactgtttttccactaaatgattgggtaggcgataaccagataatggtttatcaactggtgcggtgaatgtgaatgaaacaatatcagtgctaattttcttcttgttcatggaaaaaggtgattgctcatctattacaatattgtgccgaacacgcctttggcttctgtcagcaatatctttatcacttggacgggttttcactgaatgtatcctcccatctggtaatcttcctggcttggggattgatttggctgtagaattttgccttctatttgcatggccagttgaccgcaattccacgtttctgttaccttgagtattgttttcagacggtgtgccggcagtcccaacctttctcatagtgccatttattgaatgtgtgttgcttctttgccggttgggtgttggtggcttggaattcaccttgtgcttaaccatagcattttgctttctgttattttgcacaagcacattggacgaacttgccatgcccacttgattgttattcttcccttggttaatcccatttctctcaaccattctccgctcaggatcccgagttgcaagttttctgctaatcttgcttatatcttcccttccttgaacattagttgctctagaatctggtgatgatcgactgctggccttgacctttgggccaactggagcacctccatttgactgtgagaccacagaagcagaggtgttccctgaacttttcagacttccatccaaaggctttccagttggtagcctataagatgtcaagccatcatgcttcttcagtgcttcattcattcttggtggcctttgttggactatcgcaatctctctttggctgtatacacgaacagtatttgcatatccaacatcacgaactctgtaagggctaataacctcaactccagcccctataatcctagacgccgcctccattatatcagcagcatttctgctagatatatgattaggattcttcatgggggacaacttgttttgcgcaaccgacagtgtccttttggcaaatcttggtggcaatgcttccatcctaaaccggtcaataggactaccaggcatcttatgaggactaccgggcatcttatgaggactgccaacatagcttctgccaatgaactcatcatggatagtactgttctggggggactgctgcacagttaatggcatcgtataggatccagatgagcttgctgcgggcatggaatccagacccataagccttgctacaacagtggggcccctcctcacaagagcttcatcgtcaaccactgaagatgagcaactgtgctcactgctttccttcaaactcggtgcatcttcaaggaactgccaacaattatgcatacacaattacacataaataacacaaaaaaaactaaaaaactaataagattgctcgcatgaacacgcaccgaatttggtcgagtgcttggtgtgccaccatcagattccctgaaattttcagaaacccctgcaaaggaagtatcagtatgcaatcctaattcctccatccatttgagaaaaaaaggatgtatcgagtttatagcaatgactggactcctgtgccacattgacttacttggagccggagaatcgctcccatttccactgaccagccgcttcttggacttcttgccccaatcaaacaggctaaagaagccatgtccctttgaagtaggcttctccacatccatttccctttactcccctaaacctgcaaacaaaatagctcgcgtaaacacaacgaatgaaccaaagtaatacttagcttaatgcagctaaactagtaatcaagaaagagcccagtgatgagtcccccaaaacccaatctttacccccccaaatgtgacctagaaaacaaaacccaagaaacaatactactcaaactcagagaacaacgcctgcaatatacagcagcattccatcaatttacccgaaatgcaggtaatccccaactaagaacaccccccaagaaaccacaaggcagccctcgcccgtgtagaacaccgcaaagatccggccttctcctcccagctggagtcaacgccgccggattcaccaaagcagcgcccaaccggagccaaatcgccgcgaacaccactccggatcgagccgcattgagccgtagctcgtcgccctcgccggtaagctcccaaaccagcgactttttctcgtgcacaacacaacaaaaccacacctcttggacccagccgccgccgttgagggatccgcgccgccgtcacattaggtccggcgaggtggagaggtggcggaggtgggaggaggaggaggaggaggccgcggccgcggaatccattaatgcggctgcctgaggtgggcgaggaggaggagaagagagagagagagagagagattggagagaaaagaagccttttttttctctcacttgtcctctcttcttctcttgctgctcttctcctctctctctctctctctcgtctttatgacgaaaggtttattaaaaaggaaggaaatttggggaattttggggatcggtttggtcgttttcgtgatgtaacgagatttggcggttgggtttggatcatttgctcacaaattttggctctttgtgtgtgggggtgtttcgcctggtaaaataaaataaatgggttttttcggtgtgttggatccgctgaaacagatcatgtttaagagtaggacacgatgagcccagtggccagtacagttaacagatcatatatgtaccaaaaaatttatttcaaccagatggtcatgtccacggcatagaggagatggacagtgataaaagtacacctaacaatgaaatggaaggtcttgccaacacacgaattataaaaacaattatataaattggttttgggctattattgcagtgcacgaatttaatagtacaaatttcagtagatattgagttcgcgaaaaatcagtagatattggttcaattcccacaaaaaaaattctgaaaaatcatcctctcaaagaagaccttgattctcataaaaatcttctaaatatctatatgttccaaaaaagaccttactggtatatcattttactttattcagtttttttaatgaataactaaatagttgaatgattttgtaataattatttgagagtacaaatgaatgaagtaagcattaaaaagttgaaaaataaataaaaattgttttctaaaagtttgtataaaaagcatttttataaaaaaagcgtacaccgtttagaagcttggaaaattggccgttgttacattacacactttactaaagttttaaatgcttttaaaagggtaaaacgtagacacaccacggcatgtcgcttgcaccctaaaatgacaaggttgtttcacgaaatgggcgccgccggcgacggccacggccacggcggcggcggcggtgcaccgtagacgtcagtagttggtggtagtgtacaatcatgcgtacgcattatcgacggtcgccggctaaaaaagacgattcccgtcgccgtcttcatcattttcgtcgatttccgttgatgttgcagcttatcatcctgtccaaaccagttttttttttttacactctctttagttttactgcaaatccttcgtaggatacccacaagtacacaatcaccccaaccaacaatccgcatgaactgggctacggtttcagtcaaagtttggagtaaggtgctatctataaaacatgtacacctcaacaatagactagattaatagtaaaccacttcaatggtatatctacatgggtatctatagctctctaatccattgcctagtttttctctatagactatctccatgttagtagatagctttgctctctctcttcatttaatctcttccaagtaggaaaatatgctgacatggatctcttgtagagagcttatagataaccattgtgggtgccctaaaagggaaaaaaatatgtggttaagacgtacactttaacctgactgaacatttcaccaaccaacgaaagtgtagtactactctactacgtatggagagcatccaatccaatccatcctgctcttgttgtcttttgtcttctccacaagccaagcatccatacgagctagtgctggtacaggtcgcaattatgcaaagtgacaggagagattaatgcaaactaatcacactagcagcagtggtttcctttgcaagcagggcagagttaatgcgaggaggagttagctgctctgctcgagtttaagggtactgcaactctgcaagtcagcagctgcaagaacatcaccaagttcagctaagctcgtttggagatcagcatcagcttacactgacagagcttatgctgacaagtagtgacggattcgtctgcgttgatgtctcaacaacctgtaggccatcaattaccggtttttgcttaatctgcttgcgattttgtgagtgcttggatagaatagaatccaatgtaggacacgaatactttggcagtgtgtttgcttcgattcccttatctgacagacaacctgcaagattgtgcatatgtgtaggtgcttggtcgccattgcagatgcttttcttttcccccgggcaagcaaaggtccaagatttttatcttattattatcattttttaacaaaaaataatctgcaaagaggactgtactacatatatatcttcattgaaagaaataggagagaaatgagctaatttttgttttagagtgcactaaacagacattccaggatgagaaaattgtaccatttttgtttgttttgtgttacaattcctgaagtatactgaatattttggcacagcatcagcttcagtcagaagttgagattatcagatgtggtgggggaagttgttgtagctgaaaagcatacatagcagtggggtgattgtgtttttcactcttcccagtactttacaccagtagtacatcttttcatgaaaaataaacggaaaaattcgagcttttttgcagatttgagatctacagaacagaacataaccttttcacgttaacgaagtaacgcgaggtttagggggtgtttgggagagaggggctaacacccccttagtgcatatgcagtgcagcactctgaaaaaagatggcaggtagggtagtagtgctccttaagccgcgagagcacgcaacgagaaaactgacagcctcccatgtgattttacctgccaaacctcactttgatcagctatcagatgagatgaggaaagcctttgctgctgtgtgcttgtgtctggctcaagcgagtagcaaattcagattctatagtttttttttctctctctgaaacttttcttttagatggactgaatgctctgaaagactcaaaactattgcacgtttacatgaccaatggcatggtttttaaggccctgtaatctgaaactagtacacgttgacatagagacgattaagttgggaacacgttggtcagaagtacggagttgcaaacactactcctatgctgcataatatagcaacttgtaccatttaaaatctatcttaaaatataacaacctcgcgtctcaactaattagagcaggatcttattttagctattcctttactatctcatctcaatcaatcacgactatttctcatttaatttcacatatcttcttaatctccacgaaaaaaaactccagaaacatttacacgagtattttgggaatagtatgtactaatcgagacactttaccgatttgaagggcgcaaaactgaagatgagatttgcaaaatgcaatgggtcaacaccacctgttcttgtaccaggaggctactatgagggacgcatcagcaacgagatctgaaccgtggctgtcccattgtctgcctgcttgaggcaaagcaatcagagattcagagaggcaggctgcccctccactctgcttgcagtaaacgataaatgcaacagaggcccactcatccaagatcagatcgtcttgggccacctctctctgcggcccaaactaaaagagaacggtggccaaacatcttgctgggcctcacgcggtggaataagaaataagttcatctgaggtcccttaacttgttaacgaatctgattttcgtccttcaaccggaaaaccagatacgacaggtcccttaactatcaaaactggtgtagatgaggtccctcggcggttttgatgacagttttagctgacgtgacgcctatgtggctaatttgactcggtatttgtcccacgtggcattgacgtggcgcttacatggcaattccatccctgaaaaataataaaaaccatgggcccacatgtcagttaaaaaaaagtgggcccccacaagtcagtgctctctctctctctctctcactcttcttatctggacccttgccgtcgacttcactccgaggcgttcgggctgccgccgctcgtcccagccctcgacccggccgtcaacatgagcagccttgccgccggcgcatgcttcgcctccgccggcgccggctacgacaatgccacctctgatcttttcgttagccttccattagagcaaaacgatagctagcttagctacattttcatggtgttcttgggtgacatcacacatgacatccatggagtaattttgtgaggtcgcgtcgtgcagtcggtgctgccgatgtggaaggagctggactacttcaaggagtacgcggcgaggcttcaaagcttccggggggacgacgacgcggcggcggcggcgacgctgtcggaggcgctctacatcgtcagcatgggcaccaaagacttcctcgagaactactacgccatggcgcgcgcccaagcggcggagtactccacggcggtggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgccggcctccaggacatgatcgcgaggctcaacgatgagctcggcgacggcgagatgatcgtgtatggcgacgtgtacaggtcggtggccgccggcggcgtacggggtggagaacgtaggcaacaacaccgtgcccacgcgggtcaaccggcggcggctcacctgtgccatctgcttcgacatgttcgcccccggtaggatgaggtcggcggggtgctcccatagtcccactacaactgcatcgcttcggtgcccggacctgtcctgctcggtcgccggcggaggcgagcgcagcgaccgttcctgaggagggcgcgggggcggaaggcggtgctggagaacggccaccggaggccgaggcaagggggaagcggcggcggcggcgggaacatgcggaggcggcggaggcaggcacggcaggcgacaaggagagggcagcggcagccggcggtaggcccatgggggcgggagtggaggaggccgcgcctacgctatccgcatctccgccggtgagaggagagaggaaaggggagagttgtgaagataggtgagatggggagagaggaggaagaagaggaggggattgagatgagaagagtgagtgagagagagctgatatgtgggacccacttggggcccaccagtttttttaactgacatgtgggcccatggttttttattattttcagtgatagaattgacacgtaagcgccacgtcaaatgccacgtaggtgccacgtcagccaaaaccaccatcaaactgccgagggacctcatctgcaccggttttaatagttgagggaccattgtatctggtttttcggttgaaggatgaaaatcggattcattgacaagttaagggaactcagataagcttattccgtggaataactaatccacgggcttgctctcttactgggccggtcttatcggatcatcagatcaaacgagcactaatacttagattagatggaaatcgaatgatatggatttggtctcccgtctcactgccgtgtgggccccaccgcccactaaccaccccgaggcatctgcgccgctgtcgtttcgccggtaatctcgctgcgttttggtcatcaaaagccctaacaaaaacctccccacctgcggccgccgctcgcgtcccatctctccctctctcctcccacccatggccgccgccgccgaccgcctcctccacctcctccgcgccgcgcctgcttccccggcccccgccgccgtcccgtcgtcccgcacccgagccaccttctaccaccagccgcggagcctccgcctggcggcaggggcatccggtatgcgccgcgttgccgtggcctgcagctccgcgggcgcgggcgggagcggggtcgagggcgatgaggaggggatgacgtacaagggcgccggcgtggatatcgacgccgggacggagctcgtccgccgcatcggcaggttggctccagcgataggcggcttcggtggcctcttccccttcggtactatactactacccatctccttgtttgtattaagtagattggttttttttttttttgcggggaagtagattggggtttagtttgctcgtcattaatgggtgtgtgtttgggagggttctgtgatatgtattggtagttcttaccccaggtgaccaatttcttgttgctggaaccgatggagtcgggacgaagctcaagcttgcgtttgaaactggtatccatgacacaattgggattgatctggtatgtgttcactttgctagatgagtattttatttcatccctttgagtttgattgactcaaatgatttttaattctcatgttaggtggctatgagtgttaatgacattgtgacttcgggtgcaaaaccactgttcttcctagactactatgctacgagcaagctcgacgttgatctagcagagaaggtattgttgacgctattttgtttgctgaaaacagttatgccggctaatcctctcttatctacatctgcttataaagtcataattattctgttcaaaacttttattttctcaactacataggttatcaaggggattgtcgatggatgccggcaatcagattgtgctctgctaggaggagaggtgaagttccctaactagaacccatgttttagcagtggaatacttcaatctttgtaccaatgaatacagaatatatgtatcataattgttcatctgtcttgcaatggtttgtgactactttacttcatacgaataaattttcaattatgcttacagactgatcattagaccattttctaactagcaagcactagcttcaacaagtgaatctttgtaaatgttgatatggtattcagcttagttcacatggtggatcttgtttttcatcatactttggtttgtaaatgctttgagaatacttaactatgatatatgagcataagtacaaagttaacataatgttttgactctgttatgtgcagcaacatactaataaaaaacaattgcatttatcattgatccatttgtcatgcagacagcagaaatgcctgatttctataaagaaggtgaatatgatctaagtggctttgctgtgggtgctgttaagaaggataaggtcatcgatggtaaaaatatcatggagggagatatcatcattggtcttccttctagtggggttcattctaacgggttctcccttgctagaaggtattgcatctatccaattcgagttgttttgatccaaatagatggttgacgcatgctcttttcttttgatgttgatacttgacaacccgtcctcctgttgaattatgtgtcattaatggtacctacaaaatttcatatttttttagagtactggagaaaagtggactttcgttgaatgaccagctccccagaaatgatggcatgataactactgttggtgaagctctcatggcaccaactgttatctatgttaagcaggtagctttgctgatatatgtttcatatttagcatatatgtatatgcaagtttctaattaaattgttgaaaatgaaaaggtgctcgagattattaacaagggtggtgtaaaaggaatagcccatattactggtggtggcttcaccgataatatcccaagagtatttccttctggacttggggcaaagatttttactgcagcatgggaagtgccacctgtattcaggtggattcaagaggtaagggttaacagtccacgagcatgtcatgtgtattcttgtaaccccagtgaagttattcgactgtgttgtactgaaaatcattatagtattgtgtatctgttctgaattcctctggtggaagttatatatataatcagccatatttgaactcggtagaaactttaaagattatgataggaagccctaattagagactgggtttttcttttggtccccagttttcatgcactgtgctgcgctgcctatttggtccttatcattttctccgggtgtttgtaggttggaaaaattgaagatgcagagatgaggcgcacgttcaacatgggaattggaatggtccttgtggtaagcaaagaagcagctgatggaattctcgaaggtacccatggaccgaaccacgcatatcgcattggagaggtgatcagtggtgaaggagtccactacgtctgatctaattaatgatctttataatgctttgagtagtttgaggtttgttcatccgacaggcaaaccagcctaatttttgtaatcgcataacataaagggggccaagtcctggagcaacagtgagtttagtcctgtaagataagaaaacatggggcgtactccttttagttccacatgagaacttgcccccaaacggcagaacctattatttggacttgcatctacgagaggtgtcatcttattaaaatgttcttgcataccaactctagatatcctgatgtgtctcaccatcgaggcgttgcatttctatactcgttataagcatccagaaaaatcgcattaatgcaaaaaaaaaaactttttacgtaattacctgctacatgatctcagcaacaatactcaagcatacatgttattattcgaagttcttgcatccattaccacaagaaaacactcaaaaaaacgtaaagcaaaaaaaaaaaagaatctggatcgaaaaccttggctttacaagcgtcaaaatggcataggataggataggatcaccggttgatatcgccgtcgccgccgtaaggtgtccggccgccgtccggcgagtcaccagcggcggacgaagcggtccttgatccaccggaacccccggcggagcgacgccttgaccctggcctcgacggcgtaggccttgtacgccgccaccctccgccggcgcttcgcctccgggtcgccggaccaccacggcgtcgacgacgacgaggccaccgtcctctcgtcgccgtcgcgcggcggcgccgacccgccccggaactcctcgagatccctcatgcgttccgtctctctctttgagtgcgcgtttgccggcaacgacgacgagcgaggagaggagcttttggcagctcgcatatataggggagaaaatcagggagagtttgaggccggccatgacggcctcaacgcaatactctccccgtctcccagattagccctgaaattgtcgtcgtcgactagtgcttggcacagctcgtggaattattagcctttgcaaccctcaaaaaaacaatggttgacaaattgattaggatttgcattgcatggagatttctatgtgtttcttctcaggtagtagatggcacgccgtcacgttggttttcatacgtgcaacatgttgcagttaggagttttgacagttaaattcacatggtgcttctggtaatctgcttgaaatatggcaaagttgcagacttgcagctcaaatatatttttttttcttttggtgtgtgattgccagtagtggaggagcagtcagcaagcgcgccgtcccggccgtagctgtgatttggtgggcatttccgtgtgctcggctcttggctggatggaacaagtcgccctccatccaattacaaccagatatcagtttgtttccgcagcatatgtaacactcagaaagtgagaacctcttttttttttcttggaatgtacaaggcacaggtgcaaactgatctatcatctcactatgttgatcaaaagtaaccgagataaaaaaaacaatttacatgcaaacacatgatgttgtctaattctaacaaaaaaatctttttttttttgctctttctctttttttccccctcttaagttctacaagtctccaattttcctttccatctttactctcccacaaagggttacctacaccgctacaccagacaacttattggagacaggaaaaaagttagcatgtaggctgatacaacccccgtacaagagggcattcatcatcatatcatcatactctatgtgccataggcagatgtgctcaaggcagctgaaaattcagacggcaatgtttcactaacaaacatttacagtcatctccacgtaccggaacgggagacgaaaaaacggaaatctggatgctctacttgtacgcagctgagccagttgccagcctcctccatcagcgaggtgacacgctgtccttgggtcccatcggatgcccaaatggagctgcgaagtttgtaagatgccagtccaaaggcaggcaaagatagcttgccagttgcatttgcgcaagggctgatgccaccaaaaccagggcatgctggtgtagtgctatcgctatctgcaagaatgggaatgttaagcaatctatgcagtatgtaacatataagttgcatctaggtacaaactatttacaccttcataattcattaggcattagaaggtatttacccttagaaggtgttgctaggcaatggaatgtcaagaaacaggcatcaaggtcttccaacgtcggccctgttggaattctatatatggggtacctgcaatgggaagcacgaggatgaaaccagtaatgtatagaatcatagcaacaccatattagcagtgatgctcttctacacagattgtatgtcgtgctgaatttcagcacagtaggcatgcctgttgttaggcattgcaactggtaggcatcctctgcgcgggccagcacagttggcaaatgtcattattctcaccgttgcaacaacatcattctagtacttataaaacaaaaacgatgtccacagaaaaggaagtgcaatattgtggcactaaaactagaagctatcagacaataagacatgaggtgagctcatggcggatagtctaatatagtaatatgaccattttttaagcggaaacaacatgaaaacattgacttcaaaatacttcttgaatcccaacagtttgacaacaagggacacatcttatcaactgaatgaggacatctcacaattggaacatggaagtagaacttgaagaaataaaataaccataccatgcaacagacatccaactggatggcagcagatcacagcttttgaatgccttcagagctggaaatctactagcaagaattgatacctgaagttcatgcagagtatgattatgtggctatgtgcataaatgtttgtaataagcatgggtgtaaacaaaaactcaccttgtctgtcagaggttctctacaaaacgggggatccctctccatatactgaaagattggagaacttgcagatgcataaccatcagcatcatcagttcgcaaactaccatttgccatcccatgtgtagcttccacggatgagactcttaatcggtcaacatcagtttcactgctactctcgctgctagcatccaggtattccccatcactttcatccccaaggcgccttaagtaagcgagaaaaataagtagagaaagttatatgctatcaaggaatcaccaagataatgaaagcaacactactgaacaggtaagctgttcctaactatcttcatggtggtcactatgcctaagtagaggtcatctaatgataaagccataaattcacagctcgccactctttcagtttaacacagatttatttatttttcttcatttatacatatgtttgtccaccaagacttattgcaaaagcaagttcctgaaacttcaggaaggcatgagataattccatctattagaacccaggaaaaccaaccgaagaaataaagttgaggaattctgtgtctaccctgtgcttgtctaataacatccaatgcataaattatttatttacatataatttggcacggctgtaacaaactgatatactggagtaatttcttattagcccagtagaatttgataagtcctgcaaacatatgaacactaaaaagcctaaataaactgaagtgaaaccaaagatacaaacaaagtgaccagctagacatgttgccatattgatggtttttctttcacaatggttgacctagtgaaggtttttcttccaaaaaggagaaattctaaaaatcaaaacttggcattggagataaagattgctacctggttcttgaaacagatcttgatggatctgcatacaactggatagcagacagatatggcacgtaatactgtgttacagagtcactgccatttagcaacaggggaacgccagctccataagcactccactccctgaaagattcccaaagatcttcaaggcagaaatatggtgatgtatttgtacaatcaccagtcctccacattttcaagcttgtctgcagaagaacaaaggtattacaaccaaaaacagcgtaactagaaccacggcaagatagctcgttacttcaataaaaagctgtttatctcatcagaacattgtacaaacatcactgcacgactcaataatctctcacaaaactgattctaatgttgttacatcctaaatctgattggcatgaacacaaaaccacagggtatgaattgtttatagatgaaaattatagctactgcagtaattaggaagttaggagctcaagaaagacacaattttccatctaggattatcctgcaaaaaatatgcaaagccccccgatagtgcttagagcatagatatagcaacaagcagtgggcaaccacagttttattgagttttaggtgacacctccatgtgttcagaaaaaaaaatcataatataaaaatccttcacttctcaaggcaacaacacttgaaaatagtttgcaccaaacaaaacaaggatcctcttcctaatttaaagaaaacttgctactacacatccacgattactatcatcaagcgtcttaaatggctggtgactatcaatcagatcttaaaatcagcagtcaagcgcaaattcagaaacatgagcccttctgttgatcaccactagaatgctcaacaagaatagttgattttcccctgaactacagtatcgaactatttcatcgatcctacaccaatgagtagcattttccctttgtagtcacgacgcactagctacacttaaaaacatattaattaaaaatggaaacagaagtatagatatcaaaattcgctcgttcttcctcatatcacccaacataacatgtctaagtttccgaaattcgcatgctgcactcctaaaataccttgggcaggtattggaagggcacggagggagtggtggaggtgagaaacctctccaaattcccactctcctccaccgccgtcacattcacgtcagccgcggtggtcgtggcagtcgctgtggatgccacggaaggcttggacgacgtcgacgaggagtcgtccgaatccaccctgctatccccgtccgtcagcacacccgcgcccaccgccgccgcagccaccaccgccggtggcgccgcggcggccgccttgtgcctccccgaccgcggggacggcgacggggacagtgaaggggacgtggggctccgcagccgctgctgctgctggcggcgggaatggggaggcaggtagaatcgttcgacgctgttgcgggaggaggaggaggtggcgccgccggaggaccccgccatggcggcggcgggaggggaagggggatccggttagggttttcggggggatttggggattgggatgcttagggttagggttttggtggctttttcccctttttttagaggagggtttggatctgaagcgaggagcggaggggaggaggaaggaggcgcaacgcaagagcggagcggacgcacgcagccacactcctctccactgtgctgtctgcctgtcttgtgtttgcttcttcgcctcccgtcgctggccctacttccattttccgggagcattgtttctcccgttttttttttctctataccgtgtgatagtgtcgaaatcaaaggaatttctaatgcgttcttcctagtggtttggttcttgggatttttcgtagcatgtcacaaaacatagggaaaaatatcttttaaataaaagcaacggcaatacagagctctaccatggatgaataaagaatggtgttataaacgctcttctgattacggtgatagaaatgagagaatcatattaggagttagcatagaaattcctatgagacgaaacgaggatgtggcagcaaggataatatcatggtaccttatggagtcatagcttcctctcttttgatttcgttagcagacctgaatatcgagtaatggctacctaacaagacggtatcgagattgaagatgggtgcgatgaggaagacgactgttaccgatttgtgggacccatataaataagaagagagatatttaaaagtggtggctaagttatttcaaagcggtatagcccggaaaataaggagttgacaaaagcgacgtagccatcaattgaacatttggcttgattgtcttgccgcgtggatggtgtaacgtgctcaattgtcatagattttaccgtatttatgtgacatcaaacatacgtacatgtgccactgctatctagacatcagcacttgtattttttttgcgtcttgttcacaaacccatcttcttcgacaatggtaatcgcaaccaaagcaagtttttgtcaaataatagaagaggaataacacaacaatactagggagtagggataagaaaaagtctgtggtaagagctgtgacatcatcgaagccattggctagataatatgtaggacatgataaagacattagaatgacacatatcttttttgaaaaatcccagcaacaaaaatcagaatagtaaagtcatacaaggcggcaaccaacggtaataaagaacaaagatagcatagatagatgttggaggtacaataagcatcttgtgtagcatagccaatgccagacgttaagaactaaggcatgtcattaggataggagcaacagtgatgaaacatgagcagagtggtcatgtggggaagcactataaagtgtaatatgttagtcacattcacatctctcgtagaatagtaataatcaccacttaagtagtacgaaagtatggatttcactgggagtagaaaaatattttgcgaactaacatatcataaaaagttagtcgtagaaaaaaatttaatcctaacttataaggtggaaacatcaattgaaatcgatggtcccatacatactacttaaatatggtttagattttgaataatcagattcctacgaaaaagaattctatatagttaagtggaacgaagaaacaactctccttattgtaatacataagaatcgcattcacttgttaaaattttgaaggatttttaacatgagattcaacatgttaaaagatatcttttgtttttccgtgctccaattaaacagttattcctgtattttttatgctttttttcattcacgggattcaagatgctaaggcactgaaattttacaatttttccatattcatgatttcctatgttccaaaaattccgtgtctccaagaaacggctaacgcatacttgtaatcagtagcaaatccttaacaatagttacataatttagctatattttgatactacccaaaaaaatcgatgaggatcacccgataccacaatgttagacatttacccaaaggtaaaagtatgttgtcaacataaatagtactccctccatcacataatgtttgacgcagttaactttttaaaacatgtttgaccgttcgtcttattaaaaaattaagtaattattaattcttttcctatcatttgatttattgttaaatatacttttatgtatacatatagttttacacatttcacaaaagtttttgaataagacgaacggtcaaacatattttaaaaagtcaacggcgtcaaacatttagggaaagagggagtattacaataccattatgtttttttttacattacaataccagtgtgttgtcaacataagagcaagtttaatagaatagctaactattagctctaattcatctatagccaatctaatagtttattcaaacaatatttatctataaacatatactaaaccattaacatatgatctcacttttcatacacaccttgtgttggagtccatagtagtatgttttccttctctcttttttttctctcctctacatatgtttaatagttgacttatagcctgctattgcacttgttctaattcaagtcttcatatactgccatgatttaccagaagcagggggagctttcgggaaaaagaaaagagatgatcacagccagcaagttccaagcaccagtgcacgaccacacgaccatcggagaccgtgagcagtaaaaacagatttcacccaccgcacggggagtgccgccgtcaaagtggctgtccatcgccccatcgccagcggtaaaaaaagccgcgaatacgggcgacccatgccaatggcacacacagacacagtcactcacacggatggacggcgacacgttcatgtggccggccacctctcgcatgcatcgccttgcctctcacttgcccatcctttcacctcgttcctttccaaatccatgcaaaatctcacccggagaaagcaacggtctccgcctcccccctgcttcacagtttgtttccatatttggtactcctactcctaccaggagattcttcgatggatgcatcatcatcacttggaatgtagcactaacaacaatgccactcactccctcacttgtcaccatctcggacacagcaaaggggtgtgtgtgagttgtttttcttcttattcttccacaaataatgaggtatccacaacatcagcaaaaatcatgagctcttgctgtcttgcatgacaacaaaatggaacaaaccaaccaccaggatcacaaagatgctcacaaaaacataatcagcaccactgttattagtattagtgacaccaatccatatcatttcttcaacaagacaaggaaagtactaagcagcaatcaaagaatgatccatccattattgtggcaaccctctcctctcaaaggagaaaacacaccaaacacctcttgtcaaagcctagaacatcacaacaccatcccatccattcctagtaaaagctactactgctgctagtacggagtagaggatagtagtaacagcacaacagcgaagaccctgatcacgcctgatggagaaacacaggaacacctgggtgcttgacttttccccttccaggaaattgcacggatgttgacctgactatttgggctcacaacacctgaaaatagaatgatctactagttgccatatcattgctcaaaaccaagagctaaacatagcaaaacccaacagatctactagtatacaaagcaataaacggaaacaaaccatccatgatcacatcattaacaacagatcaatcaacagatacaacaccagcacatcatagatccgagcagcacaacagccacgggagaacaaaccacaagttgagctgaataatcaaccatgctgtcatcatcagcggtaagtaaatcagtcaacactgtgtgcagatcatgcaataagagacacctgggaggcaaagattcttcagctgaaaaactgcattacttggtgcagatccaggagctaatctcttgcaaagaacaagagaaagaagatggatcataagctctttcttacattgcaacgttacacgctctactaaaaacactactagtaacattacagctaggcaagaacaagtaacagtaacaggaagaacagcagctactacatcatcatcatcattattaacttggcttccactttgatcgaactaattagctggaaaaactaagcaggggagaagaaaaaaaagggtagagatctgtctagtctctcccggttgagatcatgcatgttaagcaagcaaatcactctttcccatggctgcctcctttcctctgcttctctctctcttgctgttgctaggtgggtaggtaggtagggtggtggttcaggcgtagatgactccggaggagagggccatgaggaggatggccgccttctcctcctcgccgaggcgtctcctccgccgcatccgccgccgctgcttcaggaccacctccttcccgaaccccaccatgcggagctccatggtcacctcctcccctctctccctcttgctcttcttcttctcctgccgctccgcgccgccctcgccggcgtcgagccccagcgcctcccgtctcttcttccggtaccggatcccgcacgcgttgcacagcgactggatcaaagcaaaaaaaaaaacacagatcgggcggatcaaccaccgaaaacccaggcgaaaaaaatgcacagatcgagaaagggaagagcaggaggagcagatcggatctcatctcaccttggggccggaggggccgccgcgccagagcggagtcttggtggtgtggcagtcggtgcacgccttgggctcgccggaggccgtgcgctcgtccggatctatcgacccactcccctgcaacccacagatcgagcgtcaaaaaaccacccagccaaggcgccattccagccacagatcgagccccccaagaacccacggatcggaagcttcaccttctcgaccgacgaggaatccatctccggcgccaggatcggcggatctaacaccccggaagccgcagcactccccctcctcccacacctccgctcagccgccgctccgcaacacccgcgcacaccgcgccgcagacacggctggtgctctgccgccgccgctcgatccgcgggcagatctccactccacggatctactactaccagagagagcaatctagctagcaagctagggttagcaccggctactgggagggagcagtaggggttaaggggcgggagaagcaaggaggaggagaagaagagggaatggtggtggtggaggatgaggtggtgagggtgagaagaaaaagggggagggatttggatttagatctcaaaatggaggagggaagaggggagcgagtggagggaaacagaaaaccatggagggaaagctggtgaaattgggcgcgtttatgtatgcactacacacacactctactctagggttgtttctgttctgtctgaggggtttgtttggtttggttgagtgatgatgatctatggaaggttttagaacaaccaggatcatcgtccatcacctgaaggccacgtgtgttagtgtgtctaataattttcacttgtgctagcacatggtttatttgataggctcgtgttttactatgctgttgtagtgttttatttgaagatatttgttgggcctataaacgatagtgaagttgttaatattgatatagattatttaacggctagcgacatgatatgaacagaaataagctacttataaatttatacatatacagatatgatttacaagcgtctatttaaaatatacttaatatagtacaaacaatagaaatatgcatataacttttttctaaaatcaacataaatcaatcaaattcatcatgaacttttttatggacaatggtcacagtaaaaaacaaatgccatctactggagtagtagtatgagagttactctgacgattctttttcttcttcttcttcggctatgtttagttccacgctaaaattagaagtttaaagagattgaaacgatgtgagaaaaattaaaacatagtatagaaaaatttgatgtgagaggttaaaagtttgaaaacagatccttcttcttcttcttgtgtcgcaagcaagcaagacaagccatctatagctcgtacgaggctataccaggcctaaccaggccgcggcggcggcagttctcatctcgtctcggcgagtccactccaacactccacttcactcccctccaggcgtggcgcgcgcgtgtgcggcgtaaaggcgtcgaccgttgccgctggcacgcccacacacgcgcgcggccgcaccgcatcaggccgacactagaacccaaaaaggcggcagcagcagcagcaaagcctccatccgctgcgcggctccgcgcaccggacacccaaccgccccggcgcctcgcgccgtcacgcgcgcccacgtggtccccccacccccgcgccgctgtttgctgctttgcgaaaatttacgagcccgacccggacgcatccgcgggaattccccccgcctctgcgcgcgtcgtctgcattgccgcgggaggtgaaatgaccgctttgccctcaccctctttgaccggtcagaacggcccggccaatctctgctcgggctcggcccagtgagaccttctagaaagtctctctctttgatgggcctaactaggagcacatggtactaggcccagcccatgggcagcaagaacatctcgggggtataaaccctagccgctcgtgccaccgaattcctccggctccgagcaaaaaccctcgtcttcctactccgatcgagaccgcgtcgccgtctccgagatcgccatggccggcggcggcgacctccagagcccgaagaagcggaagcgtgatgcggcggggaagcccaagacgctggcgaaggggggagacgacgggaagaagcggaagaggccctcagatgccaacatggcgcaaggcggcggcggcggcgaggtcaaggtgaagaaggagccggttactgccaaggagaagcgcctggctgctaaggtatcgttgttgctcgtccgctcggtaaattttaatcatctctggagctggagcatgggttcgaggcattagcgctgaacttggtgtggtgtggattggtcaggaaatggcagagtcaaggaagaagaagaggaaacggaattacagcctcgagaaggtaaatttggtccctgtacgatctatttcaacatgccgggaaattcatgcctattgacttatgagccagagtatgattccaggaccaactctcataatgctaggcaattggaacaatggtgtgttcagggttttattttttttaagatatattctcaccaatatattctcacatatagagcttatatgttcacgaatttcattagaagagtttaattttcgctgcattagttgaacattgaataaggggaacctactattttcatggtcatgtgttatatccaatcttgatcttcactcttggaactatatgacatgaatgcaaaactgtaatttgattctggtacccttgtcactggtggggatacttagcttcacgagaatagctacattgtcatatttctctctactaacagtaagcattgggtgtcaaatttatgttggtttcattcgaatctagtttactgattgcatttaaatattgtcaggagcttactgtactatgggaaaagatgcgatgccacaatgtgagcagcacggagagatctaagtatgcattacatcattgtcatgactcgtatctttgagatcttacagtgacaaatcaatttattatattgatttttttctcaaaatatccaggctggtaagtgaggctctccgtaaaatggatgggaaatattcagaaattgctggttcccacgtaactgcacgtgttttacaagtaagatgatcaatcgatcatattcatttgtatatcaacatgttacatggttttgatgttctttttcctggtgttgatgagcattgtttcttttggcagacatgcgtgaagttgtgctcacaatcagaaagggatgcgatttttgaagccctacagccagatttgctaactctctctctcaagaaatatgctgttttccttgtaaagaagctcattaagcgaggtaaaagctctgttgggttcatacatgataatatttctttatggttggatatgccattggctccattaacatgcctgtatttgtgattgcagccactaaaaagcagtttgaatggttcatctcttctcttcacggtcgtgttgctaaacttcttcgtcatactataggagcttcaggtatatattacttgttattgtaagagatggcataaaacttgctattttattatcatttgttaggaaccttaagagttgatagttgtgtgcaattcatgtgaatttgtttgtattttatctgtacatgataaagtaaatgataatttaatgttatgccaattctttttctttcagtcgttgactttgcatatcaactggcaacaccgcctcagaaaagaaggttgctattggaattgtattctactgagctccagctgttcactgacctgactggacagaaaacccacaggtcattgcactaaactaactcatgtttctgttttcaaatttccttgctcttttgattgttctatatgctttctgaaaaaaagattcgttttcactatagatcaaacaactgtctgcggtaacaggctactgcaatttgctaacttaaactccctttttcagtttgttagagacaatttccaaccttggattacaaaaatcatctgtactgcagcatatgactaccgtgatttatccgatcttggagaaaggtatcgttgaatatcctatagtgcacacggctgtattggagtattttacaatcgctgacaaggtaatgctatccatttattgtgtagcctatctacagtctaaacatgcctttgttggcatatcctttccttttggtttgtctttatcacactgtcctataatgcttgattttgcagacctcggccactgatgtgattcgacaatttatcccccttcttacacaaggatcatctgccattgatggagatgagccatcggttgcccctgaattacaaaagaaactgaaagctaagaaaaaaaggttgacagagccacttcttgttcggattatgaacaccagagaaggattaaaaataggagttagttgcctcaagcatggaagtgcaaaggtaggttatatttttttttctctgagactattattttatgttgactccataccttttcttatgggacactgaagtagcatgccaaatgactacccattacatagtccttcctctgtttttttcttagtgtggagattatcctcataattaaaatgtattcggcttccatgtaagattccgttaactttgtgttgaacttcaggataggaagaagatcattaaaagtttgaaggggcacattatgaagcttgctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagttacttgttgccattctttccgttgttgatgacacaaagcttgttaccaaggttagctagctccagtcttctatgcacctgttctgagtattgtgctgtgataaatatcgtatggagcatttatataacacttttgtttgatttgatagatcgtaattcaagagctcgccaaacatttgaagcaacttatttttgacaaggtgaaaaggaaaactgagcttctgatatttttcaaaataaatccacaatgcactaatagtaatgaagcttcttgttggtacagaatggaagacgtccattgctgcaactacttcaccctaattgttcacgctatctgcctccagctgatctggcttgtctgaactatcgtgtgccttctcttatttcaaaggcaagctagctattctgtttagtattttaaggagaacatagtgaagtgctgtgttataaatattccacttttggttaggatgaagcttccgagagtgctgcagaagatatcccagagaataaggtggatgttgcaactaataaggagcaagatggttcagaaagcatgcagagtgcgtctgacagcaaaaaggacccatttcaacggcgacatgaattgttgatcaaaagtgaacttgccgaggtgacatttattcagtgctatgtttattcaaatacagtgttaaaaggatgcaccttttcacattgattactgcagtagggtacaatatgatttctttggtgctcgtttagtcgcaagcagtagccagtcacagtatgtatagctacatgcccaccatgtcctaaaccccataataccaacatgcacagcattttgtgtgctcacgaatattattatataaatgatggcaaaatggtccattagggattttcctatgcaaggtttcaagtatgtaactggaaaacaacacttacaataagggtctactgtattttcttgtgtgcccactattttgcccaattagtgctgacgtgacaactaacataagttaatcgtgatgaatttactagccttgctcataggcctttctttttgtgattattagatataatatctagatgccatcgtggcagcatagagttacttgtgactcaaagtattgaatatgctttatgtggatttaatataatgcagaccttcctgatcttttctcaggtgctcatccagactctcattgagaatgtcggggagttacttcgaacaaattttggcaaagatgtattgcatgaggtgaactacttttgtccttgcagatggtgaaacctgctttttattatatgctaacaatttttcatgtcataacctcattggcatggcatgatctttggctggtactcttctttccgtgaatatcggtcacttgtttactgaatcatgtatcagggaaatcatgatttgaataagttgcaccaagaataccctttcgtagtatatcaggcacaaacgagttagtgaaatacgatacacagtcataatctggaatattgaagcaacgtgtctttgccaatctgcggtgcttgattgttgtcattgtataaataatgtttcataagtgccactggtgtcactctgatatgttgacatttgcaaatctgaaggttgcggttggtggagaagataatattctggagggcatcactgacaggatccacagcttgcacaatgcaatagcttctgatgcagcacgtccaaaggcagaagatactgaacatgcctttgataactatcattccagccgtctaatcagaagacttatacttgaatctccagcatttgctgccatcctatggaaaaaagctcttgaaggcaaatgcaagacatgggctgatgggcacaggtacctcgatttttattgatatgaccctctcgcctcttctcatgttttccaggagtcacatatagatatgttctattcatcggatatttataaaattcaatcgttgattggaatttgacaccagtccctttaggtcatattccggtggcattgtctaatttatcatgcatactgtaaatttctgatattctctcagcttgcttgttctgcctgatgaacattttggttttgatttcttgatatttttattcagttccaaggtggtcgcagcattccttgaatcgcccgattccaaggtaagggatcttgcaaaagctgagctgcagccgctggttgatcgtggcattctgaaaatctcagaccataaagcagtcgaaaaatgagttttgcacctgacttccaagcatctacagcaatacgagaaatcgacagacgaacatccgtgcttctgtgttggatgttttttttgtaacatgagtatgttctgcggagcaattttgtcacctgttaaaagagtgtagctactgctgtcaccagtgagtgagtattaactctccgtaatgttatgtacctttacagtaaaattgcatttattttggtatgactgcaagatacgaattctccggccgtgtttgttctgcataggaatgcgattgataattttattgacaactgacctgaacaaatcttggagaaaacggatgccttaatcatagagttgtcatttttaatactagaaaacgatttttgcaaaacacttacaaatgcttcaaaacctgggcagtatttagagcagtatttagagcaggtacaatagtaaactattagccagctataaacatattttaatgagataaaaaagataagagataagagcagcggactgtagatatgtagctagctgcagcacgaacttcaagacgcagtgtgtatatgataggtgggatcgtatattaatagtatagttagctattagattgactatagatgaattggagctagcagtggacagtggactatattattaaacttcttttagtgaatttcactgttttcctcttcttgttgccgtaaaatgaactaaagaaagctaagcaatctgaaaatgtaaacgattctttgagagagaatggaagctaataaatctgcaatgtcactagcaggagttcgtccgtcaccaatgacgctttgttcttgcggcgcgctccggcgcggttctgatctgatacaccggcgactcgccggcgccgctgccgcaccatctctggttccgatcggcggcgaggttctcctcgaaccggcagaactccgcggcgaacgccggcggcgggggcgggcgggtgtccgggtagccggggaaccgcagccggtcggaggggtcgaagagcgggaacgactggcgccgccgggcgccaccgccggcgttggccttgaggcagctgtcgatgacgcggcactcgtcccggagccggttntgcacctcccgcagcgcctgcgccgcaacgggaatcctcctcccccagcagcagccgccgcggtgcttcccgtgctgcgcgccgccggtggccgtcgccgccgccggcgtcctcctctccgcgcggtgcctgaacctgtcgtggcacgcggcgcagtagctcgcgcccgctcgtcgtcgaaggctcgccggcgagccccgtcagtgaggcacgcgtgcgcctgcacacgttacacgatttgatcgtcgcatcaaaagcagaaaccgcaacgaaacgaaacggtttttgcagaattagtatactattacgaggcagtaaaaactgtagcaaatcaccacgtttaatcactgttacgttaaccacgaggattcaaagtttcaaatcgatttgaaaacgccgctctgtgggcgaccaccgctgcagtaaccgatggtggcggcgatcgaaaattgaccatatctccaagaagaggagcccaatgcaatgcaaccacccactaaattgaaagcaagaaaaaaggcaaagattccaagccatcattaggaagaagaagcatgcggaggcagagattaccaacctcggagacgatcttgaatgcgacctccgcctttgcgtgcgtgttcttgtccgggtgaagctgcagcgctgcatgcaaaccaaaccaaatcaaatcgaaccaaatcaaaatcaggtaatccgattcagggcattgcattgcgtcgcacgcaccgagctggcggtagcggcgcctgacggcgtcctcggtggcggcgtcggcgacggcgaggacgaggtaccagtcgacgaagggcggggatcgctgccggcgccggtgcgtgcacgcggagaacgccgccgacgccgcgcacacctccctcaccgcctgcgccttgctaccgccgccgccgtccgccattgccattgcccccaccgcgtcactcgatccgcttcacctccacggccatgcacattcgatcgatcgatcgatcggccgcagtgagagccgagccgagcagtgcaggcgtcgcggcgagatgctaccagttatagtaaccgtgtccacttcgtctctgcgtgtgaggagtggagtggcgagacggtaccgttcaaagcagcgatgagaggagatctcgaggggggaattcaacagcgcaaattgcggccaagcgacaaaaatcagaatagggaaataaaaaaaacaaaatgatttgatttaacacggatcaattaaattcatcacatactactagagaaatatttatcctgttttttaataatatatcttattatcatattactctctctaataataagtatttgataattatgataagatttggtgaaacttctacaattccgatcatcgataatttctttctcatattgttggttcaaagattaaataaattatgtacgtatatttgacttaaaaaagactatcgtaatttaataggtccatttatggatctatatgctttgattggaaccaaaagatctagaaattacagtcttaatagattttgaaaatttattctaataaaaacttcaccaaattttctactccttccgtttcatattataagttgtttgacttttttcttaacaattttttttagatttgactaagtttatagaaaaaaaatagcaatattaatgatatcaaattagctccattatatttaactttgaatatattttgataccatgtttgttttgtattgaaaatgttattatattttactacaaacttaatcaaacttttttaaaaaagatttaaaaaaaagtcaaacgacttataatatgaaacgaagggaatacttaacatctcatttatgggagtatcttttatggtaccacatgttagtctctctatattatcttccgatgctctccttgctcgaatgagtacatgttgtatggacagagggttgcagggatcaaacaagtgcagctcgccgacgagatttggtgtttgtcctgttgctgtaaacgtccaatgttttaggttggccatggcgatcaaagtcctgatgacaccgaatactgatctggaaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcatcggttgccgatgcaagaattttgtccagtatacttggatcaccacagaatgccaataaaagaataatattttcaatgagcaatgaaatactattttcattttgcaaagacctgaagaacgactgaacacactagctaaacacgaaccctatcttttcaacgttccaatttgcgacgccaaacacaagcaacaaagaatccaaagctgatcttggaacagtgtaaaaattttacacacccaaccaattgctaatatgagagagcctttggagtaattgtggctgttcacagctaaactcaaatctgatgctagaataataaagaagacatattgattattgaagcgtagctcgcctgcagcagcaatcagacagagctaaactgctataaacagtttggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccgtcgccgccgcgggggcggcggcagcctcgggcaccgcgctgctcgcctacatactcctcgcatgctgccggccgcagccggcgccggaggccggcgaggaggaggaggaggagtcgcggctgttgtcgtccggggcggaggcgcgggggagggaggcgggggatggcggcgaggaggaggaggagtggccgtacaggccgccgtcaacgtgctgcgaggcggcggcggtggccgcgcgcacggcgcggcgcacgtgggacctcaccgtcgggcgctggggcctccacggcatcgccttcgggatcaagcgccacatgaagcgccaggtccgcgagatttttcgcatttcacctcgtgattcctcgctcttgtgcgcgattactgcgatgctgccagtattcagttcttctgttcgtttctgtgtctgcgctttgcgtttcttacttgcaaattgaggatcatttcgctcgatggctttaacgatagcgactgatcacgatgttctaactgcgctcaaatcgcactgagcggcggaacgtgtagttgctttgcttcgagtggactttttcttcgttttagttttactcttgctgaaaattttggtgtaaaaggcaggatttatgactatttcaaggtttgacttgatttgacttgcaagtaagactgcttttgcctttttatttgggaaataaaggctcaatgttgggtcagtggcttacaatagcttcacctctaccactaattcaatacattcctcgtacttgcaatgtcagatcatacttaaattctgtgcgggacttaagatcgttgatgtaaatatgggtaaatctcatggatccgtaaggtcggattcatggattttttcagagtcaagctggtcatggtggtcaaggtctcctctagatgttgatctgaagtgagaaacgtttccaactgttctgaacttctgataaccaatcgatatgcgttttatacagagctggttattttgttgcgcatgtgtgaatttgctagaagaacaactaataaaattggaccagaattctgttgtcttgctaaaactaaaatggttgctcaaagaagaggaaacaggacgcactcaacattcagttcaatataatgtactctgtttatctgcagatgttctttgcaaagctattcaatgcatcaaaactcaataagatgtacttcccgtgagtgaagagaagctggctatccgatgttctgatgaatcagcataactagcattttgttctttaagacgtaaattcggcggtagtagattgtttgctgaagcaattcagttatgcagattataatcagcttggttctgtatagctgtcttgaacatattacatagtcaatggtgtggaatcatattgtgactgtattttttcctgtttgtgtgctctagggtgatttgcagcatgagtatagtggaaatgattgccttcaactaaaaggtcacgacgcacacactgaagtagcttatctacttgagcacttgaagatttgcatgttctactcaaagaaaacattttcagcgtttcttcagtttggtgggtacaatcaagaagacattcttattcacaaggctagggcgagggtgagtaagtatcactgtattcctcttatctcatgcttaaggtactcacatttacaatttgtatttgttcctccacattttgactcactcttaactatcaacttgatgcagcttatgcaaccttctttcgcgcttgtgtgtgacaaaaaatccaagtgctttctgcttttcattcggggtgctatcagtactaaggagcgcctaacagccgcaactgctgctgaggttccttttcaccatatagttttaagtgaaggacaaatcagcaacgtggttttaggatatgcacattgtgggatgcttgctgcagctcgttggattgctaaccttgccaagccccatcttcacaaggcagtacaagaattccctgattatcaaataaaggtatttcttattagtgctatgcatggatgaagtgactacaatttataggtgtagccgctgcagtgcgctgtgatctatatacatgaccttatttgaaataatttgtttttgataaatatcactgagacagttaagaagcgtaatcagatctctccttttgtcttttatgtcatgtttatttttgtgaagatttctgacccaaattatgtctccttatttgtcatttgtactaggtcattgggcattcaatgggagcaggtatcggagcaattctgacatacattcttcatgagcatcatgagttctcatcgtgcacgtgtctggcatttgctcctcgtaagtgacttattcatgatttacatctttaaagccacactttgcttagtttttgcattgtgccttcgagatattatatggctttatgattatcaggtgttttcttatattattttcctgagttgtaactttgttctgtttcagtacttaatgggtgacaaaagttgttttggcactatgttctcatgatctcatccatgccaactgtttggttgaacgttcttgtgtacaatttgcattattggacagtgatggagaattagccattgttttatacagatatgatagaattgcattgacttgcaagatttattttattaggctacaagttaatccaggaactgagacagttatactattttctagatttaagagaggaaatgctttcagatttttaaagggttcctgttttgtatagctgcctgtatgtcatgggagctggcggagtcgggcaaagaatttgtcacttctctcatcaacagaaatgatgtggtcccggccttttcaaaagtttctgctgagaacctgcgagctgaggtactctgaatttctgatggccagtgtcttatgtgtcagcataataaaatcagaccttcactagtatgaacttcttttgtaattaacaaggaaacattttaagaacttagcaaagtgttaatacattaatttcttgtgatatttcaagaaatatgtgatgcaatggagatcttagcttcaaacttgaaatgttaacctcattggcatactggacagtggccatataaaatttctgataaattgtgaaaacgaccatatacctgattcccaacagtgttctatcatcactgatttttttgtctctactgcaggtaatggtatcatcaaagctagatgatgagcaggatcaagctcactttagcttatttacggcaataagtaagcgtgtagctttcataaagtctcatatgctgtcagtatctcatccaacagagaagaacacagatcctgattctagcatatctgaggtaatacctcttaggcactttaatttctactatttaaatgattgcttctgtcacttgtcactggatcctaaactagcacaatgataattttgcgtccttaagccacatgtgaacccagcacgagtattaatttgattacccagcggttttaatgactgttaacagctgatccagcgatcctttctagcatccaatcccaatcaacaccgataacactgtggcgggcatgctaatattatctgttagtatactaggtagtaggcatatctttggtacggatgattttccttccattggccatacaagcatcacatctattacaaaagggcaaaatgagaatttccatcatgcacagttcctgcttctccgtgcagtgtaccttccaaaaatttacagaagcaaagtaactcttgggtttactgattagtgccaacgtgagtacagaagcaaagcaacgagaggattgacgattttctgacaccctatttattctgtcaatgcagcccttgctcaaacatgtccccgaaatcacgcagcctgtaacaaatgggctaagcacagactgcaaccagcatcaaacggacctcgttgctaatacagagcaggacttttcagctgtatcagttgttacctctgaagaaaagattgtactatctagcaacgataatgttatcagtacaaagtctgttgctggatcaggctttgcagcacaaggggatgtgaacatcaatggatcactggacactgaacaagaacaatcatccttgacagggcaggaggaaccagaatcactgaagcagaactgtgatatcaaagacaagctgaaagaaccgctaccaacctgcagttcgcgccagtttttccctcctggaagaattattcacatggttgcaatggcctcacctgacccaaatcctggtgagggatccagcagcaatgagatcattagcatttatgaaacgccaagagatttgtatgggaaaataaggctagctccaaacatgataaaggagcattacatgcctagttacataagcacaatggaatcattattggaacagctgctcaaagacgataatgtagatacaataacaaatgatttgtaaattatgtaaaaactcaataaattattaatccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgggttcctcaagggcgacgacaacctggacgacgacgacgacgactgcggtggcgggagcgttgggtgaagggggcggagcggggcggccggcgcacgcctattaacagtgaaatttggtaatcggcaaagacgtcatcggcttagaatcattatctgctgcagcatctcggaatcagccgatgggagttatcaagtcgccaatagtcggattcctgctatattcggttaaggaaatcaatctactaaaggatacttatccctaagtgaccgagtttaaagaggatgcggcatggcagtttatctattaattaggaatagtttgttagtttccttttatctttaggaaagtgtgtccgataaggactttatattttccttttatctttaggttagtttctttcttgtccgacaagggcttgtatcaacccatgggtataaatatgtacacccggggtctatgtaatctatctccacgatcgatacaattcggcgcatcgccaccccttttaccttttctactttattttatcgtctggcgggacttggcacccgacgcggggctgcatcggtgttcgatctccggcttcgatctccggcgaaggggtaagtccaatgtttcgccggtccaggcaattgtatcatttatgtcggcgtcgttcaaggctgcactagtacattcgacctcttggattgctctggtttggatgatatatttgcctacctatttatcatatgtctctgttaatctagtcttagcatatcaatttagctctatcggctgcttctcgttttagggtttttgccggtattagctaaatcgtgtttctagattagattagcttagacatctaccaccctgaaaactcagtcaacggcttgattgtctagatataatgtttcttttcatacttagtgctgcatcagttaagtttgatctactaagtcgtgcttagaaccataatctctagcctgcttcttgattgccaataagggtatcatcggggttttagccggtgagttatctggacgttgcatcggctcataaggattgtatatacatataagttggatttagcgatgacaacaaaggtttcactgtttaatctaatcttgtggatttcatgacatcggacctccagccgatgtgtgctttaaacctcggatcgatgcttatttatcatatcattgctagccgattggtttataccggattatattgcaatattatattatcatcagccgattgcctttatatcatcatctacattggacatatagccgatttatcaaaaccctatcgctatcggctggtatcggcatcggctattatcgactatcggctggaactactctatcggcttgtcagccgatcggttgttttgatctactatttgcatatcttgtcagttgcaggatcaaactgactggcacgcccgcatctcaccaacctttggacctgcacaggagttaagcagatctcctaggccggtgtgttcgattttttcgtcaacaacgccggattcctcaagggtggcgacgacctggacgacgacgacgacaactgcggcggcatggaagcccacgtgatcctcccatgaggaacccgcgcgtgcgccggccgccccttctcttgcgccctccccttctcttgtgccgccgccaccgctgtgccgccggccgccgaacctccccgttccgtggcacttggagagacaggagaggggagagagatgaagagcggggagatagggagagatgaggaagaaggatagggtgaggatgacacgtgggccccaccattttctaattatttttttgtgtaactaacatgtgggtcccacaggttttattatttttctggatcgaattgccacgtaagcgccacgtcagtgccacatccgatgaagatcgagtcaaaaatagctacgtaggcgccacgttagtcaaaaccgccatctaaaccgccgatggaccttatctgcaccggtttttatagtcgagggacccgttgtatctggttttggggttcaaggacgaaaattggattcgttgacaagttcagggacctcagatgaacttattcccccactttttcgatccccctggcatattcggcccaagataacccgatacaaaaaaagcccaagagtgtgtgtgtgtgtgagagagagagtgagtctgatttgcttcctccgcgaaccggtcgtcttctccagcgagacagccgccgcagaaatgggtgggagtcagctcagcctcaactcacttccgctaattcgctgcatgcaagctctcccacgtccatggcggatcccgcccgcgcatctctcgccatggcagcattagcacgcctcgctcacaaaacgctcccgaccacacgaacccaactcccgctccccaccaccatatatcgctcgccgcggtgcctccacccatgatcctccatcgacgacaatggcggcgacacgcggctccgtgcggctcctcctcctgatcctcctcctccgccccgccgcggcggggagcccactgatgatgacgtgcgccaagacgccgcacccggacgtgtgcatcaccgtgctgggcgccatcccggagtgcaggaacaccggcgacccgcgcgtcctcgccgagaacgccgtccgctccgccgccaccatcggcgcggcggcgggcacgttcgcgcgcgcggagctcgacatcgtgaaggacaccgacatgtggcagtgcctggacgagtgcgcgcaggacatcgaggaggccgtctcccacctcgacgacaccgagggcggcgtcgtcgacctcgacgccaagttcaaggacgtgcggctgttcatggacgtcgccgagagggacacgtggtcgtgcgaggagagctgccgggacgcgccggactccaccgtcaaggccaccctgctcgacaagaacgaggcgttcgagaagttcatgcgggtcaccggcgcgctcatcgagatggtcatcggaacggccggcgagccggcgccggagccgtcagctgatgaacactcggacgaactaataccggatgtccagttatgatcaattcataatgtactaatcgctcatgtgacttctcatctccatttttgatcgatcgtgttcaggtattttgattaggttaattaagggcccgttcaatttgacgtcattttcaaccataccattttttttaaagttgtcaaaaaaatgtctacgtttagtttgctactaaatttgataaatatataagaaatcctgccaaaatttggacaacattatcatcttgccaaaattttgatattgccaaaatttggtaagatttattttggctacaatctgaacaggcactaattaattaattagctcttctaattcgttgaatgttttgtttaaccatcaataaagtggttgattcgttcattagctaactaataaatcatcagattataatctttctttgtcatatatgcatctctctctctcccctctctaagcttgagtattctatagtgtcacct

SEQ ID NO: 74863 - DNA, 5056 bp, Oryza sativa
tggctcggctcggcctggcttgggcgcggcttgggccgagcggccggcccaggaggagtggagggaggggaggcccgggagagagaggggaggggagggagctgggctgggagggggagagaagaggtgggccgggaggaggaggagaggcctgggagaggagggaaagagagggaggagagggagactttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatcaattaattatcataacacgattaaccatcgtaagctaccactaaatataaccataagtaatatcgtaatatgattaaccccattgatgagctaatgtttctaagcatggctaagcaattatacctatatagcacttagctgaaccaaaccaatatataaggtccaagctattcaatttattacccataggaaaataaagtcattgtcggccattaaataactgggaaaggctcaccacccgacgacattcgaaaataatgcataagttgaaataaaacattagctttaaacatgttcaacatgctaaaagcgctgtttgggatctgtgtgacttgccttgagcttcttcaaacacttctgaaccttcctcagcgtaaacgctctcctcgggaatgtcggaaactaaagcaaataaaccaaatcaacaaacagtacaaaaacaagcataaacagtacatgtggatatttttaacatgtagatcttgattttagatgaatttagcaacttgaaccacttgaatttgagttacgatgatttagttatgaatttccgaagtttaatcgatttttaactaatagaaaaaactaataaaaaggatttatgacatcatcgatgacaacatcgctggccatggcacggctccacgcgaccactagcgatagagagctcggttgggctatccaaggacacctacgcgaagaggacgacgacacgaactcaccggtgcaagaaactacgccggacaacgacgtacggcgaccggcgatgaggacaaacggcggcgcggctcgactcgacgacggcggcggcgttccagcggcttgcgacgacggcgaaggggcagccgaggtactcctccaccgtgcaaacccggcggcggcgacggacagcgacggcggcgacgctagcggtggcgcggcgcgactggagagtcgccggcgacggcggcgccgctacgaacaacggcgggactcgggacttggggcaaacggaagaggacgactaggggatgctttatataggcttggattagagagatcggactccaaccgagaggaatcgagccgggaaaaactagggttagttaggagagataaactcaaaacgaattcgatttggtttatctgggcaaaattgatctccgaaactctaggggaaagggagaggataaggaggagatgatttcccctcaagcaaccggactcgggggcgaccggttgaggttgaatcggaggagagacggcggtgctcgggctcggctcggcccggccggaggtaggggatgaccctgacatgtgggccccatatgtcggcggctagaggagaggagggacggctaggcttggattgggccggcgtggctgcacggccgcgcgcgagggacagggatgttgggccggaaacagcctaggggaggattttaaagactttttcaattaaaataattcgtgaaatgatgtttcatttattaaaaatacttcccttgctcaaataattcccagaaaaatctagaaaatagataagcaagcaaagtatttaataaaattttatctagctcaattttgtgttgaaatttttcctagattattagagtttaacttgtaggtttttaaaataatttctaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttcttcaactgcgacacatgggaaacgatcatgtattccctccattgacagaggcaactctacttgataagctacttcacctctccgactcacaatcttaaaaggtcccacaaaacgcggtgccaatttctctttggtctgaaaacgatgaactccccgcagcggcgtaacccgtaggtatacataatccccttcttcgaaagtcaaatccctacgacgattgtctgcatagctcttttgacgcgactgagcaactcgcaacctttcttggataatcttcactttttcttctgcctctcgcaatacatctgtcccaaaaacttgacgctcaccagtttgatcccaaaggagcggtgtacggcacttacgaccatacaatgctttgtatggagccatttgaagactagcttgataactgttgttatacgagaattcagcatacgacagattcttatcccaacttccaccgacatctagaacacaggctctcaacatgtcttctagaatttaatttactctttttgtctgaccgtcagtttgagggtgataggcagcactgaaattcaaacgagtacccatcccttcttgtaagttctgccaaaacttcgaagtaaactgactacctctgtctaacactattttcttgggaacgccatgtaaacatacaactcttgccatatatagctctgcgagcttatttcccatgtaggttgttttgacgggtatgaaatgagcaactttagtacgcctgtcaaccactacccaaatagaatcatgtcctaccgatgttctgggtagaccggtgataaaatccattcctatttcctcccatttccactctggaatcttcaacggttgcagcagaccggctggcttctgatgctccgccttgactcgctgacacacatcgcatagagccacatattctgctatctctcgtcgcatgctggcccactagaattgttgcttcaggtcttgatacatcttagtgctcccgggatgaatggaatacaaagtttcatgggcttctttcatgatagtatcctttagctccttattatcgggcacgcaatttctttctcctagccacacagttccttgctcatcctctatatagccgatggctttacctcttctcatgttctttttgatttcttggatatcaggatcattcatttgagcctctctaacttgatcaaaaagagtaggctgagcttctaaagcggcaacaaaacctttgttgactattcccaagttcaacttttcaaattcctcacataactcccaaggtaggtgtcgaccttctaacatcttacaagtagcttttcttgttgagagcatctgctacaacatttgctttacctggatgataatccttgatcaactctaacccccgtcgttgacgcatgttcaaatcaggttgagtgaaaatgtacttcaaacttttgtgatccgtatacatctccgtacggttaccaaaaaggtaatgacgccaaatcttcaatgcatgaactcagatgccaactttaggtcatgtgttggatagttattctcgtgggggcgtaact

SEQ ID NO: 74864 - DNA, 3277 bp, Oryza sativa
tcctgcagcccaacatagaagcccatgcaaaaaataaaaggagaatacatgtgtacacttcccggcgaaaaaaaattccccagcgagaatacatgtgtacacagcattccttgtatgaaagaagacaagtcataaaaacaaaaacagttttatttgcttggcaatgtctagatgttaaatcagttttttttaaaaaaaaaaatcatgatacgcatatgaaacccaacctatcatatgatcattgtataaaaactaggtaacccaatttggaccattcgtgaaggaaaaggtattttaaacggttatatggtcaggacataaggcggggaggctctttgtgtagttcactagttcaggttgtaaaatatgtcaaattatttgcaggcatcaataatactagacacaagtggcatgaactacaattacatatgactttatgtgacattaattagttggttcacaaaattcaaaaatagcataatcaaaatggaagttgccaggaacatagtagcaaaattaggcatgaaaagtaacataaagaggcataaatggcaatgaaacactagctatcaaatgcataagaaaacattactaaccaataaaaacattccattcatctgtcaataattcctaagcaagaaggcatgttgtctaactggtagaagctgcccttcagataaaaaaaatactttacagtatgtttggataaaaatcctaaagaaatgttatccacgtttgcttcgctgccccaggttaataaaggtaaaaagaacaacaatgtatttctttttgcagaatatcatgatccaatataaaattaaagatgtgattacaaccttggagaaaaaagatccacacagctctggtgctcggtaccaccttgttgcaatataatcctaaaaacagaaaaatcaattagctgatgatataaatcttaagagtaatgagctgcatagtgtgtagtgggcgtgaaatgacgtaccgtccagaagatggcggttggagtatcactaaaagctacccttgcaaggccgaaatcacatattttgagcttacaatcagcattcgccaagatattttttggtttgagatctcgatgaaatacatttgctgcaaaaagctatcaaaagatgcatcagtcaggaattagagtcacaaataggatggactgataaataggaatcacacaaacatagaacactgagtacagaaaaaagattaatctgttagtagtcctcgtcttattattcctttcctgaatggtgcgtttgtatttttcagcctttcatataacaaaagtactaaattggtcaaactgacttcttagaataatttagaaaaaaagaggggatgggggatgagcacatgcattatttacagcatcattagaagcaaagcaagatagatgtttctatcatggtataaaatgaatagggaaatcctattcaatcacaatcaggttaataaaaaaacctaaagaacagaactaacttagtcacaaaagggtgcttcatgtgaagggtatgtctatcaggaacaacgaatgctggaatgtgtcaaatatatgtaaacacttgtgcttgcctttgttcttctgcttttgaaaacaaactaagttgtctgaccaaagccaacaaacaaccagggtaagaagatgaagaaaccagagaatatgaaattccttgtttattacagcccaaacctcggtttgcaccatggcagatgtgtatcagataacaaatccagttcaattggaagatgttagctagttgttcgacttttcacaaagggcagcaagcatagcctcttccctaggaaaagtatttgttatattgtattgccagaaggtaagaaccatggtcaatagcatgtacagatagaagatgaggttgcagttacatgcattatactttcaggatgccatgaataattttttggatggttaaactacccaatgcctcaggctgtaccatcctggcacaaattcagtgtatccacaacttgggaagcaaaggaagacaacaagattctgttgatgcccgctatggaagcttgctaacacttcagattttataaactctacatcaaagggcgccagggggcatctagtcatcccacaagaatgatccacatttcaggagaattttggggtactgctggtttatttgtactaaagcaaccacagttccataagattgttttcattatatagtttgtgcagataaactgtaggttcccaaaaaagcacaaatgctgaaggaacaatcccagaataatctgctagtagaaaaatagtttggttgttatctggcaacagttataacatggtggcaattgtccttagcaaatttatttatttaaatagaacattcttcacagcaggctactgaaagaaatgcaaaagaaccatctttcatgtgaaaataaatcaattacctgtgtgtatatatttcagtcctcggagcaactgatacaagaaaaactggtagtgttcaggagtcaagtcatcgttggcctttataacttggtgcaaatcagactccatgagttcaaaaacaacgtagatatccttgaattctctccttgatggaggaagtagaatatgcttaatttccacgatatccggatgtcgcaggagtctaagcaacttgatctcgcgaagtatccgtgttgcatcggacacatgctcaaagatgtcattgattttcttgatagcaactttatcaccggtgtgagtgtccaaagcagagcaaaccacaccataactcccttttcctataacctcttctatcttgtacctgtttccctcaccgtactcggtgaaaaaatccatctcagaaggtgtctgaatcataaaaagacaaaatggatcagaatcagactagttcttttagtatgacaaaagaatttttttagtatgagaaaaaaaatcctttgttcaattaggtcaaccatcctaaaggcattagctaaatcatactgtatgaaagcggtttcatcggaaacaacataccatgtcaatcatgtatgatgcaaaacagcaagcgttactttttttatggggataaataacatcaagtgatattcttttttatttcaaaaactgcttaggggtcagaaccgcatgattcaacgatgtgtatggatgggggccatacgtacgcatatctccaagtccaggataacaagatgcaaatttatgtactgcataaatcagataaaaatatgaacatacaagacaataacttgaggtcaattaacagtcgccaaggaaagt

SEQ ID NO: 74865 - DNA, 5810 bp, Oryza sativa
acctccgccaccccgaacgccgtcgcgctccgcgccagcgtccccacgttgtgccgcttcgccacgttgtgcaccaccaccacgctctccaccgccgccgccgccgccgccgccatggccgccactcttttctcctttattttccttttttttttgcttttaattcgctctttttttctcgctgtgatgtgaagaagggtggaaatggactagggaaaatactacgcgtgagccattccactgacatgtggggttcacctggagggtccatggaaaggaagacaccgtgccttcgtcgtaggccagagatcgtctgaaaattgaagacaatgaagctcttgatgctgctgcgttgagtgtttatgatgcaaactctcatttgcaacgcaggaaatttcacagtatttcatataagaaatttcataggaatctgtttgtttatttaccaccaaaattgggagaagagctcttggaacacaatgaggtcaatggcgaatcagacaaagccacatagtacaaccagacttattaacatcatccatgaaccgaaacctcagttcagtgaggattccaggataaatggaatagctcagaagcatcaaaattcaaacacattttgatactcttacctgacaagaactagttctgattgcctgcaatgctcagcgaaaaaaagataaaccaaaaggaaaagcattcagaagacaacgctctgtacatcatgtataaccaacacccatcccattatccattatctctgcggggttttgattgatgtgcgaccaaccatgtatattattctcaaagtttaaccactctcaccaccactcattattccatccaatcttccatccatccatccaaggcaagctcagcaaatcaatcaaaaaaaacaaataaaaagagaaaacaaaatggtgtatatgaagaagtctagcaaccggcgaggcgggcgcacaccctgcgctggatgggggtccggcacgatgggcactccttcatcccttgcttgtcatggaggtcattgcatttcgcgcagaccacctggtgcgcgcaagggaggaagacgaccgacatctcctcgctcaggcacatgacgcactcccggtcacgctgtatgtcgtcaaaatcgaaatcctggggtaccgctgctatattggccaaaatttgagcgctgccattctttctcccttcagaaaggcgcaacgcgttggttctgttgtctgctccccacttgggaggggcaccaaccctcaacgagtccaaggataccttcagctgcgaaatctgctgctcgagagcacgtatctggctcttgtatctttgcgtatcgttctccgctttgagatgcaggaagttctcttccgacctcagtgatgtctcaatctgatccctctctttcttctctaagcttacacgggcaattgcctcaatctttccagcctcttcttgcctccaccttgcctggaagtattgaagatcatagaaagaccaaagatatacaagtttagtgaagacagcaatgtaaagggatgaatgaatgaatgatgttgtagagagccgcggcacaagaaggagggacgcattaaaaaaagcaaaattataatatttacagaacagtcttacctaacccacaatattaatcatcactgagcttctacttcagcaaaaacatggtatttgcaatcaactcaatatgaattcatgaaagtaatgaaatgtagactgcaagcgcataagttccatttttatgaatcctctagcagaaactaacaacatagccaaatgacagattttgtccaaaaaccatgatagtgcactcaagacagtttaaagcagtctactctatccaaagcaacaattcctatcattgatcattgccacgactcacttacaaaatatttttcatgatttccgccttaagcagaaatatgtacctggcgtctgaaagacagtgaagataaggaaggttatcattgcatggcatattcgacaaatttaagattggcaaagtgcagatgtgccagtgaataaatagcattgtttttgtacattcaagctttggaacttattgaataccatttataaagatatatcatcacatgaaatctttatttaacattgtcaacatttgacaaatcactaactagtacttgactggaaggataaaatgcaataccatgtaaagttcacaattagtatttccttaaaaagttgtgtaaaacattgcaacgtattcatgatatacaaagcatgctagagttgtcttaattaggacatccaatttagctaccaaaatttctaccttttgggcatccccaaccccttaggagtgagattcaggaaagtaaattaaaaaaaaatgtcacatgaagcttaactaacaataaaaccatgacatgtgcatatctgttaattgcccagaaacatcaccatatattaaagaaaatactgcataaatggagacatcaccgtctattaacttctttgacaagctctaagcactgttaaaaatactgttatccatatattttacaagcttctcactctctcagtgccaccttacatcagatttattcaaagagctactacacccaaaagagtaagaactaggtcaactgtttatctatacacaattaaagtcaactattctaagtggcaatgcaattctaacaactcaagattgttcagatatttcaattttacagaaaccacatgaattaaaggttgatcatatataactaatatgattcaattgtataaacttcccttcaaaagattatgaagaggtaaagataaaggctaaaccaataaatacctggatttgatccttctgctctttagcatgatgaagttgctggtggacctgagatagcttgttcctttgagcagcaagatcctcttgcaacagggctctttcagattcccaatgctgagaccttttatgactgttctcatccttctttgaaagctccaaaatatttgttgcagacactagtgcatgccgctttgcagcttccatctgtatcctgagctgttcattctcggcttcacgtctacgagcagaagattctgccttttccagctgggtgttcgccctagaaatcgcagattccatctctaaaagcttcttccgagtgctctcttccagattgtgcctctcttcttggaggcggtccgcttcttccttctctttcctaagtgaatgaagctcttccttctccttggcaagtcgacgagtgacttgcatcaccttctgctgagcccagtctgtccaatccctcatatgtgcttgcaactctttctgccgctggacaagaatcaagaccatttcatccttcttatcttgtgggatccaaaccttctgatcctcatcatatgataaattgattttgctgctagagtccataccctctgtattggcatcatgattcgaagatggagcaggactgtcatttgaggacggcaatggcaacgacaatgagagatctgtgctagcagctggtaatgggttcaagttactactcagcttggcatcaaatgatggattggagggaagggcagcaccagtaaaagaaaggtcaggtggtacttccggtcccttcatgcttgcagaaaaccctttgcctactttggatgaggccttcaaactgctagtagtagaatctgaaaacgacctgcacttcctgtccagcactgcgctacccaaagagctatgcttgcttgacctaagagatcctttagaacccagtgctcgggaactcttatcaaaactcatcaacttctgccgatgcaaggaatcccgcttagaactccccctcttactagggattggcttatcatctttcacaggttgtgtcgcagcagcaacgaatggttgctcctctgaatgatcaggcacaggatttgagttttcttttggcttaagattcgggatttcactctgcgccttacctgagacagagggtttactgctcggtacattcaggtttgctggtgttgcggatgaatcagccttggcagtattgtaagaattgggtggcactggggtaagttttccacgaaaagtgacgccagtctgtgggttggtaatagatactgataaatccgaacttggattattaggttcatagtttccaacaactggctgggcaatcacttgcgtatccactgctgggagggaagccggattgtagtccatggcacaggcattggccacattcatatccgacataagcaagcagaacatcacatcacctgtagtgtagaacggctgagcctgattgaccaacgcaatcatgccaccgagcactgcctgctcaatcttcctcatgtcttcctcggaggcgccctcactcaacatgtccccctcggtcttgagcacctcgaccgccgcctcgccgaacccagcaaggctctccctccaattgtactgcgtggcagcccgcaggacggcggcacgcgcggtgggctcggagtaacccatcgcgatgatcacacctacggcattgtcgaacgtcgcgtccaggcccttgagaaggatctcctcgagcagcgcctcgttggggtcattccaattcacatatctctggcactccagtagctcctccgccgtggggtgaatatccttgcaatcgcacgagcccgggatgaggtccaggttgacgccctcggcggccaccgcggcggcggccgccgccgccgcgatggctgccttctccggcgacatgaactcgaagcccacgcagtcggccgtcagtgggtactccagcccgaatgaccccagctcggcggacggcggctcggcgcggtacttgcgcttgttccggctcgccgccttctcctgcgccgccgccgctggccccaacggtggatgcgccgcgagagtggacatcacgatagatagctgctgcaaaaaaaaaaaaatccccccgacccaacaacaaattcatcagagaaatcacaccgcgcaatctcaatatagcacaagaaaacaaacaaaaaaattccccggatacggagaatttgcgactcacctctggttccttcctgcgcgtgcgtgcaccgaatcagggaagagagagagatagaaaaaaaaataaaccctgaaaaaacaaagagaggggaaaaatgattcagtaacaatcgggaagcaccaccgaatcaagaaccaggagaaactccccggcgcgcccccaccgcccagtgcccaggatcagatggggggaggaggggctgttcttgatccgatcgggtgtgggcggggggaggtgcgacccgggagacgggggcagcggatcgaggcgcgtacccgggggggggggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattac

SEQ ID NO: 74866 - DNA, 9716 bp, Oryza sativa
tatatagttttgtgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatctgttcgatgcctcgagcagggctgctgctgccttttgtatcctttcttcagtctccatgggctgggcttgtagtatggctaacatagcccatgtacaacccaattgagttcctaacaatcccctcttcttagaattcggcttgtcctcaagccgatgcaaaatattgcagatgtatgtgaaccatctagaattccaatagtcatcttcctgaagaacaaactgatgggtgctaagattgttgcttcgatataactcctttggagcaaaattgcatgcttttgattgatcgttttttgcccagcactcttttggcatccacctttgattggtttggctcttttcatagcactggtccttcctagtcatgccaagcaacttagtatcccatatagccatactgttatatgtaagatatttttttgaaattgcacataagtgtagtccagccttgaaactagatcctctgctcccatggacaacgacaataacactaagtagaaatttccatgtcctgtgtatgagcaggcactgcaattgcttgtgtgtcataagattcagcagcccaattgacttacaaatattcagtgcatgtgcatcaagtacttgagtagaagctgaatatttcagaacatgtgtgttcatctcaagtatagaagtgtcaaaactgctgatcatatttacctcttgcaataagttcttcaccataattttaatttggaaagtcctctcattccttatcagttcaagcaatttcctcatggacccacatcttgctccagcctctgaaacatgtagtatatgtgaaccattcccgatgccaagctcatgcctgacaaatgctcttgctggcctgacaactgtatgcctgtcttggtcactgtacacagtaccagcccacccaaacttaaccatctcatggcaaactagaatggccaaagcttcaagacatgtaaggccaacaatatgccccagatgatagcagtgcactagagaccaactattcaacagaattatgtcaattgaggtcctgttgtctcttggattccaaggtttgcataagatttgttcttgcccattaatatgctcctgcaggctagatactgcaaccattgtgcaactttcctgattcaacaaattccactgctccatcctagcacatagactcattcccactctagttttccagcacttgcattgcgcagcctgaacaaaagtatttctacaatttgtttgatttggtggaggccatggcttcaactcaccacggtgcaaattaatatccttcagctcagtgagaatcattacattaccttgacataccaatgcaagacaacttacttcggtaggtggcagccaaggtggcaaatgatgtacccttgaccaattgagtttgaattctggaccagccataggctgcaaatcccatccattaatcactccatcacaggttggaggtggccatggtggcatcaaacctacacttgtccaaaaggaatcgagtacataccatgggatgtgccacacctcccctcctctaaccacaccacctgaccagggaggtggccaaggatctctcttgggatgccccaccagcaacttcttgatagctttgaggcatttcatcaaacactcagtgggcatcagcttggcaaggtccatttcagcgatcaaccatggcgacaagacttcggatgatgcatcaggtaatacaacaccctcaggcacacccatcatgatctggcatgtgaccctggcgtggtctgcaccacccttgacatcaaggccaactgtcgaacagttggcgggcatcgccttggtactatcaggggtgtcaatgttggtgctgccagtggtgccgtcaatagctaccaactccattgatgacacgacaagggtggcgcaagtaaccacagtagccacagtgtgatcaggcttggtgtcggagctggaacatatcgtcgaacacttggtgggcgtgaccttgggaaggtccttggcggcaatgtaggggacaggatccttgtcctcgacgtccccaagctcgaaggcaaccatcggggcaggtacctcgcggatgtgacttgaattcactgccacccaagtgaagttgtggttgtggcattccatcaaacagttggtgggcgctaaagaaggtgggtgccataggtgtcaaatatgatgcagcgttgaaaatggcggtggttcccttagtgtcagcaatcgtctcctgggaagccttgctctgacgagcctctatgtcgtccaacttttgaaaattttgattaagcttgtcctctggccggcgctggcctgccatttgttcaaacttctccaatatccgatccaaagcttcatctaaccatttctcctctttattcatggtggtattgatgagaacgggctgtgatatcctctgatcttccttggacatcccaggttggcttggcattccatcgagcagttggtgggcgatgcttggatgaaaaccttcccaactcaattcttgctccatcttgcatggctgcctccccaacacctccatgacaaaaatcccagtgaaccgaacggctctgataccagattgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatatgttcgatgcctcgagcagggctgctgctgccttttgtatcctttcttcagtctccatgggctgggcttgtagtatggctaacatagcccatgtacaacccaattgagttcctaacattttgttacagtcaccaaccactggaaactaagctaatacagtcaccaacgacaggcagcaccaaccaagaagttcagggaatttcaccaaaataaaaggcgaaatcctaaatagaggcttgctgcttgggttcctaatcatgttctagttgagatcacgcgggagttgttactgtaacaaaatcggtgagcagataatactggtgcctagtggcgaatcgggtcagaacaaactcacattgttgtggctgttatcgagctccatggataatccagccttggtctgattcgcctccccgtgtgatggagtcgatgcggagcaggaggggatgggcgcagaaagagaaagcatcctcgagcgctcggcgacggcgagaccctgagggcgccttgaggctgataagagcggcggcgggtggtcggcaggcgccggtgttgaggagagcggcgccggcggccgccgcggcgagctctcgccggcaatggaggagaatccgaaaaggaaattggattagtgaccttacgttagatattaattacggatctgccactcggttttccggtgggccatagagaggcaagcttatatgggctgggctggctgtggatatatcacaacttcatgaaaagaaaaaagtctgatttgacttcctcaaccattggccgccgaatcttattcgtatccatggactgcaaattaggaataattaggctgtgtttgagggaggggggattgagaagattgggaagatacgtaaaacgaggtgaaccattatcgtatgattaattgagtattaactattttaaatttcaaaaatggactaatatgattttttaaagcaattttcatatagaatttttttttgtaaaatacacaccgtttagtagtttgggaagcgtgcgcacggaaaacgagtcacaatctcccccaatctcttttgaaagaacgcagccttagtattagtagcttctttggacttagctattggtttgtcggaaaagacatttaaaattgtgaagtgtaaatgatctacgaaatagtggtttaggttatcctgatttggcatactagaaaagcaaaactgcaactgctacgatgctgaaataatgattaagattgcaataattcattaaacaaacaatccgtgccgagaaggatgaactcatgcatactgagatgttcatcaaccaatcgcccaaattatgtcttcagcaagtacagcgtcacttgctctctgtccaaattatcatacaaactcatcaatcacgtcagggatccgcgatctacatttggtaaccgcggcttgtgattgattatctggcatcttcggcaccatctctgaattttctgtgtctatggaggttcagacatgacagtggccgtgtttagttggatcaaagtttggattttggttgaaatcagagatgatgtgactgaaaagttgtatgtgtataataggttgatgtgatgaaaaagaactgaaatttggatccaaactttggatctaaacacagccggtgtcactcactcagggtgtgtttagttcgcaaaaatttttaggtgtcatatcgaacgtttaactggatatttgaaggagtttacggaaacaaatgaaaaaactaatttcataactcgtctggaaacgtgtgacgaatttattaagcctaattaatccgccattagcacatgtgggttactgtagcacttatagctaatcatagactaattaggctcaaaagattcgtctcgctatttccatacaaactgtgcaactagtttttttaatctatatttaatgctctatgcatgtgtccatagattcgatatgacgttcttaagaaaaaaaaattgggaactaacaaggcctcactgtggtcacaccaaatccaattcaatgaccgagcaaagtcagaatcactcgccctccaattcaacatctcaaagattgcaaccctgcaatctccggtggtcgccggagctagcgacgccgtcggtggtggtggtggggctccggcgagcagaacgcactaaagaagctacacaactagctccacttttagtagttgtgtgctcagctcactttgatcacttcgtcactgcgcccctttttctctgacggcattgtagcttcttcacatgcattgcactcctctttctcatcctaataatcctagggccttgtctccttcctcctgtccatgcatgcaaatcatgttctgttctgttcgccattgacgatcgatttatcgagagggccaccaagcttctttatcttttttccaagctcgtgcctttcaacgaaagttcagagaacacgatcagtggagcgaaaacaactctcccactctgaccaatcatcggaaaagttcatttttttgatacattaaaaaaaaactagcttaatgatggctttatgatcttatgaaagttactctgaaacctgaaagggggtttgattcctatgtatctatgattgccactgattagctttcgattctttgcttttgtggctgtgtctgaaaagtgttgcaaagatatatcttccaaagctagtagcttcagaaaacacatgacaacgaaggttttttgtttaaaaaaaagttgcaaattgcgatgagccaaactaactttctaagagaaattaaatgaagagccaaaattgagctgaaactaatgaggattccgtagtgaactgtacaccattagtccattacacctaccgctcattcaaagttgcagagacaagaaacacggcaagagagcttttcgattgcttgcatcagaaaccggaggtaggtgtggtcaaccccatattgacaggaagattgttgctccctccgtcccataatttaagggattttaagtttttcttatactgtatgaacactcgtcttattcaaaaaaattagaaatattatttattttttgacttactttattatcaaaagtactttaagcacaacctttcgtttttttatatttgtataaattttttgaataaaacgagtggtcaaacagtgcaagcaaaaacttaaaatcccttatattatgggacggagtgataagtagaaagtaaagtgaccattagttcggtaaaaaaaatgaaactattaatgatttaaagttcagtaaaaaaatgaaccattaatgaattgacagtagagtacgagtagaaaaggtaagggcatccaatcatccacgtgcttgtgcagttagtgcgttgatccataatatcaaagactacagtagtacctgaactgtcccaaatatcataccagtagaagatctgctctcttttttttctttgtaaagatttcttgtatcggtccatgctattctagatgtagattttggtacatgcttgagctgctcgtgattaatgctgaaaaatgtttgttgtaacaatgtacaagttacttaaacctatattggccttagttttgaaatcacaattaaatacggaaatgtctaggataaccgggttttggtgtatatatgcagagcatgaattcattttacaatcaaagtatattgccaataaaatcctatttattttactataaccaaaattattacttcgttcgattccaaataaattgttggttttgactttgagttgtcgaccaatagtatttgaataatctaaatatctagcatcaaaattgtataattagacggggttgtttagattgcaaccaaaataaaccttactaaattttagcaatgccaaaattttggtaatattgccaaaattttggtaggatttcttatatatttatcaaagtttgacaagaaactaaatggatacacatatttgataactttactctaaaaaaaatggtatggtttgaaatgacatcaatctaaacaagcacgtaatctaaagtactttagtaatatcttatatacaaatctatttactcttaaattgcttaaaacataaaagttaaattgcatctatttgggtcaaagccaataattatcacaatccttcaacatcaacaaggctagtacttaatcaattatatctcatatgaactatataatgatattgaatcatgtaagaaacctatcgattctccaccatcgtcaacgtcaggtcccaactgcctctcaacacaactgcagaaatgacaggttcgttcactggcacacaactgcagaagtgagctggagtacacatttctgctgtgacctggtctctatgcgatgctgaaaggaagcaaagaggcaatgcaatgcatctgcatgcattgggattggacttgggagtagtcggagatgagccactgagacagccaggttgcctccgttcgaacgttccgttaagactgcttcttgcctttccaaaatcagctgtaacactttgcaactgtagtgccattatgcttaatgctttccagcatattgtgtctttgttctctttgctcttttttttttaatcttctgaaatgtgtttcatgcggtgtgttatacggctttttttagtgatggataaaccccggccgctgtgtcagaatgtggtcttgttcctaggttcagagcattccactgcacaattatggataagggctcctttgggtgtgtttagttcacaccaaaattagaagtttggttgaaattggaacgatgtgacggaaaagttgaaagtgtgtgtgtagaaaagttttgatgtgataaaaaagttggaagtttgaagaaaaattttgaaactaaaaatttatttataggagtggcaaagaattttgttaggatttaaatttatatggtttttttccctaaatgtttctttggttcatagaaaatgaacgaaactttatatacgattgtattcctatgcttaacatttcataggaaaattatcgagatgtgtgatttttttaataaatttttctttgtttcttccatggtaccaacaaagggctcttatatatcattccctatgttctggattctggtaggattcgagaaccatacgacttcgattttcgtgttgttcaaatcctgcgaatcaaggggcctaaatgatggctgtgaactttgctttgttattgttcctaaaatattatagtgcgatgatgcaatacaagccgtttttttgacaaattgacccttttcaaaaacttatttcgaaactaacccctgccaaaaacttcaaccaaaaataggccgtcgcctcagcgccaaacacattggcgctgacgttggccgtgttagcgccaacgggactggcgctgacattgtgccaccgtggcggccggggccgatccccagctgacgtggcagctacctcagcgccaaccggactggcgctgaggtgggacttggccgccaaggcccagaccagcaagccttctggatggcttgcaggctgggacctcagcgccagccaaaatggcgctgaccttgggaaactcagcgcaagccaacctggcgctgaggtgggacttggccgtttcggccttggcccagaccagcaagccttctggatggcttgcgggctgggacctcagcgtcagcaaaaatggcgctgaccttgggaaactcagcgccagtcaacctggcgctgaggtgggacttggccgtttcggccttggcccagaccagcaagccttctggatggcttgcgggctaggacctcagcgccagccataatggcgctgactgtgggaaactcagcgccagtcaacctggcgctgaggtgggacttggccgtttcggccttggcccagcccagcaagccttctggatggcttgcgggctaggacctcagcgccagccataatggcgctgactgtgggaaactcagcgccagtcaacctggcgctgaggtggtacttggccgtttcggccgtggcccagcccagcaagccttctggatggcttgcgggctaggacctcagcgccagccataatggcgctgactgtgggaaactcagcgccagtcaacctcagagtcagggaacagaatactgccgaagatgtacagcacgtacgccctacagtatcgctgtactgtagcctcatctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggatgtaccggtcgtcgaacagtatgtgggccgtgtgacctcttactcgaagggtcttcaagcgctgcatcaatag

SEQ ID NO: 74867 - DNA, 20212 bp, Oryza sativa
ctcgccgggcggatcacgctccctcatcattggtatcaggggcggagacgcgagcggtgagcctccccgccgttgggagagatcttcacttgccaaactcaattctcagcatgtcgtggaggcggctggagctcgccgcgctctgcgcctacgcgctggggttctacctcgtcgtgatccggaagtcgcttcgcctctctcatggtatccaatcgtctcagattccaaaatcttccattgctgttaattttggaactgcttcgcatcacattatcgcttggtttgtgcagattactctgggaggttgtacggcctacgagcaggctcactcgctggccatctgaacgtgtgttaaattcctcccattcctttatcagtgttctagttttatctgaagattgaggagctacgcatctgatttccttgcattctgtcgttgcaggacttgtccgatgcacaatggagaaatttccgggggaacttacctgttcttaccattgtgatgggtgcatttctgatgttggcgaatatgcttcgctactgctacagcttgaagggaagaggggcctctttggtgtggcttctcctgtctgtcacctatttatgctatctacatggtgcttggtaggaaactgaccaatgcttttcgcttgttcttctccaatatttgtaaagtttctgacatatctatctctatggcagtgttagtttcattctcctaatagcattgattaactactccatagtgaaggtcagtgctagcatctttgatcaaaactactgttgatttcagttgtcttagtcgttgtttttctgttttccttttttttttgcataaatatatagataggcaatgccacaaacaaaagtacatggagcaaaacagaatgcttttttgttcatattcttgttataggtattagaggtagcatatttgtcaatcgagcatatgtttgtggatgtgcacaatgtatgtgtatgtttaacggatgcaactttctcaacgtgatatagaaaactgaagactactccacaggtgcatatgatatcaagcacataaaagataagaaacatagtacacatcaactaaagaagagacactgtgataacaggaatgccagatcaatggattttttaagtcattattcaagggaaaactaagactctatgttggtaaaattcatttgggatgaattttcggtttatgtattgattccaaatgtttcattcatcaactagaactggtcaacacaactattacaatattgttggactgagtggttaaacatctagtcaggttggttgaaaatggtgtcctcagttaaggaattcaagttaacatgctgtttattatgtgattattgtcaacctgtaagtggtaccttagttgtaagcaatcattccgactgtagtgttgacatcactgttcgattttctctgttctaattgattatgggtttaagttttgcttttgaccatagtattctctcttgcagctattttctcgatataaatattgtgttgggctcatttggagcttcaacttagctgtccttatacttaaccgagtctatgaaggctattcattctcattgtttgggtgagctgttctgaagctgctctatctgtatgatgcaattcctttcagtgaggttccttttctttttaatttttgtgacgtttgattttcttatcgaaataggcaacagcttgcttttctagacaatcatcggggtacatttcggtggcacatttgcttcaattttggtatagttctccttttgtcatcttgatttggttgaaatcatgtttatacgaatagcttttgatgtttactatgtagaaatctataaacgtgttctccttatgccccatttgatttgtctggcagttgtattacgaatgataagctttggatgcgattactgctggtcactccggtcttctcagtttgatcataaggtattatatttcctgatgacttgtctttttgtaccacattatctgtacttcattattggaacatcagatgctttaaatcacagaaacatagttttaaaagcacacattacatccctgttggtccataagatctgacactcttaacaaatctgatcttgtgttttcttattcatcttggtacattttcaaaacaatatgtctacttgtcttgttttaaatgttattggataaattataaagttatatctgatatatgttgtgtacctcatgggaaactgataagtttatgaacaactcttgtagagatctgtacctgtaaattagtaaatttatttttgaccatacctctgtcttgtcagtactgcactgtactgaaatgagttgccttggtacagaagcatatgcagcgatgccaagtttgttattctggcaaaacatgctactttgctttgcaggtacttatattttcatacttcccttgtcccaataaaaatactgttgttgatagtgctgctctaatgtggtactgattcatggtagtgtcttacagccattgttggttttaccattttggaagcattacgacggtatccctttagtttccagcaaaataagtgttgacacagcacagaatgaaactagtggttttgttgaaagatgttgataattactaagcgtaaatgaatggttaacatttctgctgataccaggttgaactgttctgagttgttagttgcaatataaatattttctgagttacttgtaatgtaggtcttgagtcttgacattagtgtatcttatttacctttgtttatggtattatcatttgaaatttgcagctttgatagtgactcttgtatcctacaagaccttcctttacaaagcatactatattcactcttatatttgttgatagaattttgcattgttcttggcaggagagagcgctcattggtgacaaatacacattactaacatatttatgctacttgacatatgctccactctacatcgctggacctattgtaagctacaatgcatttgcagcccaggttggtctgtttcttatagataatgattcaatgcagctgaatcggttagatgaacttcaagctaaaagcagcagaaataaatattaattttaagaaaatgaaaggaagaaggggagagaactaccatttaaattaaaagatgtcaaaattgaacagaaacaaatattgctttcatgaatgtttctctctatttttcatttacaggtcgtgctttatgaaatgaagatgatatcaaatttgacatgattctttggctatagtagagctaaaacaatactttcataaaagctgaacatgtgacaatgacatcatatattaatgcatttttgacctgtgcgcctgtcaattttatgtacaatgcattgccgtgacttagggatttatttcatgcgaagggttagcgtgggggacttgatcctgatccaaactctgaccttggcttaggtgtagacttaactttgagctaatttctttctttcccttcttatactcattaattgacaagtgacatcctttatgcactgtgaggttctgtaaacaaatcttgactagaaatgaactggtgtatttccaaacaattttttaactaggatagcgagtgattataacaacttgtctctaagttgatgtggttgagggaccagcctttccctacatcaggcactaatctatttttaacgtctaattagatcagggccctttgccactgccatcttagtctaatctacaaaaatagacacaacatttacatccttctttaatatatttggaagtcattaaaaggaatttctgaatggtccttaacaggttaatctattatctgccatagttgttaacaacgaatttcagctctgaaaggtaataatataaaagatattagcaatttatgtgtagtgaacagtaaaagggcactagctattatgaatttgctttccctgtctataaatgagtaatgcctttgtttcttccttttttgttttgcaaaaatatctttgagcttgttataaacgatcttaaatggtactgaccattgggtgactttaggaactatataaggtagtaagttttattagttggatatagtgtagaaatatcttgacaaatactaacctgttcttgttgtagcgatcttgcagttagatgcaccccagaaaaattattcagttgcacaaatatcttggtatggggtgaggtggatcctaagtttccttcttatggaagctatgacacattttttccactacaacgcctttgtagttaggtacatgcttatctttatatagtataatcaatccattctttttttactatattctgattaattattcttttgacagccgattatggcagcaattatcgccatttgagatcttcatcattagttatggggtaagattatgttgtacatactgcattttctagtatatactccggtttttccttcagagttgtcagttatggaatttttcttgcatcattttcaacaatatgtagcagttgatattaccattttattacttattatgtttttattcaagattgaatacaagttttcgtgatctcctgtatgaatacgtgtcctgacttgcaatactgtatatttgtttccaaagttgtctgcctaggttgttttctactttaatgcgttaacttgcatgcttaccatatccacggtcctgttgctattcttaactaacatactgtagcttcttttttcaacttggtataccttgttgttggggttaataatcatcaataagcattgactatcaaaactttcttatgcaggtgctgaactttatgtggttgaaattcttcctgatttggcgctacttcaggttttggtcactggtaatttgaacatttaaaatcaatattgattcatcatgcaccctgcatgctttaccttttgatacaagggaacattgtcaataaaacaactgtgttctcatatccgcactgttttatgtaatgttttttgtgttttatgctgagtgtttcattgcaggtaggaggagttgagacgcctgaaaatatgccaaggtgtataaataattgtcatgatctggagagtttctggaaaagctggcatgcttcttttaacagatggttggtcaggtttgtgttaaagtagctgctttaagtactaatttatgaattcatctgtgctaccatgcatatatttcattttgaagttttggggttaaaactttattctgttcatagcctcacttctttaacatatgctcaagaaacgcatgcaaaaaactgtcatatgtccgcttagacagagtttaggcctatcaacattattacataacccatgcttacacagagttggtatgtgtgcataccaatgtgcatctgtagtcaatccataagtattaatagtcgataaaattaagtttaactttctttgacatatgtctttcttgttgcaggtatctgtacattcctcttgggggtgctcaaagaaaactacttagtatctgggtggtattcacgtttgtagcagtttggcatgacctggaatggtaagttctgtaaaatttataattgttatttttgtttggcaacagctaggttttatgatgacttacgatgtcaatttgattgcattctcataaacaggaaacttatttcatgggcatggttaacatgcttatttttcgtccctgaaatattggtcaagtctctatccaacaagttccaggtaaagttcccttgtgtgatttgataagacttcataacctaaaggataaagcagcatttctttttctgttgttgcattcatttgcttagttgcaagaaacaaacttaagtattttttgtatggaaatttgtgagatggtaaagttgttttactaccatgttaagttactccctttgtttggaaaaataaaccagtctgtacagcttgagtttggaaaggaatactagatacttctaatttaaggtacaaacaagaacaacagcatggcaaccatatatactccaaactaataagtttttgttttctcatgcattgatggattcttcatcatgcttgtttgatgtcgatggaaatttcatatgattagtagctaatgtatttaaaaatgtagccaagaagtgcccttgggttgttcattcaccgggagttaagtgcaattgctggtgctgtgacaataagctgccttatggtacgtcttttttttgggggggtatttgaattcatatttaaatgtattcaaccgattattctcttacttcgctactggtttactacaattaaagattcctggcaccaaatctcctaggaaaaagtatgcatgcaacagcatttgttgtcaacaaagattcttttagagtaattcatatatcattaaatctaggattttcagtcttacactagatgggtcacatccttgttccgcattgatactgatatgctccactcatgcaggtggcaaaccttgtcggttatgttgtaggaccctccggcattaaacttctcatgtcacgaatgcttgggaaggatggtgagttgcgaattcacatccattatttcatagtgaatttcattcagtcatacggcctcttcagctgacgcctgtgtctattttgcagcccttcctgtccttgccttcatatttatctcattctatgtgggagttaaggtgattcctttgctaattactttctttttgacgctacaaaataaaggtgattccttgtctcacagctggtaaacttttgcagcttatgtttcatatacgtgacgcacatgagaatcaagggtgataactgataagtcgacggggaagaactcccactgtaaaatgtagacaagcagctgcgatgagacgctgtcaagactcaagacaaataggcttacctcttcttttatgggatttgtttgacacgaacgaaaagctcctctgaccgccgagctttggctcttctgtaatgtagggcttattgattggggtagtgaagataatagagcacaaatggaaatggtactacgagctctgtttttaagagtggaaatgcagggcacactccattggattgaaggaatttcaattctcagacaattttcctatgagctcttttggaacaaagcaatatcactggcaaaaatcctatggagatttgcttcctatggctcaattccataacagtctaagcatgagctcatacctcacgttttcgttttccttcgagaagtcgtatgcattctcttcctttctttctctagcatctctctcccacaaaacaatttcttctaaaattcatatgttttgttttctacaagccatccacacacaaactcttaaattcctatattttggagcgtataagattttattcctacgttttatttgttcttgtgttttatagaaatcgtactttccaaaggagccataagaggctcgtgttcaaattactcttttaggccttatgaaattcctatcattcccaatggggcatctaggtaaagtaacaatagttcaactggttaggttactggatgaagcatgttcatttttgttcaagctatatacttaatatgggtgtttgtatttatggctttattcttttattggtagaaataaagtgacagaaaaaggagacatctctttcgctctcatcgtttagagatccaaacattaattgaagaaaagggaaaaaaataagtccaagtagaaataggatttaaaatacctgaaatcctctctcaaaagattaaaaagagttttccaatttcaatcttccacatcaatgcttgacaccaaaaagattcaagagcgatgatttgctctatgattgataaaccttcataaatggtagaaaaataaaaaaaaaatcattcttaactacttgaaagccaatgacgaaaatttatcaatgataaaagccttaaaacctagtttaaaattgagttttaaaattcaaattccgatttcaactgataagctaacaagcaaaaggtagagcctaatttagctataaaacaatatcgtaaaatggtactctctccgtttcataatataagactttctagcattgcctatattcatatagatgttaatgaatctagacatgtggacaatgctaaaaagtcttacattatgaaacgggggaagtagtacatactaattggatagttttcgttgaatagcaaatgatttggcaattctgtcttttttggcctttcaaaatacctgtctacagaaaccagaaacaagaactagtgatcactacctctaaaaatacccagatacttagcctttaaacctgatgaaaaatcatgaggccggttcagctactgggcggtttgattcgtacggcaaaagcggctcgggttggctatttaattcttctcgcagatcaagaaattgtggatcagaatcctctacctttttaagtcacgtgactttatcactgacatgtgagccagatagatctagacccacgtgtcaataacaaaggcatggtgaggatagatgatctacatctgaaatggttcgccatcgctaactcagaaaactcaagtcatccccttcgacgagacatcgccgacatcccgtgaggttgccatctgcaggccacgtcagctcgccacgccacgccatgccgtcgcctgcgccaaccttgggagtcgagccgcgtggacagccaagagccgacgccgccgtcctcaagaaaaagcaacctcggcgcatcgtggcaccgcgccgatgtgcaagaatgtcggtcgcgacatcagtacggttagctgctgaggtcatagactccgaggaacgccaacagcaacccaccccattgtggcctgcgggcgccacacgccgccgacgtcttcaagaaacaatagccgcaaactcggcgcgctgtggcaccgcaccggtgtgtaagaacatcgacctcccccgccgaggctttcaactccgaggaacgctgagcgccgccacagccgctgacaggccggcgtgcgccagttaccaccccgctgaggacgctgaactaccattgaatcaaaaaaggacgtttgagattcattcacatcaccatgagtagcatttttactcatggtgatgtgaatgaatctcagacgtccatttttcgatccatcggtagtttataagttttcactgcatatgtggtttgcactatatatttttcccatcttttcttctctatctctatatgaccatgcaaaaatatgtttttaattcttttttgcaatgtgactgacatgtgggtcccactgcaatgcatgtgccatcataccatgtcacatcagcggatgaagggaattagagcctatttgaacctatatgacaccaatgacaagtttgaagaaaaaaaaatacatttttggagtttacagaattacatgacacatccacactagtttttaaataccgtctgtatactttaatctatttttttcatcagtggtcctgttcttttctccaataagagttggatgaagattaaaattttcgtggcacgcttttcaaactgctaaatggtgtgttttgtgcgaaaactttctatatgaaagttgctctaaaatatcatattaatctattttttaagtttgtaatacttaaaaaatcaatcaatcatacgctaataccatctcattttatgtaaaaaaacttaatcttcatctttagaagaaaagaacacaatatatattatcagaaaaactacctaatggcatcccgtggagacggaatagtagtactgccttatctcctcttcccctctctctgtgtctcttcccctccactcgctctctctctctctcttcccctccactcgatctctctgtgactatcacccatgagcacggaggcggcgacggcgacgatggcgacagcaacgacggtgatggcggcaacaacgacgacgatggcggcggtgccgtcaccactagcccccgcggatgacctggacgacagccggcggggctcccgaccaccacgggcgacggctgtcgtcgagaagcctccccatcaatctcctcaagccgctcctcctcttcgtcgttcttgtcgctggcttcctcgccgttgccgccctcctcttccttggcggtgctagcgcctcctacggtcggggagcggtggacgcggccaccgggggcgagcgcttgcacaacatgagcgacgaggagctgctctaggcggcgtcgatggagccacgatttcggcggtttggagcgaggcacgacgacgagcgacggaatggcacaaggtaggcaccagatctatcgcctcctcttcctcttcctcttcctccgccgccgccccgctgctcgacctccccgacccgcgactcctcctcctcctcctcctctctcttgggatatcacgctgatacccaggtaccaaggcatgatacctaggtaccagctcgatacccagggtaccaggtatcagtcgataccaaggtatcaaggcctgatacccaggtaccaagccctgatacctaggtatcagctcgatatccagggtaccaggtatcagtcaatacccaggtaccaaggcctgatacctaggtatcagctcgatacccaaggtactaggtatcagtcgataccagggtaccagctaataccagtgtattagataccacctcgataccttacccaaggtaccagggaggattggataaggtggaatcacatgatagcgtgggtctccccacgaaattgacgatgcatattaaatctctcaggattttagttgtcccgtgactaacaagagtaacggaatcccgtggggtagcagccctcatatattattctgtctggggaagctatgtgagaaaaatttataacttcgcaagccacctaatatgcaccactccactagtttttacaaaaccagctaatttcgagctgcaccacctccgggttgaccaacccagccgcccgccaatggcgaccgccgccgccgacgagctcgcgctgcggcggctggacgacgccacccgcgacgcccggaggcttcagctcgagaccctccgcgccatcctcgccgagaatgccggcgccgcctacctccgccggtacatcccctccgacggcggcgcccaccacctcctccgctccaccgacctcgccgcggcggccgacgaattccgcctcctcgtccccgtcacctcctacgacgactacgccgagtccatccgccgcgtcgcggatggcgacgctgcccccgacgagctctcgccgcgccccctcctctgcttcttcctcaggtgatccacctctcctcctttccactcttcacttccatcagaatttctccaccaatccatggctgatccgatcgacgtgcagctctgggacgagctcgctgcggccgaagctgataccctacttggattcgccgggggcgagggccgccaccgccgccgtgatgcaggccaactccgccctcgtcagaaggtgttcgacgccgacctcctcagccttcaccatgtttcacactgatcagggctctgatctgatctgattctttcaggctgttccctccacggccggcggtgagcaaggcgctgtggttcttgtacgccggcgaggtcaggaagacgaagggtggatacgaggccatggcggcgacggcgtggggcatccggagcagcggcatccggggagcctcgccggtgatgtccgcctgcgtcagccccgccgaggtcatcctcggcgccgaccaccagcagcagatgtactgccacctcctctgcggcctccgccgatgggacgccgtcgactgcatccgcgcgccgtacgccgccgccctggcgcgcgccctccgcctcctccagtccaagtggcgtcaactctgcgatgacctcgagtgcgggacagtctgcgccgacgtcgtcaccgacgcggcgatgagaggcgccgtccaggacggagtgctcgccgggccatgccccgagctcgccggccgcgtccgccgaatctgcgagagggatgactggcgcggcgtgctgcgccaactgtggccggacgcgaggtacatctcctgcgtcacgacggggaccatggagcagtacttcccggcgatcaagcacttcgccggcgaggcgttgccggtgctcggaacggactacctcgcctccgagtgcgccatcggcatcaacctggagcgcacgtcgccgcctgaggaaaccacctacgtgctcctccccagggcggcatacttcgagttcatcccgttcgacatggacgccgccggccgcggcgccgccgcggcagagccggtggacatcgccggcgtggaggccggcaagacgtacgagttggtggccaccacgttccgtgggctgtaccggtacaaagtcggcgacgtcgtgaagatcgccggcttccaccactcctcccctcggcttcagttcgtgacccgcgcgccgccgccgcaagaacacggcgaggtgctcaccgagagggacgtcatggccgccatggacaccttccagctcatgctaaaggacggcggcgaggttatcgaatttgcggcgttcatcattgacggcgacggaggccagcggcggcggcgatgcgcgacgatcgccgtcgaggtgagcaatggaagcaagctgctcgaccatgagaggtcagccgccttcctcaggcgatgcaccgcgccgctcgagggctgcctcggcggagcgtacaggctgagcagagccaccggcgacgtcgcgccgctggaggtcgccgtggtgaggcccggcacgttcgacaggctcgccgaggccgcgatccgcggcggcgctccggcgaaccagtacaagccgcccaagatcgtcaggcaccggcacctcgtcgatgtgctgcaatcctccgtggtgtgcagcagcagctcaatcactgaaccagctgctcactagcatctgtctcattgtgtcactgaaccagcggcagtttcttgatcgtgagtccaattccggcactgacaaggtgttcatctccgattcgattctgaattttcagcactggggaggtttcagtctccgattcgatctacaagaagaatccctcaccctttataaggatcacccaagctagagggaatcgtcggtcggttgctctcgtttggtcagcgctgatttcagaaattcagacttgcgtccccgcaaaaaaaaaaaaaaagaaaagaaattcagacttgtgcagttcagaagcagaagagatggaagctgcatcatcatcgggagctctgccattgccgttgccattgctcgtccatgatcttggaacccgtagcgatgactcgcagacgcaattcagcatctgcaaccaagcactcagcactgcagccatcgagctactgagagatttcaggtgcttcgagactccacaaggctgggtactcactctgaatcctgcgtcactgcaaaccttcctatggcgacctcaggacagcaagaagatcgatctcccaacggcgaaacagaacttccctagaagcggcaagtgcctcctctccggcaacccaatctcgtcgtcgtcagattgcgccgtgttggtactagatcttgacaccccagcgatgctagtctgcaagatcggaggcagtgaatgggattctttcagctacgagctctccatggtcagcaagaacaacaagaccctggaggttcacatggccaagcttcagggcatcgatgctgttgccggcaaggtgtactacacattctcaggagacgctctcggagtaatcgagttcagcctggaggtaaaactctctaccatggatgtcgacatggttgaattgcctgccagtatgccaaacttctcgacagtcatgcggcgagctgtttcttgtggtcgtcttcttcctcggccacaacctgcacaggatcgcggaggtggcggtgtacaagatggatttctcggggccatcagagtggtgcaaggtggacgggatcggtgacagtgtgtttcttctcggtggagatttcatcggagcttctaattttggagcgtcgtgctcggctagtgaccatggtttgtccgggaattgcatcaattttgtgaacaatattgccgctgaggagaattttgttcatgtcatcgacttggagaaagggactgaagaagtgcttcggcctttcagacacaaaggatacccgctgccgctgcgtccacccttctggctattaaccacccatgattgatatcttttccttgtagaatttgcacctcacttgtcatatttgttaaagtaggtttacagttaaatttgtcatttttgttacgaattatagaaatcgaatttaaatttatgtctgtggagttatatattttatataaatctattttattttttttaagaaaataataactatgtagttggcaatttggcatacaaggaaaaaaaaacaatttcacctcctaagtaacaacaaaaattcgtaccatagggacatagggtcactgacattgaacaacaatataaaagtttatcttaaatcataattaacaggtgaggatatgtttagtagaacttcaactctcagatctacctaaagctcaaccaaacggttcagcttaaaaaaactagagagctagatggaacgttctgaaaaaatgtactagcgtcgtggtgaagcggggaaaggcagcttaaatttctgaggaaatttctgttgatcagacgagttctgcaacaggagccaaggaaatagtcctcaacaatattcagataaaactagaagactgacagaagagagaacgcatgcaacaacaagtaaatcatctgcgtcgtcacgtcacgggtgcacgtagacgccgacggcgtcgagcagccacccagaccgcgcgaagaagccgacgacgcggccgccgcccttcaccggcacgcggaacgccgcgccgccgacctcctcgccgaacggcccgtgcgtcttcccggcgctggtgacgaacgccagcgacctgacgacgcacgcgtgggggccccacggcccgagcgtcccggagacctccgtgacgcgctccgcctcgccgagcttcaccttgtgcttctccccgccggagccgccccacggcccggcggcgtgcttcgcgccgtcgatggcagcgtaggtgaaggacagcgcgtcgatggcgccgccgctcctgacctcgatgctcaccaggcggtgcggcgccgcgccggcgccgagggcgatgtcctgcgggtcgccgccgtcgccgccccatggaccgatcttggcgagcccctccatctccctcctgcacgacgcggacgaacaccttgcaacacacctatctactcctatatactactcacgtacacagcgcacgaacaccccttggtatctccgaggcgattaatggattgaatttttcagtaaatgcattgaattcaaaccaaatcgtactattggttatcgagcaccagaggccggtttgaatgaattaatgcggaattttgaacggcgccttcagttttcgatgtgacttttgagctgccacgttactccctcattcccaaattaatcatcatataataaatttaaaatttcttaaattgatcatcatataaccgcatagatatggattttatcataatacaattagtacagcatgggagaatgtgtgaatgtgtgcatgctaaggtatactccctccattccataatgatcagcatatttcattgtggcatcaagaccaaggagagatcctctacccgttttctatttaatccttgtaattaatctccatattaatcggcttggagaaacgaaacgacgttactgccgctgcatgattgcacaggcaaggaatgttccatgctgcatgcagctcgaaaatcgcatggcctactcgatctccgtgataactagttaatccatccaacatgcacatgctaccagcgataatatgctgatcaaatcggaatatctccactttcgttatgtgctgattattatggaatggagggagtaattggtatggtgttttaatttatgcatgcactgtgagagaatgtgtacatggtgtcttggttgatgtgatttagacaaattatccttggtctcggtagataaacatactccctctgtccataattatagaggattttggtctttagatttgtctaaaattatggacgactttgcttctcccaataggatgagtacaaccgtcattagtaatcgaactcccatcctttgtagtatgcttatgctaaattaaattattgattggaatccaataaaccattttaatattaattggttgcatgcatgtatatgattcctttcttttgtcacatagtggataagttaattcttcctctatcttgatgaaaaacaagtcttagacatttaaatggaagaagtactatgtttaagcaggtagattataaaaactaaatgtagaaatgaattgttttgtttcacttgatagaaagtaaaacaaacaattttatctctaggtacataatctttccgtcccaaaataaactaatttttagagtttaaattttatctctaaataagctaatttatgtatttttttatatatacctttagtccacaaaatcaataggtttattccttcagtatgtcttgctgcacctacctactccctccataaaaaaaaatcaaactagtattagatggagcctttcctaatacaactaatttgaacatactcatatctaaattcattgtactagaaaatatctcgtccgatattaggttagccattttgggacaaatggagtacgtactaatgctatacttgtacttcaaccatttcaaaatataaggcataatttttttttaagatgtttcataatataaggcatgcgtgcatgcatgtaattaactagcgtctactattaaattttaacctattcattctcaagatctctaattttattgtattaggatgattcaaacaataaggtaataataattattatttttttgtctttaggtaaaaatgtgattatgccttattctttgaaatagaaaaaaaattatattttatgcattgaaaagcgagcagtcgagtctttaatgtgacaaagcaagtacaaataacgaacaccagaacaccagagaatgcaatagaggatcagcaccagcttggctaggttgaatgatagtgcgaggctagctagggtcaacgccaacgccaacgccaacgccaatggttcagggcaggtaattgcactgcaaacatagtactgtactgctcgtttcaaaatgtaataattttcaactataaacttagtcagttgtttgtctaaattcataactataaatgattatattttagaatagagatagtactattttaaccatataatggtcctagaaacataaaactagtgatgttaaactgtatgaatttatagaagagtatagtagatgggcctggtgtgtcattaggtccctgaactcctaaaatgcatttttaggtcccttgctatgtatgtcatataggtccaaacgagttctaacccgttccatgcgctgacgtggcaatgccacggtgacgtctacgtgtcagtggaatccacatgtcaaacatatataaaaattaaaattaaaaaccatattttctcctcttaggtagacagaaaaaagataaaaattataaggtagagaggagaaaatatgtttttctaattatattttattctatgtgactagcacgtgagtccaactaacacgtatacactatcgtggcatgccacgtcagcgcatgaaggggttggagctcgtttggacctatataacacccaaaaaaagtttaaggacccaaaaatacattttgagagtttagggacctaaatgacacacccgtttagacctatatgacaccaaaacaagtttaaggacccaaaaatacattttgagagtttagggatctagatgacacacccgcacaagtttgaggaccgctcgtgcacttcactctttatagaaattaattgtcaaagatataaatttttgacttagaacaaagcttgaacaccaaagtaatttgaaacatagtagttcaaatactagagctgaattacaggctaaaggagggaaaatacttgaaatgcaattaagttttacaagttacagcaatgtcagatagtagtacatagttgcagctcctagctctgcaaagggaacaatgttcctgagaacgaaatactaaagcaatgtccaacattgtgctgtttacatgatccttcttcggatttacttggaaaataaattgaatagcagcatcagtcaggtcagtaaagagtcccttgttttctcagcaagaaaatgttacagtccacttgttgcttccagtttccactatacccccttcgaactgaatcatgtgatgtccaattccatgagatcttgtttgtgtaccagatcattcagaggttgagctatgaagaaatgaagaaacaggcagcctaatccactagggcttgcagtacaattctactgtttttatcatggaaaagcccccaagaaacaatacaagtctgtacagaatgacatgttttaaatgtctaagaatttactacatagaacaataaacccatgctgatgctgtggtaataactagcgttttcgctggtgcgctgcagaaatttaccagtggccactccgaccatcgacggtagcaggcagtttgttcgccacatatggcttcggtggaccggtttggctggaatcgatcctttcaacatcacctgtttcactcttgcaggtctggtttcttctggggtatgagctccccagaggaacactgctgtttggagcaattgctgggttccgaacaacccttcgctgctcatattgttgctcagcagcggatgtcgaacagttaccgtatactcaacaccgaaccaactgctatacacaggtcttgcagcagcacctggaagataggtaacgtgcaaaatctatcttgagtcacacaatgtatgaaagatataatggaggatacaagtttaattgcaggttaaagtcaaatggtaaggacagatgctaaccttgagggattctgcttgcaccgactgaagcagaatcgtgtgattttagattgttgtttatgattaaacacctggaaagatccttagtgacactggatgtgctttgtggccggtaatatgaatagacaacacaaggcctgtcgatacaatagtagatagtcaagaatcaagtatatattcaactggagctacaagttccatcggttaatccatgtcatataaaataaaataaaataaatatcttaccttggtaatgagttatgttgtctctcaggtggagctgctgttgatcccttggcataatgttcttcaaggtatgcaaactgttttttaaaatggtctactgcactgtaaacataatagagtaattgatcttagttctttgaattatctcaagtttttgtcgtgcctaatcgatttcgagcaacaaatagagcaattaaaataagtaatcactacttaatacggtgcatcaacaaaacagtcaattcgcataaatatttgttatttaattgttaacctggacatatagcatgttcaacaacatacaactggcctggcagttcaacaataagatcactaaattgtctcagaaattataataggaacaactcagttgaagattttaaagcaatggaataaaaataaacttggcatgactacacaccttgggtacatgaaaccagtggactcagttccctcaaggaactccctcagcatctttggatgatactccagaatttctctatatatgagttcccttatatcttccttagtaattctccgcctctcgaactcaaactctagctttgtgataggttgagcagaaggctctctatcaacattggctatgttcttgaaataaggatcagcaagcgcctgaaaatgtggctgctacattagctgctgacacttgagataacacaccaaaaaaaaaaaaagatgcaaggttgatgctaatactgacaatacctcctcagcacttggccgatcttttggatcaaaagctaacattctctctaacaaccgcattgcaagtggatctgcatttgggaacttctgtgtaaatggtataggttttttccgcctcatactgttcaagtaacgtcttgccttctcatttctaatctgttgcataagtgaatgtagatataagcattataggatttt

SEQ ID NO: 74868 - DNA, 3792 bp, Oryza sativa
aagaaggaggggggagagagagagaggacagagagggcgaatggtagggggggactcgggatcgcggtattatgagggggggcgcgtttcggtcaggtcggtttgggtttggggttgcgttgcatcgggttcgcccgggtcaaccgcggtggatcgggtggagggagttgggccgtgtacctacacgcggcggcggcccaattttgtactggagatgggccaccggcatttggtgagtccagctacgtctctagatcggcctgtgggtgtactgggacggaaactatctttgttgggttagatgggcttcaatagtcactaggaataagtctattttttgtctatcctatcttgctgagtactgggaccgaaactatctttcttgggttagatgggcttcaatagtcactaggagtaagtctactttgcgttcatcatctcttgctcctgattgaattgtctccctctatcgtaaaactagatataacgctttccacgtcttgggaaaccggtgcaaatcgatttctatggtggtttttggaaacggtttctaccgacatcacaaattgaccacaattgactcattgagtgagttagcaggggttagtttttccttccttccaattttacgtcggcctataagtacgggaccgaaacaaatattgtcaatgggcttcaatagccgctatgaaggcacattgaggtgaacactaaagcccgttcctccgtcagggcaatttaccactccttccgtttaatactttaagacgtaactttttccttgcaagtctagctagttttagagaaatatagcaacttttataacatcaaaatagtttttcgctacatcaaaaattaaatatattttatactttatttgtctggtgttgaaaatatcactactatgttttctataattcggtcatacttaacattgattaagaacaaagttaaagtcttataatatataacggatggagtaattatcatcgcaaaaaatcacgtcaattagacctagactttaacatagtaccattttttacaggcaacggtgttttgtatttttttttattgcgatacttttaaattttctctactcctaataattatatgtctggttactcacccaccttacaatgctcgtattatttgcttcttagcagtgtaaactaatgttgcttcttatgagtttcaccgtctttaccactacaccagtccttcgtcctaatagtcatctccaccacgttggtattgtttacaccaatattatcccctacaaccattaccccacacccctagaagcaatctcaaccttaccgaccccatttcgcctacctttccctaggagatccattactggcttcttacatattcatcacgctgtcattaatcgcttgcctaaactagcggaataatcggttcccaatctcctattgatatctttgaccttataagttatttgccatcaccattaataacttggaggtaaaggataccttacaatagttagttgttttcaaattgagatttgcttagacattccctaaacatataggctgcgttcgatactccaacaagaattggatgaaattttgaatactcgtaacatgtttttcaaactgctaaacggtgtattttcgtgtgaaaactttacatatgaaagttgctctaaaatatcggattaatcaaattttcaagtttgtaataattaaaactcaattaatcacatgttattaccacctcattttacgtgaagcacttaatctttatctttatcttaatcttcatcttcatcttcaggagattcaaacagccattcccgtcgcatatgagattaagatcataggtttgcctcaagttacaaccgataaatctaacgcctctttgggggaaaaaactgcatatggtacatgaaaagatatatgttcttttatttattttgctcactccttcgctttccgaaatgccttcgtcagtaaaaaggggaaacaatgccttgagcgcccggcgtgcaacggtgtttgtgaacttcactctacggcttcaaatccggcgttttccacacaacaccctgtgtgatctgacggcatccaacgttttccattcggctggatgaaaacgaactggtcagttcatcctgacagatacatttgcaccaatcgatgcctgggtcactcaagtctctcttcagattaagtaccttcgaagattgccaactcggttgcttctcatatatcctttcgatgttgttcacacgtattccttgcccatgtcaccaaaatctcaaaacaattcgaattagtgtacataataactgcagtttatctaacaaaaaatgcaactagatttcataactgtacatgtacttcgctatcaacaaacagtgcacgcttcggttcttgtctgttggaatagagaaatcagaactgcagaaagccaatcggtttgcactaacctgggctacatgattttccaagtcagcacttagtatatactgttaatataaccgggtcaagatggcacgaggcggctgcattgatcagcaatacagtgaccgttgagatgattgttttttttaataaaaaaaacagatatagttattaagatgataatttcatccttacaagaaactgtctaaccaatcgggatttcgtgagctgagaagttgctgcactgatttaaacaaattgagtctacatcttcgagtcatgaacaagcaaacagcatagaccaaaaaactcacaggaaactataacccatatggatcactatcaaaatctccctgctaataaatttcatgcttatcatagggataatgtgccttcgtgttaagtagccaggcacgtacatgtgtgtcgatctccttaattaattgccacatttcaatcgaaacaagctactattctcttcaagcaactaacctccaaattcatcatggatttctttacacccaagtggcctataaaatcacgagaattcgatcagcttagaaccatttaaaaggaggaggtagccaatggaagaaggcatcaaggaggagacgaaggcagcagcagcagcgagctcaggtcagacgacggcggcggcggcgacgagcaagagcaacagcaccaccgtgggcgacatggcggacacgacgttcaagagcatcggcgacgtgctgaagctgctgccgacggcgacggtgatcgtgtacgaggtgctgaccccgatcgtcaccaacaccggcgactgccacgtggcgaacaaggtcgtcacgccggtgatcctggtgctctgcgccttcttctgcgcgttctcgcagttcacggacagctacgtcggcgccgacggcaaggtgaggtacgggctggtgacggcgagggggctgctgccgttcagcggcggcggcggcgccgacggcggggacgccgccggcagggacttctccaagtacaggctgcggttcggcgacttcgtccacgccttcttctccgtggcggtgttcgccgcggtggcgctgctcgccgacgccaacacggtgtcgtgcttctacccgtcgctcaaggaccagcagaagaaggtggtcatggcgctccccgtcgtcgtcggcgcgctcgccagcgtcgtcttcgtcgtgttcccgtccacccgccacgggatcggctacccgccggcgaagcccgccacggcgtcgctggcgtcgctgtaggcggcgagcccgattagtcgatttgcattgccatgcaggcatgtgcttcctttttatgggttgtgtttttttaaatatttgcacgtgtgcatatgtgttct

SEQ ID NO: 74869 - DNA, 6353 bp, Oryza sativa
  unsure (1)..(6353): unsure at all n locations
agtcgatttcagtgagaggaggaaaaggcataaatctctagtgaacattgcagatgatgccagcattccaatgtggacaccagaaaaagtaagggctggggtttcttcatatagcaaggatgagaatgaagacgatgccgaagatgaatccacacaagtgttttgcaggggggcagttttacatggaagacccttagaaggaaaaggtcaagccacttctccaattcctcagattcaaaagggcgctcggcattctaatcttgggattcaggaatgttgttgccctgatgcatttgtttgaatcctctcctttgagaaaggagtgctcctggatagaaattaacagggggtatttagggtacatttaagcttacaaattttaggattagtggtattgtatggatttcttggtattaaattgtgtccatcagaactaaaacatcgtagttggctttctggtataaagtagatgtactgttcgtctcgccgtgatatatccagtggcagagtggctttctggtgtgaagaattatactgttggtcgtgttttgggagtggtgtttattggtaatctatcgagcgatcggtgttaatctagctaggtttctgcaatggatcatatccatggttgtgcgctctgtgcggccggatgatcgcattaaatattcatcatttttgcgcgagcaatttatacatacgatgaaaccaggaaagttaaataaatttggactataaggtgctccctctacattctggactgaggatatcaaagcaagtttatttgtttatcctatatgaatgtgacatctttctggtttgaaaatcgttggcactctacacgtcctggtgcctaactgcctatgtctaatgcatggaatttagaaatgtcaatagaattattggcattagtttcttgatgattatgttcaagagatacacttacaaataagatataaatgatagtctgtatttatatagttggaaaaaaattagcatcttcaattgaggtgctaaatttggctctccaaatcttcgttccgccgttctcaccaaaatattgttttttttttggtccactccaacagactcttttacgttaattggatttgcatgtcaacttgcatattagcgggacttgtacatgagaggaagggaaagagagagtatgggtagggaaacaaaaatagaatggtcagggtggctaaatttgggcactaaaaaaattgttgttgtttttgtcatgttggctaatactccctctctccgtactcgtaaagtaagtcgttttggacagccacacggtctccaaaactcaaatttgacttcttgtttctataaaaatatttattgaaaagtgatatatgtatatttttatgaaagtatttttcaagacaaatctattcatataatttttacatttccaaactcaacagcttgagagttattcatgattttatattttcaaggtttgacttaaacattgtcctaaacgactttctttacgagtacgaagggagtatttcttaagatagagtgagacggcttgaagcatttattacattcaaataagtaggcacaaaaagtatcttcgatattttgcctactcgaaaattaccgcacatcttaaataaatataaatacagagtaataatttagagggatagatagtgagagggagaagaaattaaaattttactgccccgtttcagactatagttgtttagattttagtcaaaatcaaattgctctaaatttaattaactttgtagacaaattcagtaatataatatttacgacaccaaattaatttcattaaatctataaaatatattttgagtaacttgcatattgggtctatattttttacttggactagaggcaatctaacctttccactatgaaccacctaattttacaatcgatttcagtttggacctccgtttcctcaagcttcctctccctccccacttctccatgttgcaggaacatcaccggtgaaagaccctatccggcaccaccgctgcactcagcatcatccctcacaacctccattcttgacatcgagcctccgtagcaccgacgcggcgttcgacctcaagtcctattggtatcggcgctggcgcaataacatccgtcagccaagctagcaccacctgtgtgccccatggctttggtccttgtcttgagctcgagctccaccggtcggcaccatgctacacctcgagctccgccagcnnnnnnnnnnnnnnnnnnnnnnnctgtccctgcaatggccaaggccaatggagaatttcttttctgctttctttctgaccgcaagtgaaaatctaggtgggggagatatcgagatgccactcaagcttgcaatgctggggagctccggcgtgagtgctgcagcggcggtggactggtggttgctcaacctactcggcaaacctgctcatggtagggaaagctgaaggtagaagaacatgcccatggtgaaccatttggtaatttttcttggtccaagttgaaaatgtcagcttatctctggtccaaagtgcgatagtggtaaaacaatgtgaccctatgtacaatttactcatatatttttataatgtatttgtcttatgttaaatatattactactctttttataaacttggagtagcttaactttgaccaaagtcaaaacgacttatagagtttgtttgggggagtttctagctgctgcagcttctcccagaatcaaaagctcccccaaacggtgcagcttttggttcagattatgagaagctggagttacagaatctagaaaaataaattgaagccagaagttgagaaacctagttttttcagattctcggaagttggctaacaaacaagtgtttatcataatcttaagctccttcaaacaaccccataatctgaaaatagatagaatatatggctctgaattccattatattgttggaatctactactccactacacgcaaattttggattaactgagatcattatttgtgtattgccctttcactagaagctactgacaggtaggcctcgctcttccatggcctggccccacatgtcaaccacctgtaattcctcctctcctaatgaatcaacccaatggcccacttgtcagtgaccctgttcccatcctaaccgcagaaaccctaactccccacaaagccttcctcccaaaccctccgcctccgccttccccttcccgctctctctctctctcccacgtgagcgcgaggcggcggcggcggcggcgcgaggtgagcggggcaccagcggcggcggaggagatggggaaggcctcgaaggggtcgcggagagggaagaaggcgtggcgcgccaacatcagcaccgacgacatcgaggacttcttcgagaagcagacgcgcgacgcgcacgccggggccgccgccatcccgtccctgccctccgactccctcttcttcgtcgacaagccggcctccgccgcgtccacctcctccgccgccgacgccgccgcggcggatgtcgcccccaaaggtaaaatcacaaggcacgtggggtcgagcgtgtggatgttgctgggtgatagactcccgagtcttctacctcgtggttcgggttgtggtagtagtttcgaatcgacgctaaagtttgtgttcttggaatgcttaatgtgaaaaatcgcttcatatagtcgcgtcaagctggttctatcaccatttatctatatatattgttttgatactgtgaagattagttaaccttcagtttgggacctgaggatatgctctgttacttttaaccgctccttttgatatttaattataaagtggttcatatcagcaatgaattatctcacttgcttcaaagtaggcgcaaagtttctaaatgagttaatgtttattgtgtctattccctcgtaacctctgtgtttcctgctaatgtatcccttggtgtgttggcacttttgtttactggctatagatattcctgtccaaaggaagattgagaagaagagagagaaggttctatatcatgagagtgtattgaagcggaatccatatgtacaaccagtcccgtcttctttaacgacaaagaaggataagaagaagtcaaagaagaaggaatcgaaagagacacaggaagcgaaaattgttcccatggtatcaattgcttttatttgagacaaaatgaatttccttttgttcaagtcccaggttgctaaggtggactcatctgttttacaggaagatgattcaggtgataagatccttgacatctggggtgaagatgttaaaggagatcacaaggctaaaaaggtgttgctatgctccgcattctgttaatctgttttcactttctctatttgtattacaaaaagtcgatttttagaactatgcagtcatatttttcaaaatttacaaatctcttctgttgcaatatgctgaatttgtgggttttgtatatcaattttaatttgttagtttctttttttttctttttatcatttttgttgcagaggtctaccgcatctgtgattcctgctgttgaagttgaggccccaggatgttcatttaatcccccattcgaagcacatcaggtatgttttgtaatttatgttccggatttggcaatgttacccatgttttaggaactgatgatccttatattagtggatatcttagcacttatatttaacaacaaaatcctgttgacattgtaggattctcttgctcaagctgttgctgatgagatgcgtaaaatctacacgaaagagttagggcccaaacctgtgccacttattgttcctggtgaagcaatcactgaagaagatgtaagtcttatgcatctctttgccaatagatggttgaaatttctatattctcatgtcttggaaatgttacacgcgctctcaactttttagttactttgcaatgaaaactgcctttttgtgaacttcgttgtgtattatgagttgagtatttttggagttggattccatatacaatgccagtatgttctgtggtatattcatttagaatagcatggcccttcaggccttcaccttactagtggattgtgcttgtgatgtctatgtagcatttttgcgtacaatcttacttataccttttttctgcatgttgcctacagaaattttttcttgatgcggatgatggagatgaagctgttgaagaaggtgatgaagaccaggctgctgatgctttggctgttcagaggttagattcgactgttctattggaagtatagttttaataggttatgcacttatgctgtacgatagacttatgcgtgatgcttaaatttccaaagcttttacatgcttttagggataacatggtcactatgcccttaatatatattttcaaagcttttatgttttaatatatctttttccatttctatatgataataagctaatggggcaaaatatgggttatccctgtttagagtttttatattcctcaattgctatgtggcacttgctaagtaattatattagaattcaggtttactgtatttgtgaaaataaccatgaaagtcacagcttataacttaagaattctggaattaccatgtgctgttcttgatgaacaaaacacactgttctgactcagtaaattttaaatttgtcttgcaaacactattagagtgtacttttgattgtatgatttattattttttcaggaaaactaaaacgaaaagagttacaagagtagaactgaacaaaagagctcgtcgtaaggagaggttaagagcagaagctgaagcaaagaagatggaaaatctttcaaaggaaatagataggtagttctttttatttttgttcactaatctcccaagatctgccatttcagtcaaagttagcttgtattattatattattctttttgcagcctgcctgatataataaatgaaattgctaaagaagatgaggaaaaggagaaaaggcacataaggcgaactgtggctaaacaggaaagactgaagtcagccccgcctcgtctgggcagacacaagtacacctctaaaatcacctactctaagtcactcatattttcttacagcaattcctttaatcttggataaaattgctacactgttttaaagattctgcaaattaacaaaatagtttagtttgcatatttcacatataatgatgccatagtatatcatggagacatttaagttagtaggcaagatgtttcatggacactcaagtagaacaataattttagaataccgtgatgtagtagtcgtattctttttggaagtgaggcagttgagtactccctccgtttcatattagaagactttctagcatttgcctacattcatata

SEQ ID NO: 74870 - DNA, 3889 bp, Oryza sativa
atccccgcgcgcgcgaggcggacggcggaggcggcggcggcggcggctcctctcgtgcgcgagacggacggcgacggcggcggcggatccccacgcgcgcgaggcggacggctgaggcggcggcggcggctcctctcgcgcgtgaggcggacggcgacagcggcggaggcttctcgcgcgcgcgaggcggatggcgatggcggcggcggatccccgcgcgcgcgaggcggatggcgattcccatgcgcgaggcggacggcggaggcggtagcggcggaggagacgaagatggtggcgttgagtggcgacctcggcagcgtcgacgacggcgtcggtaacggacgacgacgaggcgtcctcggcagcagagggcaaccggtggcggtttcgacagcagacaacggggcgccggcaacggacgacgacgcggcggcctttgcagcgaacggaggtgggcctgataggggacgacaacggtggagggggcggcgctggcggagaggtgccggcgcgttgggcagtggagaagcggaggaggaatcgcggcagagagagagtgcgggatgggatgggagggggaaaaggcgtgggacccacgtttggctaggctattttggccggccaaagttggccggcgcgagtagtattttggccagccagccggctggccaggctgttggagcacgattttgatctaaaattgctaaaattttgcttggagagtgaagtaagggggctgttggagatgctcttattgtcttttcctttccaattgactctcatcagttctattctcccttttatttactagatgccctttgatgggtataattcggttgtgtgtgtgtcaagtttatctacttattctgttctatctattttgagcaactttagtttaccttgtggaaatttctatgcagtataaagaattaaagaaaggacacataaaatgtgagcttgagagagtatgaagttacctcccagaaaaatatacagtgcaaaatttccatatgttaagttcgtggtatagaaaatatggaagcattctcacctcatataaagggcgccgcatatatgtatttatatcagttggaaattgtgaaagacacctggactttacattatatttgctaatcgaactgaacatatcaaatcaatttgcaagcataatataaattctgaagcctcgagtaaagaacataagagacattgctgggactttaccatgtcagtcaactttagcctgagatatgtccgtcaaaccatacgaaggcggtgaccagatgtgttgcacatttaggagacttgacaaaaatggctaaaactctatgacattccaaatgttctaaacccatactcatgtgaagctagttctcaagatgcgcactagctccacactttcatcttaagcaataatacacaaagcaaataaacctaagacaaataaaattcagattacatcaactttaaatacacataggccgacaggccaaataatctgagattcgcggaagcttagctacccagaccacaagcaaaccgactagggataaactcctaattgaatcaagtcctagaagaaacagtcgaagccggcaccattcaaatttatctaagcatttaacctgcaaagatggatattccagtataacaagagttagtacattattaaaaataatgtattggcaggccaatatcaatcctaacatgctacatgtaaggcatatattcaaaggagggaaatatgtagttcaattttagcataaagcaagttttgattcacaattcttttgtaaaaagttgatgattcaattaacaaaacaaatttgtaaatttatcatatatataacatcatatcatcttaagcatacccttgttgccttccttggcaacaagtcatataatcatcatcacactcatacaactcaacacaaatcatccatttcaaattgcggtttcataaacataatttaaaacaatgagtctatactcatgtgaccgtgagcacgactaatcgattagtttttgaactctgcacagtttgtacagctttacccacatgatgtgaatcactctggtttgtccggtacctgtcagtactaccacactctacatattgaatgtggtctagaggttacaacgtagcctttaaattacctaatgcctagccttgcatcatcgatggcaagtgtggctccatcctaggcatatgacctagaatcattaggtggcaggcccacgccttcaaccaaactccgtggcaacgaacatatccgttcccccacgaggcactatactgttgaattggatagactgagacgcccatgccgtgaggaaggacaaatccgtccactcacgtaacacacacgtagggaatcatcctacaatcaaacagacacacatgagtagttcctatgaatcatcgctaagactaattcattctatttcggccttcatatgcaagactagacattaaataacttaattagccaagggcataccataattagcacatgtagatatacggttaactttaagttggtgacacaagttcagtcgttgggcaaacactcccccctatcagtgtgcaactaccaccatatgcacaccacttgccgcccaagtctaaaacctcattttcacacctttagttcacaaataagtaaatatttccaaatctgtccagcagtgaaattatgcccaaaatttcacttaaaaagttttcataatgtgatttggcatattctaagcatggctaagcatatagtagcatattaagcatttatagtcccaaatgagcacaagtgatgtactctaaccattcctaagtatacaaatggagaggtgtacaataattcaaaggagtttatgcaacaagttatggataactaccatttcccaagttttcaaatattggtttaagaaaatataaatgcaattttgcaaacaacacttttcatctcccaaaacatgggtttcaatgtgatcaaagagaaggggaggaagaacttgccttaatcttgagaaactagatagcatttaattcactccttcaccgaaaaaaacaataatctatacaaataacaccgtatgcaaataaataccgaaatctgctaaaaatacaaaatgctctaaaatgcgtgagtttgctaccatgaataggtgctgtgtggataggatttgtggtgaaagaatttctagtttatctattcacatttgtgagttattaattttcaaaatgtaatattaacaattgggtaattaaactctattagtacttaggtgcatcttaggtccatgatttgtgatgcgttcagttgctgcagtgaagtataggttctcaggagtacaacaaaattggtttcacaatatttaggattaacatgatttttcctttgaattttataagtaggatatcacattataggtttcggtagctatactgattcttagacatgtctgggtactgtaagggccatattttattgtataacaattaagctcatgatttttccaatctaacaaatctagaaccacctcatttggagttggaataaattttatatgattttttagaagtttttatactattcttttgcattaatcctttattcaaattttaatgatgttttggttatggtttcatctagagattagtctacagatctaaagtgcatacttttgtgaaactaactaattttagttttgcccattttgagttaaaatgaattacttatggattttgtagtttctaatttgcattatactagttattttactaaataaacatttggtgatgtttttattacaggatgttgcaagttttagttcatgataattaagaatatggttttgtgagcacactggaactttattcactcaaaataag

SEQ ID NO: 74871 - DNA, 18865 bp, Oryza sativa
tgttggaaaaagcactcgcgctcacgaatctgtaaaacaacaataccgatttttctgacccccttaatttgaaaacccaaaaaaaaaaagcacatcaactccaaattgaatggatccaactaaaaataaacagccacagcaagaacaagatggatcagccaaaaataaaacacacagcttcaactcaccgagatctcgaaccaagaagacgagctccgaccacacagccgctagcaaatcgaagaagaaatcagcagcagcagcacaggtagaaacaactcctaggagatcccaagaaccatcagagatgtggatctcctctctctctcctccggggaaagtgagcaagaaaggcaggatcttttaaggcagcagcagtccagcaagaacaagaaaagagagccgcacagctcactgatcctcacgcgcacaaggcaaaaagaaagggaagggaagaacaagctagctagctggaagagacctggaagaagaggaggatgcggccaagaaatccagctgtgatctaggcaaagctcatggaggagagaggagaggagaggaggtggtagctggggagtcgagactggagagagagatcgttgtggcctctgcttttccgattgattgatttatgctggtaattgcaggttgatttcgctttcgtttcttggaaaaaaaatttttctcttggtgttgtttggtctggaggtgagagagctcccactagaataagggattggagcacatggagccatctggtttctgacgttctgtccacatcttgtgtttcttttgattatttactcttcttttttctattatattaaaaaatataaaaagaattggtactctactttgtttttctaaaacaagaaatatgtgatataattattatatatatatatattgaaaaatctaaaaacaaccgttgaataaaaatgaacgtctttgtctatatcattaaaagtaaaatttttacgctaagatttaactatgagttttactacgagaagaaaaggtttatgtttgtaacgtagacaaatcatagccgtttatttttatatctatccttatatatgcggtttgcttgacatatttttccggtttcttaagcaaactaatttaagtgtagaacttaaatttaattttatgagaaactaatttggtgttgtttttctataaatgttgtgacttagggcatgttcatattgtagccaaaataaacattaccaagttttggcaatattgctaaaattttggtaagatttcttatgtattgatcaaatttggcaacaaactaaatgtatttttttttgcaattttggcaactttgccaaaaaatggtatggttgaaaatggtatcaaagtgaacagacccttagaaaacttataattacttataatatgtgacagagagagcaatttggcttaatatatttttacgccgaggcaaaaaataatttattcataacaaaaagtccaaaacgggatgtctttatctactagagaaaatacgcgtaggaataatgagaaaggaccatgtccaggcttcctgtttaaggaaaaatggaagagatgaagcaatatgaatttcaacctttcctgaaaagatataaatttctatcattgctgaggtgtgacagcgtttgtgcagcatatagctatagaaagcatctgctcttcaattatttcccgttcctgtgtactgagaatgtaggcaacggaccgcaaattgaatgaacatttgtgtagcccctatagttcctggcaagaattcaagtgaatttactagtatttacatagagacagctaagctggagtgctggactagttatgcaaggaaatatctttatctattttaacgagtattaagcaatgccctctttttgtttatgtgatcaggcaagtagtaattccatgcttgatcattgttttttttttctaaacatgtatccatgtaaagaccattaaagaataattacacgataatattgttcgtggaaaacctaggacctgttcactttgatgccattttcaatcttaccaaatttttataaagttgcaaaaaaaaagtgggtacatttagtttgctaccaaatttttgtaactatataagaaatccttactaaaattttggcaactatgctaaaattttgtcattggcaaagtttgatatggtttttttggcatcaaaatgaacaggctactaataacgtcatataatccgtcagttttgttttttaacaatattatgggtgtcatttattttgctataacttgtttcattattagagaattttaaacgtttcgttcaaaaaaaaattaaacgtgacttatattttctatattttacactaaattttaaataagatgtatgattaaacattatatatcaaaagttaacagtaccctatattaaaaagagagagatagtatctcacgtatattgatgagatgagatttccagatttgaccgtacacgttctaaacaaacatccttttaagaacggatgagagtatcagaccaaattaatgtttgttggcccatgcacagttgcatactccattatcaactttagaaacaagacaaggaaatatcaaccttccaagttccaagtaaagagtgttttgccaggtaagaaacagcaaaaggttgagtaaccaccctttttcctcttggtttcagttgattgcttgattcagttggatgtccaaaagacaaactgttgtgtacaattataaacaggtcaccaaattctgtgcaaatctgatgtctgaggttaacatgacaaaactggtaatcagatgcaacaattagcagtggacagtgtcagccatctcaggttcacaaggcaatattttccaaagcagtgatccatgaaacatcatcaactaattttgcccacttcagcactaagaaacatgtggagcaaataatatcacttttttttgtagaaatggtactttgaagatactctttcatcaaagcaaacactccacttttaagagacttggacaaagttgagtgggattgcatatgatcctgattgctcactaattataaaaatggctacagatgccattgccagccatgtgctgccaactaaggcaaaagagtcgtccaatttataacgatcaccagtgaactagatttctcttgccgaggacgttaataatcttggttcttgaaggaccctgggttaacaagacaactaaaatgatgacaatctagaaaattaacaattttagaacatgtaccgatggttcattctcctaactgattactgttgactacatataataggatgccacataatttcctctttcacaggaatcagcacatcgggtcaccctcacctccatagttgacccacttagagatcacgacaaaaccaaagaagacttgtttctgatacgtctgtcacagagtttgcatcttcagtggtcacttgctagcatttaccttgtgattcgcatcaaataaggtcgatttgcccactctcaacaaggcccttgatggacttgtaccggaggacatacaaatcatcagcaactaagtccacaacctcctcccctctacgtgaaattagagcaccacagtgttaagtagagcttgaaaaggcgcaacagcaaaaaacaagagaacttcggcacttacatatcatctagctggaatgctcctacgtcactcttggttttgcagaagacaaaggtgtcaagctgaggctctggaactgaacaaggcaaaaaaaaaaaaatcgaatcatatagtttctagaggtcaattacagtattacatcactcaaaaatacatatgtcccacatcagcgtatcttcagaaataggaaggaattttgagcaataaaaggcatgtaaataaacagtctataaataattcccaaatcttcttaaaatagaaaagaaccttttgctggaactttctttactcttttaactaaaagtgcagctcaggttcctgttctagtaaaaagcacatggaatgtatttcagctccaagatacataccatatattaaccagttggaccatcctgatcacactatttcattaaaaaaagttatgcaccggattgttagttactacacactgattaattcctaactgtatgcaacacggctctttggtggattgaagattgcaaccactatacaaggtaaaatatatctgcatggatctttggcacaactgatgatcagtaaaaactggtgattatgttagacaaggaacattatcgcgctgtgtacggttgacatttctcactctgtactccctgaaactgtgtatggttgacattcctgcatactgttgtgtcatgcatttccgtttcaaagaactaactataacagcattttactttctattcatctatgcatgcggataaatagtactaactctaggaggacttaaatattttcagggcaaaccagtaagacaccattttctcgtcagttaactgtatcaaagaatataccactttgttagtaaaaattagcagtcattagtactccctaaaaattataataaaaggattgatatatgcgaagctgattcagttctagaactgtttaaattgagcatatccgagactacaagatgaatgagtatacaaagaggtctttattgcatcctgtggttaaataatgttatttatgagtatgatatgaactcaaattttgggtgcaccaaatttgatacttaaaatttgatcatactccaaatttgatcatgctatctgatcaaatctctgccaaatagtgaccaaaactccaaccaacatctatttggcagagattgatcagatagcatgagaaatgtcgtgttttctgctttgaaatggtgaattttgtactcatcatttgcattaagcagattatgtatcgctcaaaactacaaccaccaaaatagtattgcatcccaaataaacgcactaattataggatcaaaaggaatacccatgtcatcctccgtgctcgacaatgattgcctcgtgacggagtcatacccgtatggaagcttcgacagcactgactgctcgagatgcttctccatcatctccgtacaacttgcaacaaatcaaacccaacaaatgatcatcaaaaccacctgaatccagtcaatcaactaaccagcgtaatcacaacgagtagacggtctagtcgcctgaaaaatacctcttcgcaaatcgctgctcctgctgcgacagccggctcaagagatcttcagacttggagatgtgcatcatgtacttctcaatctacatccatccgtcaaagtaacaggcaatgccaatgccaccagttcagttcagtgatcgatccaatgcgggtggagttacagagaatggaaaattgaatttaaccttttgtaggcggaggcggaggtaggatcggaggaggaagagcgtgcgatcgagatccatctggtagagcgacaccaccaggtcgtcgacgccgctctcgccgaagtcatccagcgtctcctcctgaccaaaatcacatcacatgacagtcgataagaattccggaacaatttgagctagaacacgacgaattgggcacgaatcaagaatcgaagggaaggggaggagagggaaaccgacgaggagctggatctgctcgcggacgcgggagacgaggggagagtcgaagcgaaggatctccggagacgccttctcgttgcgccacgctcgcttgagaagctccacgtcagtgctcgccgccgccgccgccgcggcggccgcggccgagtcgtcgtcttcccaggaggacatctgctttcgctaaaccagtaactggcactctcccggatggtggcctcgccggccagcaaggggcggctacgccgtttgtgtcggtcggtcaggtcgacgcggcggtggcggcggcgtcggcggcgaggtcgccggcgggaggggaggaagcggagcgcgacggcgtggtggtgggggggtggtgggccgagccaaggagatggacgtgtttgggccttggtccatttgcagagtacgcctctctgcagcgaaagcgtatttgatactggacttcctcaaagcctgatgtagctgaccggctggctgagctccaaacatgaccagagcatgaataccaagaacccatcaatggctccatccaaacgacatatttacaaataaaaaatagtttataaataatttttttatatatgtgttgttattgatctaaaggcattggctaaaaataaattacgatgaaaaaaaactaaaatcaactccaaatttaaaattgaaaatttaaatcttggcttataagtataagtataagcggaaagatgaggatgcaagatttttttttttttactaaaacatagagattccattaacctatgtactagttacctccgtactcgaataactgcccatattaactgtaagtctaaaatatctcactttaatgatcatattatatggtgagtgcaatttgtatggttatatttaccacgcaacatactccatttaactgaaaaaaaaaacaaatcctagcacatatatactctctttggaacgctttggaacggagggtgtacttcaataatataacatcttttttaagtttttataatttctttataaaacatttaaagtttaaactagaacaatagtagcgctaagagagtatgtgattatgttgtcaggatagagagtttgaaactttggaaactttggatggctagaaagttagacaaggtaaacccaggttgtcattatcctgatccatattttagtatcttacaatactatgaagccaaaatgatactgatcccacctatgatatcctaattttcataatatctcgatcttactattcatttttcacatgatcctataaaatctgaagtagtatcttggtactacgattctaccaaatattatttaaaataaggtggattgaaaataatgtgaataaatatgctcaagtttacataaaaaccaatttttttttcaaaatcaatattacatgctttaatttatacattttactagaaaaaaatgcccgtgtgttacaaagggtgaatgttcttttaattattattatacggtttagttaagttaaaattcaccgtgagaatttgcttggatttgtttatttttacaaaatcatgagcggcaattaggagtatgatcgtctcaagttagcatgcgagtttttttaaagagatttcttatacgactctctttctatattccaaaagcgaacgtccttaaaatctaactcaaacacggatatggatttccaaaagcgagtgaatttaaaaaccgactcaaacatggatgacgtaccaaagtaccggcaaaaacatcttcagtttttataatagtagacatataaaaataatgtactttccaaatctgatagcatcccgatcctacggtagatttcaatactatgatactacaaatcagaaaacgatcctacctagcatctcgatactgattaccttgggtaaaccatgcaatgttggtttcaatgtttcaatgtttctaaagattagctttggaggagtactttagaaacattgaaaccaaccttcaatattttcaatgttaaaatctctaggataatcataaaacttgaatgatctttaaaaataactccatcaaatatagaattacgatggttgcttatcatagtccttctccagtattaggcaatcgctctttaagatgattttgttgattcttagtgagcttgccatgttgatagccgctgcattgcttgaacttccacttgtattgtaactcaagaaactaaatgatttcctcttgcttcttttcaaaattacctcacgaatcttcgcaacgggacaccattgttaacttcaacaaacgcgagcaatggtctggaataagagaaaaaccgatgattttatcatacccagtaactcagatgataaggaaaaaagcttctcttggatggaagtgacaactaaccacagccaaatgttttcaatacttatcctcctcctacaaaatcaaatagaaaaaaaccagggaaaaatcacgtgacacgtattttcatcaatgcttcccattgtttaccaaatctaaaatcagctaaggtcaagatttcaaagtttttcattgaagtttttttctaagcattgacttttaaatcgctaactatatactcctatatatttacacatttaacaacatattattattgttgttactactttgggcagtgtttagctcctttaaacttccaaaaattccgtcacaccaaatgtttaaacacatgtatagagcattaaaatgtggacgaaagaaactaattgcatagtttgcatgtaaattgagagacggatcttttgatcctaattacgccatgatttgacaatgtgatgctacaataaacatttgctaatgacggattaattaggcttaataaattcgcctcgcaatttataggtggaatctgtaatttgttttgttattagtctatgtttaatactttaaatgtgtatctgtatatttaaaaaaattttggcacacgaactggccttgtgctgcgttcgggaggagggggcacgtaaaacggagcacccattattgcatgatcaattaagtattagctatttttttttcaaaaatggattaatttgattttttaagtaacttttgtatagaaactttttataaaaaacataacgtttagcagtttgaaaaacgtgcacgtggaaaacgagctagatgggttgggaagttgagggagatggtcgaggtggcagtgccaagcaagcagccaagttggcaaccgaaaatatcaaaggcttcccgcgaccaccaaccccaccaccacacacatccatcctcacgacgccctccaccgcttcgcgaatcttcctccccaaccacacgaaaaccaaaaaaaactcaccttcaccctcgccgtcgcggcgccccccaaaaaaattcacccctttttccccacgctccggtggctccacgccgccccgcccgccgccgcgaccacccgttccaccggcgaatccgcggatttaatctcccacagctccccgtgagatcacaaagaccgggcgggcgtgggctgtgggctgggatggtgggcgacctctcctccctcctcgccgccgcctcctccgcctcccccgtcgtcctcgcgccatcaaaggtgcgccgcttttcttgctctctgctaccccggttggggctgattgatgattgggggaattcttggttttgtaggagctccatggcgtgcacttgccgatgccgctccaggggaagaggccgccgctgcagccgcaggacgctgccgtccacatcgaggccgccgccgccgccgccgccgccgccttccaggggcaggtgatggtgcccggccacgcgcatgccggcgctcccgccgccttccaggccttcgctgtgcccgacatggccgcgctcatcgacgtccaaggttcgtgttgcctcttcgattcctcttcttccttcgttaagtgcatgcacaagcacaccgttggctaatttgctagagattttgttgttcaattgaatttggaatttgccagtcgcagctatggatccgaattgtgagattaggcatgctttttttcccctaaagttagagacagtaatttgctttgcagaaaggagtagaaacaaaattctttgcttgttcatgcgcgcgccttggcttgtggtttacaaatgagacctgaagccattgctttacacatcggttgctttcttctgtgtgcttgcacatagtacaagattgtgtagtgagctttgcaatggtcttttctagtaggatggtttttcatggtatgttacacataattcaggtcaagattaaaatttcctactctcactaagtggtttgtcccgttcgattcatgatttaatctgtcaaattttcagttttacaagtgtggattagaattcattttcagttttgcattttatgctgattctaacctcgatgtatctgtgcagcagactctcaccctgactcagttcaacttagccttgggattgccgagcaatgctcaaggcaggagaaaatcctgaaatttctaaggtcagggtccgatgtgaaagaacttgatgtatctttactgactgaacttacggggcatcaaactctgccaatcaacttgggtactcaaccatacatccctgatgataagttatcagctcttccaatcagcatggccagtcaaccatatatccctgacgataagttatctatctatgagtttgaattggatgagccccagcagtatctaccagaaaatcaacttgtcatccctgatcctcttgtggagtttttccagtcccatggttctgcccttaccatagatcaaaacaggagaatcctcttcaatggaaatggagatgatatgagatatttactttcgattgtcttggcattcaatatgtctaaacgagaaataagcagttgcaagacagcatatctagttccatattttgaaaggtaatactgtgaagcatcatgctccttgtagaccttctcattcatcttattcatttgttcattgaggtttaatacttgagtgatatgcaaactccgtggtaaccgtgttctcttgagcactgtaaggtagaccaatgattctaattttgccactcaggctgttttccattagataaaagctgtgttaggcacctatggtcatcttttagctgtattagcaaagatgtcgcattaagatcttccttggtctgctggacatgttgacaccgtttcaactggccatgaatagtgcatagcatatttgttcgcggttggaatgaataattccatgtctggatcaatactcccaacagaattctaaagactgctgcatcacttcacgcacaagacgctttccctgtagaaatacagaagaaagatgttaaaattatttcttaacactattgctgttctagacgacatgtttccttgtgcttcacaatgatctgttaaaaggggcattgcattgcctctgtaatcaatgttgaatcatgtgttttttttcttgtcttagtgaccccatcctcattattgatgcctcttttttttggcttttgtctaattgtcttataaatgtcttttttgataaacaggaaaaggcgatcccgagcaagcagccatgcatccaattcaaaattagcaagcacagcagttgatgcttcaaaaaggtacattgcagtcacttgtgtattttctgaacaccaaccattagcataacttctatactgttttcctgccatagtcatgataaaggttaaatactcaatggattgggttgaagtagtgcaattcttattcttcaaactgctagtgtagactttgtagttacttcgaaaagatacacaatcacttgcagcatagactagacacaagtagtggcaggcttttttgtttgaacaaaataaaagatcagacacatagaacagacatgtgggaattactggactaaactacgatgatattgctctttttacctgtttctaaaactgcatccaaggttatttttacatattaatgtgattttttttaaatactcagcactgcaaatgggaagtcaaaatcttcatcaaggaagaagcagaagagtaaaaatattaaagaacgtgacctgtacccgaagaactatttccatgctagtgaagcatttttatctatgctcctggacaaggacaatagcagctcaacaattcattcactgaaaaaagctggtcctgagatcagtgaactgctgacaaaatgctctattggcatcgctggaactggcttggctgttcttctctcagttgtgtgcaagatggctaccggtatgaagagtcctattgctgctacgcggctggtgaacactggtgttggacttgggctcttttggctctcctgggcagtaaacggattgcgagacacaattactagcatatttagaagcccaggtgacatgaacttgaaggacgaagaggttgcagtcagaatacaaaagagcatgaacgacattctcttcagagctatcactatattggcaatcactgcttttaagtttgcgtaagtggttacatactaatttaccttttccccgacccacctgtaatatataatccaccattttggttcaggagtacagcactagtgcttctgtaggattaagtgccaattgagcaaatgatccccggtaattttgtagaaaatgagaaaccgttgtgaactgtacagaattttgctggcagcttggtgtatatgaaagatgggtttttttcttatctgtagatgaacaatccaatgcccaatgatttatctatccagcagacaggttccatattttagctacttatcctcgtttgttcctgatctatcgatgtttgattgaaatgtcagtcctggtgtaattttaagagattcatgcgctaaattttctgatatgttagaaacaccctgatttgcagaatgctcgtaatttgaaatggttaaagcctgctctcttcttaaaaaaaaaaagcttctagctatgaatctggatagagttttttttttaaaaattttttttgggaaggagggtgcccatgcaacatggttgctatagtctttcttcaccaatcacatggaactagcaatgagtacatccgacgttgataattgtcattgataccatttcgaatttatgatcatagtcaactgattacttcaaaaacgaatttatgatcagtcaactactataaaaaaaatgatctgctggagttccaatcagtgtcttaggataataatgtaattttaagtagctgtacacttgatctatcatatgagagcatataaggaagaagactcaaaggagcttcactgttggtaatgttgacaacagacaacttggcatccgcagctgctttgtcaaaacagttgaatgtctcggcattccgaataactgtggctatgtaggcgacaggaacttctgtcgcagcgctactgaattcgttgctggtttcttctttgtttgcgacattattagttcctcgattattcccccttctcaatagcatagaaagcactctaataaggtgcggcacacagaccggatcatatattatatctgcaccaaggctgtcaaaagatatcaaattagtgtttatcgaaacgaaaaagaaacatatgaagggactgatgtaatctggatcatgtgtcagcaggggtgtatcctgtcatcagcttgcaaaggctatttgtatttgttcaaccagatcagttcagtttaatgggcatgaactcaacgacactatgctcaaaaggttttactctctattttccaagtcgcaatagctcgataaattgataattgattcaaacaagtgtttcatggctcccacagtcacatgtccagtgtcagatggataatggtaatggaaaaactaagtgtaaactgctacaataatacaaaaaattattgcccaaggaaatactgtactcacactaagtctggcctgcagtcccatagatcgctttcagatgtttcttcccatgaaagatatttgcattgtacctgcatgccagaatatagtacaatcatattttatccagtagtgcatttgatctaacctcaaaaggacaggtatctgattcaaggtggtgtctggtggttaaagtgcaacaagagtacaagactacaagagagactaattaagctacaacatttactggaaagcacacaactattttttctcaaatgaaatcatactgaaaaatatacacaatgtataatcttgaaagtatattctttatataagaagatagcataccttattcttgttctcttccggaagttgagaaccttcctgctcaacgcataagttattcatttccatgttgcctttcatgttttctagtgtagatgcatcaccatcagtaagaataacctgcatcatcgtataaacactgtgtcacctgtctttcctgttgaactaatctctaacctttgaagaagtttatgagcttagttaggagtaaatatagctcatagcataaccatcactagtcgctacagtcagtcaaacttaaagagttgactatatgtctgcattttcatttctcagttaagtcgtcttgacaaactatacaaggcttactttttcacagatatccatttacttgaatggagagtggcattataaactttcataccttggaggcgctgacatagttcagacatacaccaaccaaaccaacaccagaacctagctgtttatcatggaaacatttagaagggtaagacacactcacatataacttttaaaagtttcggtcatgagattttctgttgatataacaggcaaggaaaaagtatgatgctgatgagacagatgatcatactaaagtcatagcaacagtaactgcatatctatttgctcaagaaaaacatcaaggtaaagcgacacatatagtagaagggctttgcagagagctagcgacagagttcaagctcaattttacacattgtataatcactagaaaaaatgcccgtgcgttgcaacgggtaaaaacgttttttatactatacattatactcccttgattttgaaccaaatgctttcttgttttttggaccgaacgttcattctttccttccttttcagctctagtcctagagcagtccgttgcctctatctgctcgacctatctctcttcggctcagcccacaagtggagctgtagacctagcttgaacagtcctttgcctggcctacctctctttggctcagcccacaagtggagctgtaggcccatgtcgaacagtttcgtgcccgtaccatgacggagccgatcctcccaccaaatccggtaatttggtcgagctcgcatagtaccgtgcccgtacgatgacggagtcgatcctctccgtcaaatgcggccgaatctttctcgatctccaaaattgttgagaaattttgatccactcgatctcatttttcgaatttttatcaaaatcgaagcaatccgcaaaactcggaataaaaaatgacgaactaatgggaaattaaggggaaaatgatgagagagtagtggggaatcggtttttgcaatcaattggatgaggaaacgcatggagaggcaaatcgccatggcggcggcgctaggattcaggccgaaaaaaaaaaaccgccaaaaatagcgcgttggatttcgttgaaaccggaaaaatggtgaaagaaaaaaaaagaagagaaaaacaacgcaaagaaaataaaaggaaaatggacgaaaaaaccgcgaaaaatggtgaaaaaatggcaaaaagaaaataaaaccgaaaaaggggaaaaaaaaaagaaacggacgaaaattttgccgtgccgagcttcttttttgtccgcttttttagtacagataagaatcggtcaggttttttttttgccacgcctttttttttccgcgctggacttttttcgttacaatcgaacttttttatcgcttttatttattaacggacgaaggaaacatcttatactttttaagtagtagtagattagagaaatgtacaatggacttctatatatttgtgttgcaaaacgcatgcctaagcaagatataaccagtatttgctgggggatgatcaggttggctcactttggatctgtccctggttacagtaataatattttacagcagaagatagagtagttgagctgaacatattcctataaatatatatatgctagataaagataacattttccatgtatctaaactaaaacacaaaaaataatcggtatttacctcaaagcaacacttcctagagaaaatttttgggtatgaaagaataaactcagataggaataaacctgatggccaaagagagcacctgtaaaagaaaagtatgcactgacatgaattaagaatttatgcaagtagcttaatatatagataatagtagattatatattcaatgccatcataccctgtatcaccttcgagcatattgatagaacatgataatcgagcaaccaagcttactcgtttattgtcatctacataaaaggtgcatgttacaaactattataatttggaagaattcaaaattaaaaactcacttgtaggagaaataaaagatatttctttatagatcttctcagtcctatttaaggatgaattattctgcacatgttataaaataagttacttttagtacagcatttcaacagttattaactactacttggctatattacgatgtttaaaagacgtactgattttgacgacatgaactggccaaattcctcataaagtccatcaatcacaatatctgacgataactcagcttctgctataatccttttaagaatagttgtaacataactacagttttgatctccccctgcctgtaatgaaaactcaacattttagattaggagttacaggaaaatattgtgcaacaaccagaaaattataaaaatgtcaagtaaaccaaattgtgactcttttgtattatgcatctttctacaacgcacacatcatggtcgtttttttttctgttgatagttttgcgtgagataacaaaagacatttacattattgccagtacaactctccaaaataaaattttgaacgtgtggcgtgacagaacctcccccagcttttctgcacaatcaaatacacacaaatttaaataaacaccaccataaacttatcaaaaaaaagaagagaaaacaaaatagcgctttgccttgtcaagttacaatcacattcatacaactgagaagaggaagattattattttttttaagaaaaacctttgtatgaaatttcctgacacattcatataaggtggaaactgacaagttctctgaactttcctgggtctaaagatctctctgctcattggagctcaatcactagccaagtctcatcacactactgacgcaaacacagcctcctccactactaaatccaaaccaaatctctgtatcggcaacatttttctgaaggcaaccaaccgcataggcttgcctgagattggggactcgatcgatcgatgcagagcagcatacgaattcgagcgcgtggggggcgcgcgtacctggcgagggagaggacgcaggcggggggctcccgggcgaggaaggcgagcttcaggtggaggagcagctcctgctcggcggcggcgggggccatggatttcagatgccgcgcgtggagatgacgagatgagaggaaaagctgctgatttgcagtctgggccttggctttattgcagttttgggaggggacagactgaggccgtgtacgggcaggctttctaaaccgccggggctgggttactgtgccccgacggtaagcacggttaccgtgtggtaaccgcggtaaccgtgaaaatccatacaaaatcgtgtaaaatttatcaaaaattaattattttttaaatttatttgaatttaaggaggttatcgcggtatttatattaccgtaccccgtggtaagcccagtaaccatggtaaccgtgcggttaccggcggtaagtcaaatcctatgtacaagtactttttggaggatataagattgttttagtatcataaaattattactacttgtcaaaataaatctacagatattttttttcgaaataaatctgcagatatggttccttcatgacaccatcctagtataaaatcctaatataagtgcgcacctgtaccggatttgaacagttttactactacatcttctgatattatgtgcacttattcttgtggtagtaggtgcacttatattgagacgatgagagtaacatatattcaaggtaaatatatttaaaaatgtagtattatgcttaagatatttgaaatttggccataaatattttttacagcaataaggcacgttcttttggataaataaaaatgaataaatgcacatgtttcatgagtttctaaatagtttattaaagggataatgatgatggtgagtgatgaattagtcaccagtcactaccctaatcaccactacctttttggaataaagaaatgacatagggtcaaaggactcgcatgtcaaccaccactaccatcatctctacttttgtggaaaagaaaaatgatattgtgagcctatagagaccatatattagttataaatatgtagaatttaagagatgatgtatacagaaaataatgataatagcaggttaatgatcattttcatcaattaaaattccattacaatgcacgggcaatatgctagtatatacaaacatatataacaatataagaaacggtaggtcatgttcttttctaatcaagatgtagattttacctcagtttcattaacggtttttcaaactgctacacagtgtatttgtgcgaaatttttttagtataaaagttgctttaaaatatcaaataaatatatttttcaagtttgaaataattaaaactgctaatggttttctcgttttacgtaccctacttgatcttcatctttgtcaaattcaaacgggcataatttctgcctctctagctagttaagtattaccacctccatcctaaaagataagaagttttaaggatagacacataagttaaaaaagttggtgaaattaaatagaagaagattgcaattgattaaaaagagaaggtagatgggaaatcggaatggtaaaagtttatgattaattgcgaagagaacgtagatagaaaaattgttatattttgaaataaattttgaaggctttgttatatcttgggacgaatggagaactcctttcgtttgacatatattaattcagatatgaaaagacgaatattttctttattaagacgatctattcgatatttctcct

SEQ ID NO: 74872 - DNA, 585 bp, Oryza sativa
gaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgtttta

SEQ ID NO: 74873 - DNA, 6731 bp, Oryza sativa
atatgtattttacaaatttacactgttttcagttaaacagaaaagtctttaaagtgttttctttatatttcccagattttatgtacatggggtccacaggtcataggcttggggaggagaatagcagcagcagaagcagagctcaccggccggcgggcttgacggcaatgccgatggcgaacgacgactcttcggctgacatatacaaaagagaaaatgtggaagacattcttgcgaactcgtcggtggtggtgtcttggccggaggtggccagaatcgaagccgacggcagcgcgagcagcagcggctttgaggctgcatgtggaagacaagtcacgggcttggttcggttgatttgatgcgtgcatgagctttctttggtcactagggagactcaccgcaggattgtgttaggactcagtttctcaagaacaatggaggatggattgatggaattagggattcggaaacacggaatgtttagagtctctcgatcctacaggaccgaaccgccgccgccaacgccgccgccgagttttccgttcatgcctcctcctctgttcttcttagtatttaacaacacgcaactccagctggcacagcacagcttacgcacgctactcacgcttacaaggcctcacttggcccacatcggtccagcaattctagtattggccttcttgttgcgcagcccacgacccagctttggctttgtcctgtcgccgtcctgtagctcgtccgggacgcttgctgtttcatcgtcaggttgctcctcctctgcttcagcccgacttgcagacctgacaatcccccactcttggtggctggcttgcccccaagccagcgcgccaggaaagcgagcacgcagttcctccatgtcctcccaggtagcttcctctgcaggtgaatctgaccaatgagtaagtaactgaacgacagttttgttaccttttttagtgagacgcttgtccaagaactggagtggaatttgtagttcccctaaagagcttggtaattgagacataaccggtttagagaacccggcagccgctcgcaattgtgacacatggaagaccggatgaatagcactataagagggcaactgcaaacgataagctacagcccccactctgtccagaacttgaaatgggccgaaatatcgaaattctagcttatgattagctctcttagtcacagaagtttgaatgtatggctgtaacttgagataaacccaatctcccacattgaattccttgaaactcctcttcttgtcagcttgagacttcatttgctgctgagctcggttaaggtgttgctgcaagagttgctgcatgaactgtcgctcttgcaaccaaatttttagatcagcaatttgacaatcatcagagctaatgccaaaatgtgctggagtgtagccatataagacctcaaagagagttttacccagagttgagtgatatgaactattgtaccaaaattcagcaagatataaccaggtggcccatttagtaggagtagcatggacaaagcatctcaaatagatctccaaacactgattgacacgctcagtctggccatcagtttggggatggtaagcagagctcatgtgcaatttcgtacctgatctagagaatagttgatcccaaaactggttagtgaatattttatcccgatcagagataataaccttgggtaacccatgcagcttgtagatgtgtttcatgaactcagtagcaactccattagcagtaaaaggatgagttaaagggatgaagtgactgtacttggaaaacttatcaacgaccactaaaatgcagttatagtgcccagatcttggcaggccctcaataaaatccagggacagagtttgccatgcaccttcaggaactggcaatggttgcaagagaccgggatacttggatctatcgggcttagcctgcaagcaaatctggcaatgttgtaacttgttcttaatcatctttttcattcctgcccaagcaaacatagttttggctcgtcggtatgtaacaggaaatccagagtgaccaccaatgggagaagcatgaagttcattaattaatttatcctggagcactggattgttgccaacctagattcttcccttgaatttaagaattcccttgcataactgaaaatcaggcctgctattaggattaacagctaattcagcaatgacttgggtggaaaaagcatcctattcatatcctgagagaatatcttgcacccacaatggaatacattcagatattgctgctaactcggctgaatcaggtagttccttgcgagatagagcatcagcagctgcatttgataatccctttcgataacaaattctatattgaaggcccaacagcttagtgaaagctttttgttgccaaggggtatgcaaccattgttcagacaaatgcattaggctgtggtggtttgtcagaataacaaattccccttgttggatgtatggcctccaattttccatagctagcagaatggctaagtattccttttcataagtggagagtcccttggtttttggacccaaagctttgctaagaaaagcaatgggatgcttgtcttgagatagaactgccccaattccctgatcactagcatctgtctcaatagtaaaaggtttggagaagtcaggaagtgccagcactggggcagcaaccaaagcatgtttaagttgttggaaggctgacttagtttctgcagtccacttgaatggaactccttttctcaaaagcatagtgaggggtttgctgataacaccaaaatttttaacgaacctcctgtaataaccagctaagcctaggaatcccctcaatttttttaaggtagttggttgaggccaattcagcacatcctgaattttggaagggtcagtagaaactcccagtaccccaatgatatgacccaagtaagatagttcttgttgtgcaaaagagcacttgctcaatttaacttgccatttattgtcagccaacaattgcaatacaatctttaggtgttgcagatgagattctttatcaggactgtagatcagaatgtcatcaaaaaagaccaaaacaaacttcctcaacacaggagacatggtatcattcattgcccccagaaaagttgcaggagctccggtgagaccaaaggacatcactttgaattcatagtggccagagtgtgtctgaaaagctgttttgtgttcatccccttcagccattcttatctagtgatagctagctctgaggtcaagtttggaaaaccatcgggatccagccaactcatctaacagctcctcaataactggaataggatatttacttttaacagtgatagaatttagctgcctgtaatcaatgcacaatcgccatgttccatccttctttttaactagaagagttggggaagagaaggagctttggctgggttgtatgacccctgacctgagcatttcagaaacctgacgttcaatttcatccttcagtgcaggtttatacctatagggtcgaagattaacaggttttgcaccttccactaatggtatatggtggtcacacatcctcttgggaggtaatccagtgggttctgagaacacatgagcaaattcctgtaacaagggttgcaccatgtctggaacttctttttaattatgtagttcaacagcctgaagctgaaccaagcacataacaaaacccttcttagtcataccctgcagctgttccccagaaatggtagcacactgagatgtctgtggagtaataccttgcaacttgaccactttacccagatgagaaaactccaaccacttgtgattccattcaatttgcatggggctgaactgctgcagccagtccattcccaatatagcatcatagctgcccaggggaagtaatctgaagtcactagaaaaattatgaccctgaatccaccaatcacactttggaatcacctgagaacatgatagctgccctccatcagcaatttgaaccttcaatggttggggcaggtgttttaagccaataaaggtagagccaattctttcatccacaaaagaatgagtgctgcctgagtctactaacatgagcaactcagttccttgtacccatccccttagtctaattgaagtagaagaatcaatcccatttaaggactgataagaaatagacattaatgcatcatctgcagtttctggtatgtcaccagaaaacttttcttcttcagtattgaactgtaatgcattgagtaattcctccaccacatgaagctgaatagatgctgcacatttgtgatccttgccccacctttccccactcttaaaacacagtcccttagaccttctataagacttaagagctaataacttgtcttctctagttcttacagatttagctcccaccttgtcttcactggttgttcttgttgggaggactggagtaggggtgggtctgcttttcacatatactccagaatcttgtctcctaactccagattgaactaccccttctagagcctcttcctgcaaaagagctaaagaacaagctgtgtccaagtcttgtggcctcagcatcataacagcaagcctgatattgtccttcagaccatccacaaatttagtgacaaaataaatgggttcattggctccacgataggccagcaactgatgcataatgctatcaaacctctcaacataatcacttattgtggagctctgaaaatacgaatccactgacgtatgagtgtctgttgcctatctctagaaaatcttgcacagactctttcacacaattcaaaccaagtggcccctgccaactgagatctaactgattgtaaccaaaaagctgcattcccacagaaattcagtgtagccactttaacccaattccgggggtgaataccatacacatcaaaatagatttcacaatttgctttccacatctgtgggttgtctccattgaactgtggaaatgtcatcgggggaatactatacactagagcagaggactggccatggctactagactggaacgcagaatcatcatgcgggaaaggaataggagagatcagggttgaatcgcgcataccatggtggagaggggttgattggaagttgcgcgaatcctgaggttcctccttgtgggcttcaggatacacagctgtggtcaccttccccgcgaattcatcatccttgcgttgcaacgcaatactgccctccaactgttcgaccttggcgctcagagtcttgcacacggtgttgagggtctccaccttcttttccaccgctggtaggcgcacatccagcgacagcttgagctcggcgaagtccgcacgcgtgcgagcctccgcttcctcccgcttcttctcgttctccgccatcgtcttcaggagtaaatccagtttcccatcttgcgccatgacttcctccacaccttggtacccccttactttgcttccgaatccagtcaacctgaggaaggcaagttgccttttcgtgggatcagttccgaagaacagccccaatccttcccctggattttgcgaccgactcaaggaagcagagcaagtttggctctgataccaaactgttaggactcagtttctcaagaacaatggaggaggatggattgatggaattaggggttcggaaacacagaatgtttagagtctctcgatcctacaggaccgaaccgccgccgccaacgctgccgccgtgttttccgttcatgcctcctcctctgttcttcttagtatttaacaacacgcaactccagctggcacagcacagcttacgcacgcaactcacgcttacaaggcctcacttggcccacaccggtccagcaattctagtattggccttcttgttgcgcagcccacgacccagctttggctttgtcctgtcgccgtcctatagctcgtccgggacgcttgctgtttcatcgtcaggttgctcctcctctgcttcatcccggcttgcagacctgatagattggttggagttggcgtcatccaaacagctgcggcgatggaggagatggcttggcggcagaggaaaaagcagggtgacagcggcggctcgctccagtctatcaactctgagatgaaatcatacttgaggctactgaggtcctagagatgattcctgcacggggaatcagatggtggcactggaaaaagagaaatttggcgatggtgcttggtagccggagttgaggaagaagacgccaatctcccttctctctgtggcattggctggggttcttgagggctttcgaagagaaggtcgaggcgacgcggatggcgcggtggctcggcttgaggcgcaccggatcatcgggaacggcgaagcgacgagcggcggcactctggacaccgagagcggcgatgagcgcaacacagttgtgttcgacccatgcaaattaagaaccaaggaaatgaaagagttaggcatggcgcgcagatcacgttcccatgaatagaatgtcccgaagctctctggagaagattttccacgtacggatcaaacaccttcagctgagaaggagtgagcgtacttggctagacagagaagttcttggtctatctcttagtggaacatgatgagagatgagagaagaatagagtggtggagtggctgctcacatggtgaagagtgtgctggcaggggcatgctaggtgtccttctatggcatagacacgattttggagagagggcaaggttt

SEQ ID NO: 74874 - DNA, 678 bp, Oryza sativa
ataggcaacacttgcttcggtccgaatagaatatcggacctaaccgaggaagtcctacccacgccgatgcaagcgaagatgacggaacttacttctcgccagaggtctcggactaaaccgatgcagcccatgctcgaaattaagaactcgacaggagtaaattagggtggcgatatgttgaaagttgtattgatctagagatagattagaagaaccctagatgtacatatttataacatatttataacctcgagccaatatgaatccccatcataaatgactcatgtttcctaaagataaaacacaagtcctaatcagacactaaccaaactttttaaagataaaaagaaaaaaaatactaaaccctgcataattaatagataaattaagctgccatgccatggtcttcacgactccttcttgaacttggtctcttctggacagactttccatcggttgattgtgttctttccctaaccaaatccactaaagaatcttaccatattttggcattaacacctagccatccttttttttacacctcaatcttagccatttacccatttccctttctcaatcccatgtctcataatccttttgccaaaatatgcctatatgcatctctctatgatctcttatcacgttgttgtgcctctttccccatctttacaaactcgc

SEQ ID NO: 74875 - DNA, 598 bp, Oryza sativa
cggttaaaccttatccccgaaccggcgaaccttaaccaatccgccgccaaatcctctcgggtcgagccgatctcctccagctttggctataaatagaacccccaagacctcctctttcgtttccaacccctagctcgagctcccgttccctagccgtctctccccgcagccgccttctctctccgccgccggcagccgctccagccgtccctagcatccggtgtagccgtcgcctccggtcgccgtcatcaccaccgggttcgcaaggaggagaagaagcccggccactagttccttttcgccgtaacccgctggaagcccctcgacggcgtgaatccgatctactccacctccggccgagcctcgccgtcgactccgtggtttctggacgtcgtcgtcgctttcttcggcatcgcagagccaaggtgaagcccgtccactggttttcctccgctaaagattgccggaacgccgctgtcatcgtcgaccagtacctcaccgcccttcggagttcgtcgccggctgtctcccgtcgtcggtcgtcgtcgtgccgcccctcagtgagttctcctcgtcgtgctctttcttccggtgcctt

SEQ ID NO: 74876 - DNA, 38422 bp, Oryza sativa
cactgatctaaaagtatgaacaggtataaaaaatatctacaaattacttacatgaagggctcattaaaatggcctccagagtgatgagaaaaacctccgatagaattctgcgtttaatgagagaaaatcattaattaggcacttgaagcagcaacaataatttttcaagtaaatatcaagtaaggatgagagttatactaatgaaaatgtccaacatttttcatgggtgttttgccatcatggtactattgttgcactagtatatataaactataaaaacttatgtgagccacaaagtctaaagcacagtaatgcataagtaaacataaatggtgatatactgatagatgcagaaaatatattgttacagaagatttagatgtccttaccgcccatgtcattaacaggctcactttcgcacggtctttcccagtgttcactagctataataaacacagaaaacaaaaggaaggatggtcatgtaatttcatcaggttgagaagattaagagcatctcttcatgtaaatacatatgaaaacttaatgggaacattcaattcagtagaatattcattaatcagtaactcctcaagtaaacagcatgtcccatgatctaagaacaatcactgtaattaaacatttttctatataactgtattctgaaatgttttgacatatatgttcgcaccaacaatattattttaacagtgaccatgttaaaattctcctgtcgacataaaaaggcagggctctctctaccttatgatccatgtcagaactgttacatgtggaatatcttggctgaagttgccagaacatatttcttaatataaatgttattgaaccagtatcagattcaagcaagaattagagcgagacatggttaatcccctagttccacaaacctaatcccaactgttatcaacaccgatccacatgtatattccatgatattatctaaaggaatatacttatcaggaaatatgaaataaaaaaagatgagggaaatataccagctgaagaacctgccagcctagcataaaactaactttatgagtcacttacagtgtacacaaagacagaagttgggaggctgctatctttgtaatcatgaggaatgaatggtgatatctgacgacatgagattttaaggtctggatccggttcacctgaatacacggaaaaattcataagattcttaagttcaaaacatgtctactgctactaaaaaaagatatccatcaagttcataactccatataatagtattgaaaattaattatgtaatcaacatataagctggcttggcataaagcatatccatctcttggtagaaaagagaagtgtttgtgccatcacaagatgcaagcaatgttccacagctccatgatggcataccatcataaacagtccatgccctaggaaataaagcatgataggtagaatgttgaccgctcaagttccagtcccatgaagaaattccagagtcattacatttcctgaaatcaggtaaggcatcaaacaagtgcactctatatcaaatttgttgagtcataactgaagcgtgattgcaacatatatataggtacaataaactagaattctgttcacattatgcacagcgatgtttgactcttgagtcacaaatgtacaagaaagaatttggtatatatctcacactctctctgctatataatatgcaagtcgatatttgaaataaatttctacgcacagcgccgttggcttttgaatcacaaattaaaattaaaattgaagcgcaagtcacttatataaagtatgcaaagtggatctgcatttcaaaaggccacatactatatgggaaacaaggcacatcagaagaacaaatacaaggtaacaatgtatgcactatacaattggctgtgaataccattcaatcaacaataaagaacttctgcaagttttaacttcagaaaagcaatgcaaaattacaaatctacttgttgaagcttacccttgtgcaagatacaggattgcagaatgacgagctcagaagctcagacttagtaaatttggataaactaaagaaagactgttatttgcaatataaatgaagaaacttactttaaaccttcatggtgtccgggagacaataccgatgagtactttttgttccccccatcgcgagatacaaatatctagaacagcagggtactatgtgtcagttcaagactctcaccttagttgtgagaaaaaaaataaacaagcatagtgactcgggagtactaagtcaaaagattcaagattttataaacagttgctgtcataaatcttgtatggagcccctgatgggcttgattgggtggcccacatccatggaagtttatatacatcgataggaaaaataagtgtgtaatagctggcgaattgacaagaacttgctaactgattacaacactcatcaaaaagtgtcacaagcagcagatggaactcgtccatccacaaacattaaacagtggaaacagtcgtgcctttttatctcaacaaaagtccccaaaaacactccactcaacagttgatttcacacttgagcacagccgcaacaacaaagatagcacttaaaagattctttttgacgcatatttagtgaattgccataatatgagtatgtgagacaccagtgaagggtagatgtcataagactttccccaaaaataatactagtgactagtgaggggctaggagcattttcagcagtcagaagaaaatccttcagataagctagctaatggtccaaaaattcaattatgcatcaccataaaccaagttgattaaccagcaacagcagaaagaagaagaaagcattactgaaaactggttctccatgaccggggaagtctcacataaaccaggaatgatatgccaattcttgaactctcccctgaaacctcttgaaatgctaccactcctgcaaaaccagtgtattggtatcaaaattacagcatccatagtgcaaatagacaagcataaacatgagattattggaggttaaaacatcaattcaggcggacacaccccatcccaccaagcggtacgccctgcgaagcagacggcttacatttctctttggtaaacggatcaattggagctttctgcaagcatagcagaccccattttatcaccacacacaatttatattcatagatgtttggtataattttagataaaaggaaattccattaagtaatgaaatataaatagcataagaacagccgatggtacccttccatgagaagcctcctctcggacatacgaccatagcctcaggccaaggctcatctgaaatttttcacattccaaaaaacaaatgattagcagatagcagcattaaaaaggaaacgacgcaggtgttacagaaatcaaactgcttgaacaacatgcagagaaccaagcgttgtaacataccatcctcattgcttccatgaaggtgacgctgaattccttgagtaagttggcgtggctgttcagacgccgccgccatgcctgctccggaggcgacccgccgtcgaagtccaactgcgaaatccaaagcatccccagcaaaatcaaacacgcgcccacaggaagcacaagcccaaaaggaacaagaaattggactcaccaactgcagggcggttcggccgacgtactcctcggccggccacgagttcctccggcagtggaagaggttgccgctcaccatcccgtctcacccccaatgccaccacgcccccgatccaactcccgccgatcggaggcacgatccacgaacaaatcccctcccgcgccgcgccgcaatcatgcgcgcggatccgatcccccagcgccgcccctcctcctcatcgcgccctcctccgatccgatgccgccctctgctcccctcccctccccacctctcgatcgattcaaccaaaccagatcaaaaccaaaccgaagcgggcagcctctcgcggagaggactctccagtctccacccacccgcgcgcgccgccgcgggaggcagttgctccacgcggagacgagaagaccgcgaggaggtcagcggaggaggaggctggactccgaagcgaagcgaagcgaagcgaggcgaggcgaagccgcgggaagaggaaggaagagggtggagaaaaggaaggtggttgcggttgcggcggtggcggtcggcaagggcggctgtgtgtaggcagaacgcaggcaaagcacggacgcgcgtgggggaagaagaaatcaaacgggcgtgtgcgatttattgcgtggccgtaccaatttccggggagtccgtccgttgcccatgtttcgtcgtcaggtggtaaaattgttggcgataccccggtagttatcctgcacggttctttattactcactctatcccaaaacaatatcaatagttttgagtttttgtctataattaccattcatcttatttaaaaggttatgaaattattatttattttatctgtgatttgttttattatcaaaagtattttaagtataacttatccatttttatatttacactattttttaaataagatgaatggtcaaacgttaccagaaaaaatcaaaactacacctaatttatgatgggttattattattattattattattattattattattattattattattattattattattattattattattacctccacgaatctgtgctgaagggtgaaggttacggatgaagaggattggaatatttgcatcttttctttgcgaggaaatgggagtgggaggggggaataatttcgtgtggatagtattttgtgtcaataaacccgtggtgacaagggttatgtgtggttatacatcaataaagtatgagggaatatgttcatatttgattgatattttaagtttgcgtatgctgcttgatgttagccttagacacacgagcataatgatggtgaaaagggtttcaaaaggatgccttttccttttatttgctctacgcttcgaaaaattaattaatatatttcctagaagaaaaggtagctcattatttacacctcttatctaaaattatgtttatttcttaaaatatttaatttattcatataataggtagaaatccacaccaataatctaaaataaacatgatgttaagtcaccaatgacacaacggcacatattcttaacgttaatatatgttcaacatagtttatttttcaatactaatttttaagttataaggatagatatataaaagttttggtctccaacagctgttttagtacataactagcttatagtcaaccgataggcccttctatcttttgtggacacgtgattccattttatttacgatcaataactaaattaagcgtaactgtgcttggctatatgcctatatccaaaatcattatgcaatcacattgttgcatataatactgtactcattttccaaatttggagaagttcccttcatacaacaaaaaccagagctattggaaaaaacaactgctagggtcgtttgagcattttctcatctataccacttgctatacactgcctattttcaacttcacaagtcactgttctagcatcagtgtgaaaaaaaagggtatttgtgcatgcttgtgcaatctcaagttaaaagtcaattgctaacatctacatatacatataactaaaccaacccacaaatagtcaactgatcatccaaattattatttctagtataggctgtccctaattttatttcccttatatatagagttccttcagaatatgtccctgttgcgaagacacatctactcctatcagaagagaaccagtgcgtgctctttggcttgccctttttccttttcttttctttttttttttggagagaactcactttcggttagtttcatgatcttgacagcgaacttatttatcaaccgacattttatctttttcttactcacatgaatttatcctgtgcttggtagaacgacgcgtccgggttagaaaggattatcccgaaacagtgactgtaaaagcaagtataatagtgagctataagcctattataagcttaggtggaggaaagagatagtgaaaaattaaggatgttggctcttatgtaagagctagcttatcacaagctccaagacaaatgcattaaatgtataagtgagagataaagagatgagaagaaaattgtagccaatcttatagctaatctattatatatgttggctttaagatgggctaatagtagaaattgggctttattattatctaagttgctttgttttcgagcaaagtagccttgatggatacgcatctctgacgttcgataattaaaggatgatatgtactttcttaaagactgaatgatactagtatgtagagtacttaatgggacactgacatgtgaaattgagcccaaatttcatttatctatatggagataaaggctacgtttagttcatacggaaaaacttttcacattatcatattaaatgtttggatatatgtatgaagtattaaatatagaaaaagtttaattacatagattgcgtgtaagataagaggcagatttttttttctaattgctccatgatttgacaatgtggtgctaaagtaaacatttgctaatgacgaattaattatgcttaataaattcgtctcgcagtttacaagtattagtctatgtttgatactttaaatatgtatccgtatatccgatgtgacacgccaaaactttttacccatattacatattcctctgttccaaaatacaagtatttgtaatattaaaaaatttgtatagatcaatctaagtatttctctaatactaatttaaatgcaaagaaatccaaacattttcaagcaatcagaaggttaggaatgaaacataaggcgattcaaaatttgacaaactgtgactaaaaaggaatattcaaacagcctaaaaattagtactgatgtactatattttagattaaaaaaatatatattccattttagacttgaaatttataccagggatttatccagaagtttcaatggtcggaagttgtcccgttcagctggctcgaccgagaccagccaaaaagaaaaaagaaaaagtactactagtggtacgaaaagtacaccaggaaaaggttgggtgaaccggggcgccgtccggtgtccagccatgcagccatccacacccttcccttccgtgcacgtcgccgcgcgtggccgctgccacgccacgcctcgtcacgggcgggtgccgacgcgccgccgccacccgccgcgcatgcgcgccacggcggcggcgtcgtcgccagctcgatcgctcagtactttgccggcaggcaagcgagcaaacggccggattgacccctgtggtgttcactgttcagtaaataatgccggcgttttgcgatcggtggtggccatcaatccctcattttctggattagatatggatctttgtataaagtcgatgagaaatgagtaggagaggggagagctacatactagtactgcttattattcagtcatgtaaagggatttcgatatatatatatatggcaaaacaaaacttgttatttgggttaaacgatcgtacgtagggctgatttacggcttacggggaaggaagaacgcgggcgcacaacgtcggcgttgtcgacgcaagaaaccctggtggtggtggtggtggttggaatagctgaccaagcggtaactagtactctaccaagtcgaccgctaagtccatcggtaattgttttctagaatgaaatcagcagaaaagtactgctactattcaaacgacagcgacacctgggacctctcggatctcccccggccctcttccaaacgtcattttcgagcttttcctcctcaaaacgaccgcgcggctttgcactttccgatcatttttttaccattttatctagggacggtctatacgtcattcaacggagaacatatttaaaaatcttacgaattttatatcacaagattatattaagattcgtgcgagtaagcaaaccttaacaatctcctcattctctcgactccggttcactaataccaacacattctgcgtcgccgtcgccgccgccgcccggccttgccgactagccggaagacatcaacgcgcgccagcgaggccccactgaagagcctcctctcgctcccccctctccttcctcgagccatcagtggcaagatgccctcgccctcgtcgtcttccgcttttccggtggctcttttgttatcggatctgccaccaccgagctctacaagctcgctatgcccccgccaccaacaccggcctcgtggcaccgtcacctcccacgatcatccctctaagtcgacgacctcccattcttccccttccctttccccttctcctcccacctccacttcaaccccctaattcatcggtcctccatcgaaattcgggttattatgtaggcaaaatttgctacatggcatctaaaatttgtgtaattggtcataggagaccgtaaaattgtgtgactgctaaaggacatcaaaaaacggtgtaattggctacaggacgccgaacacattattttataattttcaaggcaaagtagagagagaattttttaaaaagacaagtttacccctgattaccctttctccccatggctatgaggaggcgacggcagcttcaacggtggcgagtggcagtgcaagcaaagcagtgacctgctgcgatgggcggcccgcacaggtggacgtcagccactagagtaacggtccggcgctgggcctgtccctcggcagcggtggaggagaccaacgcgacggcacactgtggtggccgtattgctgcgctggagccatcgctgatcctgagcatgcttgacaaacgcggcagatgcagctgcgacggtgaccgtggccctacgcattgcgtcattatatagctgtccgtcggcgtggcggtgaagtgggagtgtgtggaggagatcaacggtgagatggtgtcgtcggcggacggtcaggcgagccggacggcaacgactatggtagcatccgcaagaagctccagtattgatttgtatttgttcatccacacagcacggccaacctggtacatcacgtatgtccacgcgtttttttacattgtattgattggtatttgatcatcttttgttggttgaatacgtgcggatcactaaaccagcgctttgttttttcgagcagaagcagaaagtccctttttactcgaaaatcaactgatgctcaggccaaggcaggggcaaacttgtatttctttttaatttctctctcccctttttactcgaaaattataaaataatattcctatagccaattacactattttttggtgtctctcggcaatgacacgatcttacggtgtcctccagccaattacataaattttgaatgtcctgtagcaaattttgcctattatgtatgtggaaaaaaaagaaagttgttggagttgaataaaaagtacatgtaacataaatcacgaaatatatttaataaatcaaaatttatatggactttctgttgaaagaagggttaagttaacaactccattttctttttttaatggaaaactccattttcttcgtcacacaactagcacacacaagcacccaattagtggatcccctccgcttgtgggtaaaaaaaacgccgtgagtttccctcgcaccgcgtggccaccccgctcgcccagtgccgaccaggtttcacaccgcgatctctccagagggagagaggaaaaaaaactacccgcacaccgagacgctcgtgagtcgtgtcgtgtcgcgcgacgcgccgtgccgtgacgtctcttcgtcggcgcgccgaccccgcgagcgccgcgccgccggaaaaacgacgtcgtcacgtacgcgcgcgcggagtaccctctcacaaaagcgagtgcttcttttttttttccttttggggggcgtagtggcatctgcgtcgtctcgtccacacagcagatgacgggacgagtggtggtgtggtggcgtccaggtccatcgcgtgcaccgtcgacaacgacgacgacgagtccttttcttctttattactatctccatattttaatatatgtcgcccttaattttttattctatgtttgaccatttatcttattaaaaaaatttatgtaattatcatttattttattatgacttaatttatcatcaaatgttctttaaacatgacataaatattttcatatttgtacaaaaaatttaaataaaacgaatgattaaacgttggtcgtgaatttaaataagtatctcgcacagtagtataattgtagcttttttttggtttatctcctggctgagctctcccggtttttgcgcccctcgtcagcgccagaggacacgggccactacatttcagcgtcttagccctttatttcttttttctctcttttcaatttgttctatattacactgtacttgagtgaagaacatacgtaaaattgcaatccactcagaaatggcacggaggaacggacagaagaagcgacgttgatgtgcggctgtttctctctgtccggggactacaagtgataattgggggcgaggttataatgcattgctcgactgacattgacaagtcccgaaaaagaaacggttacatgttcgttattgcgcacgtccacattcgggaactgatcgatcgatttattatacgtatgtagccacaaatacctcacgactccactcccttccttccttttaacaccatctatcggataaacagggaagagcaagctagaagctaatgatagattttttctttctttcttttcctcccatttggagcggcggccaagagaatacacatactgtaacaacatctttttcgtcgaatactacatatgtagtgtatagagcatcaacgtgggtacaaaaaggaaaggaagcggtgcggcattggaagcaagcaaggatcggaagcatcccgtgatcatgccatcttcctaacctatatattcgctattatatactccctccgttttaaaatgtttgacactgttgactttttagcacatgtttaaccgttcgtcttattcaaacaaaattgtgaaatatgtaaaactatacgtgtacataaaaatatatttaacaatgaatcaaatgatatgaaaagaataaataattatttaaattttttaaataagatgaatggtcaaacacgtacttaaaagtcaattgtgtcaaatattttgaaacggagggagtatattttttattcctaatgagtggatcgctgattaatctataatcgtggctcaattagcctccatgagagatgacagcgtcacggtcgatcgatctccgtatcattcaagcaggcatcgcacgtggaggagtggaagctagtgtggaaccttccctcccctgccgcctgcctgtacacgccggcgcttacagtacaccctacaagcgaaagaaacccaaacaaaccaaaaaaaaaaaaagttgcaggcagcgaatgcccctcagcacccgtgcgcgatcctgccggtgggtctcgcgcccgtgccgtccctgcagccgcgcgtacgtacgcacgccgcgatcgacgaaacacgggcgcagtcgtcgtcgtcgtcgtcgtcccggtggtgtttcaagcgcgtgctgtgcgtgcggcggcggtgacaccgtgcgcccgcgtacgtatccgcgcgggacaagcagcggacgggccgagcaaaatccggtgttgtacgcgggccgggcgcggtgaggccgtccgctcgatgtaggccgttccgttgcggaataagttcaccggaggtccctcaatttaacagcaagattttttgaggtccctcaaggcctcaaccacaaaaccagaaatgttcgcccctaaaatttcacaaaccgttcaccagaggtcccttggcagtataggtgggtggttttgcttacgtggcatcctagtcaacaaaaaaaataaaaaaatttcgtgggacccacatgtcagctgcagtttattttttcttctcttttctctcctcttctctttcctctcctctctctttgccggcggcgggcggtgatgggcaaacgcgcagctggagtaggtggaggggcggcgtcagtgcgctagagcaggcggagcggtggtgtctccaggcgagcgtggctgcggcggcgggcaagcggcggctcgggcggtgcgtggccggagcaggcggaagcggcgacatctccgggcgcgggcggagtaaaggggcgggggacgcggggggcacggcgggcgagcggcggcgaggcgtcgcctctttcgccctctcccgccggcctcatctccccccactccgtccgctcccgccgctgcggcgcgccacctcgctgggctcctccgatgagtgcgacggcggcggcggcggcaaccagcggcgagaacgacgtgctcgttcgctctgtccgctttgcgcgccgctctcgccgccgacaacgacgcgactggcggagtaggccgccacgctcctccttcggccacctccgccgttgcggccccttcctccgcctgccgtgctcgtccgctctgcccgcagcccgccgcgcttgccttctgctcgcccgccgccgtccaacgtcgctacgcgtgccgccgcgccgctcgcctccgttctgcccacagggcgcgctcggtggatagcgggctcaaggacgacctcgtgttcggggaccccaacgcgccgcggtttgtgctgtgggaggggaagctaaggccggtgccgtccaagcccggcgacctgccgttcttcaacctcatgagcatccccggcaagctcagggccggcctcggcgtgctcggcattcgaccaccacccccttctgatccctccgccaccggcggcaacatccccgtcggccgcaaggatcccctcccggagcaggagcccgtcccggaacctgcccccatctcccgccgtggtcgcccgcggtccgccggccatcgccccgcccgtctcggtcgtcgaagaagagagaagagaagaaagggaaaaaaagaagggatgtggggcccgtaccgttttctctcacttacatgtgagccccatatactttatttatttacttttgctgactaggatgccacgtaagcgaaaccacccctataggacctcccgtgaacggtttgtgaaattttaggggcgaacatttctggttttgtggttgaggccttaagggactttaaaaaatctcgctgttaaattgagggacctccgatgaacttattccttccgttgcgtcccgcacggcttatgccggccggcccagggaggcgacacataaaccgttcggcctttttatttatatgtaaataaggtccattttatatggatccatatagggatcgggcgcccgatcttttaataaaaaaatcgggcgcctcttccagtcctcccagcttttttactgccaccacgtagacgcaagccactgcatcaaaagaagccatgcattaatagcactaaacaatagtaggatggttacagtattttttacaaacttcaaactattttttctcttaaattacttatccaattcacgatctgattacaccgttgtattcgttataattaaatctttacaacaagaccacacatgattatatttcgacaaaaaatattttagcttttttattgatattttttttgaatgttgcatatggtctcttttgatgtttcaatcagtagttttacgttgtttcagctagtgtacttgtgatgtttcactgtgtacggatcaaatgttgcaatagattttgatattatagaagacgcccttgcaacaaatcacgcgcatattatggaaatcttctattaaggaaatccgttttatattttgttccaccaaaaatgtttcacatagtgtactcataatgtttcactatgtatagatctaatgttgcactgaacgaaacattccattgcaacaaaaagcccacatattttggacatctcctattaagggaatttggtttatttttttttgttccaccgaaaaatgtttaacctagtgtactcacaatgtttcactatgtatagatctaatgttgcagtgaactgaaacattctttcgctatttgctgaaacattgtttttatataagttgaaacaacatccaatttaaacgagtgaaatattttcgatctacttagtgaaaccattccgatatatctggtggaacatcgtacaacattttaaaaaaattcaataataaattaatttttttcgtcggaatatatccatgtgtggtcttgttttgaagatttgattgcaacgaatttaatggtgcaattgaatcatgatttggataagtaatttaagagaaaaatcggtttaaagttcgcttaaaaagtttaacatgcatgcatgatgacgtcaccccgattcctagttgcttcctgctcctcagtgacttgcatgtatgtcaggtaggcatgactgaggatgggataacagcctgataacttttcccttccatcgggcgactgacatcaagcattttcaattttatatccctcaactataatccgagttccatttgtccattactaaatttcaacagaactgctcgttggtttgactaaattagcgtaaaactatataaatttaaggtgttgcagttgcataacgaaaactacatatttaacgtgaaatttctcttagaaatatagatttaagatagagtgtcaaaaaataatagaggttaagtagcaatcatcacaaaaaaaaactacaggtccgtaacttacatagctcctacacaatggcggtgctagggatttaaactctacaatccatagttttgtgatagcttcaatattaaatatgtaggagtgaaatacatgggatggtgtcacttaggtccgtgtgaaaattgcacgtttagatccgtgaacttggtttaatataaccctggtccaatggtcctttgaccacgattaaccaccaaggtggcaagcaacacttttgtgctcagccccctccacatatatcttcgcacataatttgccctgaccagtgcatttcaacccaaatccctcaaaatatccctaaatcggctagggtttcgactgtgaggttagcggaaggaggccgagaggtagcggctgtggtggcctcagcggtgagattagcggcaggaggcagcgcggtgtagcggggttagcggtggcatagtgcggccggattagcggcggagacagcgcaatgcggcttgcactctaggcatccccatggattctccaagctcatcctcgccttgaagtcgctagaagaaggtgttgttgatcaagtgtccgctgtgcaaggataaggttattttggagcgcagagcaatgacaattaacgttaatcggaaccatattttctgtacatgtaaggagaagaatgagaggaaagaacgatttgaggattttttttttgggattctggtgtcactatatagcaacaaggagatatatgcgacgtgttgtgatgtggagggggctgagagcaaaagtgatgcctacgtggcatgccacgttggtggtcaaatgtagtcaaaggacgtttggatcgggggtggtacattaaaccaagttcacggatctaagtgacaccaccacataagtttaggggccggccatgtatttcactcaatatgtagttttgtgatacttgttctttaatatgtagtttttttataacttttccactcaatctttagtttgcgatataacatttaaaatttttagttttgcaatagtttggttgacgtatctataggtttgtgaaatttactctttgtccatttaactgcaaaagccgatattgagtgttcctcaacttttaaaaccagtgcaaatcgagtctctaattagttttgtcctacgacctgttgacttggttctaagaggcacatacgtgatgcttacgtgtcactggaaggagaatacatgttagtgtgctctcaacctttcctactacggagtacttcctctgtttcacaacgtaaaactttttagtattgctcacatctatatgtatataggcaatgctagaaagtcttacattctgaaacggattctgaaacggagggagcagggagtaggtgagtgatggcgcggcaagaagcaacggcgagtgacaaaggagcaacattggctgtggtgtgggaataagcaaagggaagtgcatggcagttctctaatcaccctcgctgccaccccctccttccgacaaccgtgtctgaggcatcgccgccatgccaaatccgatcgagtattaattagggacaacagtggtggccaaagtgagagcagtgagggtcatgccatctaggatgaaattggcatccaaatcatcgaggagcttgattcggactagttttgatagttggagaatactcctactttacactcgattatacggttgaaggatacaaatgaaacttgatatccttctggtgagcaaccgggaaccggtctgccggtttcggctgcgttatatactgtgaggaatgtaaagtggactttttcccttccggtgaacacacacgaggagtggttgctggtggcggcccagggcgtcacacaaacgtgtggcctttttatgtttcactcaagttagatgatgtgagcgttgttattatgtataaacacgattaatcagtattattttcattatttatgttggtcaagtatgatgtttgtgatgaccgtggcacggagaagccgtacacaatgagactctacagatgctttccatcggatgtcaactcttgtactttgcaatgctaacaactagtgctagctatagcctatagctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaaggggagatcgatcgcgatcggagccgatttgatcggcggcgggcggcggccatggccgtggtgctcggcgcgttcgtgccggacaccgcggcgcagtggcgcagcgtggtgaagggggaggtggcgcggcagctgggcgtggaggcggaggcgaggaagctgggggcgaggctggagaaggtgggcgccgcggtgcgcgacgccgaggcgcgggtggcgcgcgggagcgacgccgcggcgcggtggctcgccagggtgcgcgccgcggcgtacgaggccgacgtcgccgtcgaccggtgcagggccacggcgcgccgcctgacgaggggccgggagcagcagctgcagcagcataaccaggtgagatcgctagccttgaattccgacaaaagcaagaacaccttggtgacaatggcgtcgcagagcagctaatttttgcttcgtgttgttctccggcgagaaggcactgccatggctgctgtccacctgctgcgacgtggccgagccgcgccgcgacatcgccgccgacctcaagaacgtcagccagaagctcaagtccatcatcaaggagcagcggcagctgcagctccaggcatccgtcgccgatcacactgacgaccatccacggaagatcctgaggcaccggaaatccgaacccaccgacatcgacatcgtcggcacggcaatggaggacgacgcgcgccgcctcgtgcgccggctgacgcagccagacagcggcggcgtcgtggccatctacggccccgacggcattggcaagaccacactggcgaaggtggtgttcgacagcgagagggtgaagcgaagattcgagacgaggtcatgggttcacgtctccaggggttgcgtcgaggacggcaagcgagaggccgcgctgctctcgcaggtcgtcgaggccgtcgttgacggcggcggcgccacgacgggcgccgagaccgtcgccgagctggagagaatgctggccgccctggtggcgaacaggaggttcttgctcgtgctcgacgaggtgaggaacggcggcgagtgggaggagttggtgaggcggctactcgagcgcggcggccgcggcagcaaggtgctggtcaccgcggtcaccgccggcgtcgctcgggacatgggcgccggccacgtccaccgcgtgaacaggctcggcgaggacgacggctgggcgctgctccgcgtggcggcgtgcgtcgccgacgacggcggcgcggcgctgaggggcgtcggccggaggatcgtcggcaagtgcggcggcgtccctctggcgatcagggcggtcgccggcgttctgaggacgcgggaggcgatcgccgaggagtgggcggtggtggacgcgagcccggcgtggaaggtgaaggggctccccgacgacgccatgaagccgctgtacctctgttacgacgacatgccgtgccacctgaagcagtgcttcctctactgctcgctgttcctctcggacttcgccgtcgacaggagatcgctggtgcagcagtggatcgccgagggcttcgtgcagatcaggggagacgccggcgtcgaggaggtggccgaggagtactacgacgagctcatcggaaggaacctcctccagccggcggaggccgaccggcacggctgcgtcgagcggtgcacgatgcacgacacgctgcggtccatggcgcaggtgctctcccatggcgagaacctcaccggcgatgcgcaggcgcagcggctgcccagcgacggcgacgcccccttcgcgccacggcacgtctcgtttccgaggaaccaccttgctgcaataccagaggaggttctgaagcttgagggtgtaagaacgctgctgctccagagaaatccactgacaattgggagcaacatctttacaaggctgctatacctgaaagtcttggaccttactgaaactgcaatggaggtcattccagagactttggggaatctgttatacctgaggttcttgaacctgtcccagacaaggatcaaggcgcttccagaaaccatttgcaatctgtggagcctcaaattcttgctgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttcaccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattgtggacatggagagccttgaggctgttgagaacattgctgcactgagggaactgagtgtttggaacacccccaatctgaagaaaatatgcaacttgccttccctcgaagatcttgacatatgccattgtccgtcgctggagactgtggacaacatcaacaggctgcaagaggtgcacatcttcgatcatgaattgcaggagatgccgagatggatccaggcacatgcatcgaagctctgctcactggaattcatgagcacaactgaactgttgaagaggtgcttgattgatggtcctgactggcccgtgatcaaggacattgcacaagttcatggatactcgaatgactctagttacatatactattccaagagtctcaagatctttgagggcagcgcgagtattcgagaaagccgtgatgcagaaaggagtgtggcagattctgataaagttgacgatgcatcaatagagagcagaaacgttgatcgagatgcagaaatcgatggcttcttcagctcaaaattagtggagacaggaactgccaggagtgaagacaatgtaccggataggaatatggagaggttcatgacaagatccactggccgccgattgcataagctggaagaagtccccgaaggagatgaggatgaggaagaggaaggtgcagatccagtagttctgattcctgatgatacaactaaatctgacaccgtactggagaaacttcatcctgttgttactcatgatcataatgataaagcgggatccaagatgaaaagggatcctcctgcaaaaactgctccaggtacttctgttattcaatctgctgccacaatgtgtcataagttggtccgagaagggtctcaagcaatcagcattactgaaactgatcaagatctgagcctcgattcatttcgaagcaaagaacatgcatctagtaagcagaaagttgacacatctggttctgtcatagaaaaagtaaaggaaggaagatataaatctgcaaatatcaatgaccgtaagcacattgagagagttcatgactctgcaaataagatgtcaactacttctgtggagaaaagcattcccgaaacagtcaaacctatgaaagcaacaaagaataattctaaagcaacagactatcatggaactgagaataagtcacctgatagtttggcttgttccaggcaaacaataagccagatagaaaaggatgtttctgatgctgataaggctgcaaatcatccatccagcgcgatcacagagaatcgtctacacaaagcaaatgagatcgatgcttctgctactgcaataaaaactgaagtatcaaagaaatctgctggtgccaatatttgtaataccttaaaccctgcagattcacaaacagtacatgctactgacactgctcaagatttgccttccagtttactccatgatgacccacatttaccagatgttggcagcagtacttctacttctatcagtgacaattgcattcagacagagagcagcaacacaagtttgtcggccaacttaaataatgaagaacctaaagcgaaaggtgttaccaaaactacttgcgcatcagggccttgcaaactgactgccaccttagactgcaaacaacagactactaatccaagtgacgacacagatgcatccatgaagaagatggcgagcaacatctctgagaaagttgtcaaaacattgaaacgcccacatgctgaaacagtgaatattactcgctcttcatcactgccaattgaccctaaatctcatgtcattgataccactgcagcaacgaagaaactagaagctaccctgaaaaacagatcctcaagaaatgcagcacctggccttgccgatgacaaaaccccagtatacaacgactcccatcaggcaccaaaggtgtataccgccatctgggccgacaccgacacggacaccctgaaagcccggttcctcagcacgatgcagcactaccgcaggatggcttcgcaccgtcgccgacgccatagaaagcatggctccaggaccaagtggagcatctggccagtgctggtggccatcctcctgatcatctcagtggcacagctgctgttcaccttctggatgtaccgcaagctcatgaatcaaaactcaaaagtagacgaacaatgaattctacactgcgaatttcatactttggatgaagtagactgcgcgtgccttgtgcgttcatatgttgtgttgtgtagctactagctactgagtactgactagtgagagcaatagcccaaaactttggcgggagatcgtgaattttgaagcagtttggcgccaaccattttcaaatggcgctttgctccccgctaaagcctagtagctctgagatttgggaagcgaaaatttggggggaatgaaaggggacagaatgaggaagaagcagaccaagaattacccgagcagaatccgatcgaccggcggccagaccaccctccaatctttcctcttcaaatccaggtagggaaagaagctacctcgaattcagattgtccccaatttttttccccatccttttcgcttcttacatttgcccttgaatccttcagcgttgtcgatgaggaagtgaagccgatctcgccgccgccggagaaggaggaggaggaggccatctcgccgccgcaaccgccgaagcgggagatcatccgagtcaccaccaaggcgatcgtcaaggtaaccaatcgaccaaaccaatccgatgcttccccttccttcgcggtgtaactctggaaatgcttcgggatctggcaggagaaggcgagcgcattctcgtcggtgggctcctcctcctcctcggggaagagcggcgccggcggcggcgccctcaacgcggcggcgctgttcaggcggttcaacagctcagcccccgtgccgagagcggaggccgcgggagacggcgatggcggcgtccggctggagatcgaggacatcgcggcgggggatcgccgccgcgagaccaggaagcggaagagccccctcggtgcgcgcctcgcctctcgaatcccatctccccctttcaggctttcaccactcatccgtgacgcgatgtcgatctccctcgcaggtggtggcggcggcggcgacgaccaccacagcggcggaagcggcaagcgcgtggtggtgctcggcgacgacccgaagccgaggcccgcggcgaggacgatgacgacgacggcgacgacgagaaggcagcggcgggggcggcggcatgcggggcccaccggccgcggcgaggagggcggcgaccaagctgcgtacaaccactgtaatctctctcccctctctcgttcgctctctcgattttgtgacggaaatttgaacggcgtggtggcttggtttcagacgcgagcggcggcgggtggtggcacggcgagatggagggcgtcgacggcgaggaggtggggtggaccgacgacatgtgggaggggatggggtccatcacgctcggaggcttggagtggcactagcagcagccgccgccgccgccagtcgcgagctccgccggtcgccgcggcggcgcagctcgccggttttgggtttcgggtttggaaggtgacatgcgttgttagccacggcgagctgtgggtcagattatgctatgtctaatgagattattatatcatatgttactccatttggcactgtttgaccactcgtcttattcaagaaatttgtttaaatataaaaaataaaaagttgtacttaaagtactttagataataaagcaagtcaaaaataaataaataataattctaaaatttttaaataagacaagtgataaaaagtgcaaacaaaaacttaaaatccctatattatgtgacggagggagtagatatcagtgaaaaacaaaaggggttaaaatgctgctgtgctaacggtataggagtattttgaagtactaatataatttatacgctttatatgtgagaaatgatcaattagtacatcccagcttaatcaaactctgctacggcaggcagaccaatgtatctctaccaaccacaacaaaaactattgttaaaaatttacaaatggataacaagcaataatagtatactcccgctctctgttttatattataagtcgtatactttttttttgttagttaaactagtttgtagaaaatataattacattttcaatactaaaaaatctcaaacgacttataatataaaatatagttaaatttaatgaatctaatttggtgttgcagttgttgctatttttttataaatttagttaaatactaagaaaaaatcaaacgacttatataagtataaaatggaggaaataccatttagcaaataatagcatgaagagagaggtgaggacaaatacatagcaaaataataaatattttttattcagtgttcttcttagtactccacgatgcttactatacctgatagaacatataaatcaaaaaaatttacttataaattacttcatattaataagccgttacagattataattgtaagccaaaaggtggggttgtttctaaaaaatcctgatcttttcttcaataagagttggatgaacattaagattttcgtggcacgtttttcaaactgctaaacggtacgtttcgtgcgaaaactttctatatgaaagttgccctaaaatatcatattaatctatttttcaagtttataataattaaaattcaatcaatcatacattaataccatatcgttttgcgtaaaaaaacttaattttcatcttcattttcaggagaaaagaacaccatctaaaatctacaagctagacccccttcatctacctattttcggcagtcaaccctacatgatggcatgatgcaaaatgccaccacgattcattattgatcatagttcatactccctccgccgctccgccccctaatacaaatgattttaatattttaattgtaagatttgatcacttgtcttattaaaaaaaattatgtaaatataaaaaatgaaaagttgtgcttaaagtactgtagataataaattaagtcataaataaaataaataataattctaaatttttttaagtaataatggtcaaacagtgtaagcaaaatgtcaaaatctcttatattagaggacgaaaggagtacttcgtaaacttaaattcgtgtcatatggtatctgcacttcacttcactaacccctgagccagcaatttgatttgaactgctctctcggagatgatgaagccgaggaaacagttggtgctcaaacctcatcttttcaaatcttggtttgcggctttttcatctggctttggggtaccagatggtaaggaagtgactccggattatctccaaagattcgtaaggtgaactgtcttgcttcactctgagaccaacccattaggcgccatgattcttttcagctattggctatattaaattattgcgatcacgctttttaaaattgctaaatgttgtgatttttgaaaagtaaaattttatatagaagtttctttaaggaaaataaataattttatttttaattttgtcatagttaatatttaactaatttctcaattaagtgccttttgcgataagtcaattgctccttcctccaacctctgaaacgaacagtgctaagcactactccctccgtttcacaatccctccgtttcacaatgtaagtcattctagcattttccacattcatattgatgataatgaatctagacatatatatctatctagattcattaactttaatataaatatggaaaatgttagaataacttatattgtgaaatggaggaagtatttgtgatttgtgaacatccaaaggacattgtggtgactcgaaccaccattcagttgatctgtaaagcactaataaagcgtagaaaaaccactctttggcaaagaaacaacgtgcaaagttcaatcacgcataattagaaggcccaaatgctaatcaaccgccaagtgtagcaaaattcctcatttgcgtcttctcgaattaattagtcgatgtcagtgacagatgacacaaaagcaaaagtcaggcagctcatgtactccctcagtccctatatataaagattttagttgaatgtaatacatcataatgcaacgaatctagatgatcattggtccatttggatgggatagtgcgccaacagcgagaaataaatttcttgtttgggccttgaatggaaattggaaaacagaaacctggaaggaatcttttcaaattgaattatttcacataatcacatggaaggcttcgttgctccaaacagaagtaaaactgcaatgcaccttcgaacatctaatattcactcaatttaaaacgtactccgtccgtcccaaaaaaataagagattttaaacgaatgtgatatattttaagacggatggagttctatgagtttgttgatttttccaataacatctgaccattaatctcatttaaaattttagtgcagatataaaaaaaatataacatatacttaacatacctttaataataaaaacaagctgtaacaaaataaacaatacgaccaatcgtatgttcaaaagtcaataatatcctataaattccaatttaagcttaaaaacgcagtgtgctcatagacaaaaaaaaagtctttatttccatgaaagagatagtaaaacattacaacatttcaatacaaattcataaaaaacaacaacattgcagcatttctactgtcagatcagatcctctaaaacgcggttaacctggacatgtttcaaaacaagaactgctattagtaacacacacgaactcctcccgctcctcctaatgttgccaatttcacacgatcgccgcaatttcgcagaggagaagatgaactcatcatcatcatcatctttctcgccatgaactcgatctcatccttcacctcctgcatctcgttcagctcccagaagatgagctcgccggcgagcttccgccggagctcgtgcacgtcgtccatggtgaacccccgctccagcttctccccgtcccagagctccatgcacttgatcgcgaagagcccgcacgacgactcgtcggtctgcgccgggaggccggcgaccatccgcagcttccatccgccggcgtccgcctccgcccccgcccgcccggccgccgccacgcaccgcgcgacgccgccccgtatcttggacatggcggcgtcgtagaatctggggccgaagcggcggccgtagttggaggagtcgaggatccggtactcgccggcggcgacgtcgagcgccgccacgaagaagtgggactggtggttcaccgggaagagcaccgtgtcgtgggcgaggtacctggcgcccgtggccgacatgtccgcgtcgtgccccgccgccgccgccgttcttggcgggagggagctgacgtactccagccagtcctgctcctcgacggagccgaggagcacgcgacggccgttgcggcggcggcggcggccggcttggcggcggcggaggaggtcgagggcggcgtcgaggagcaccccggtgatctgcctctccgggccgtcgcgggacaggggcacggcgaggcagcgcagcgcgtcggcgcggacgcggacgcgcggccgctccgacgagaccagcagcttgtccttgcgcccgccgtgcgcctcgacgtacgccatcgtcgcctcctcccgcgcggcgtcgacggccgtgctgctcgccgcctccgagcggcggcgcgcgttcttggtctccgcaatcccgatgttcgacgccatggctagctgacgcacgcacgccgcgctctcacgtgttcgtggttcgtactcgccggagttcgatcgtagcggcggcggaagcgcgagttctgagctccgacggggtcttgagaggcgaattcgcggcgtgcaaaggaagaatctcgttgcttcgacgcgacggcgacgagataaatggaggtcggggaggcaaaggcggtggaatggtggggatggtcggtggcgcggctgcaccgaccgaccgagcaaaagtcggtttccggaattgacttgtctggagaagcgggctgtacttgcaacggcgaccggtgggcccaggtgtatatctatctactgctggcccactgtaagcccatgttaatgaggcccaattagatgggccgcatcaatgtggtttccggcccaacagtggcctcattcccggcctcttcaggcccagaatgtatgcgtcagacgtaggccgattcctcttcaggcccagaatgcatgcgtcagacgtaggccgattccttttcagccccagcattaggccttgttcgtttaatcccaaaaaagggatttgggggagaatacatcacaatagatatggaaaaatcccttccaaatcccaccaattctcttgtggaagggattaaccgaataagatcttaatgggacccaagaaggatgccttccatttcccttcaaaattaattatactccaatcttttatcaacgactttttcttcctaacgaaatgcgagagggcgaaaggggtgaatgggaagtactccgtgctacccgttgccacaccatctccagctatacggatcacaaccactatcggctgccaactatttgtgtctattgttcgtcatcgccttccaaatcaccttacgtcgccaccacattctgaacacttctagtgtgtcgtaaagccactctgccatgctatcactgtcttccgcagatcgtcaaagtcctcgatgctcctagagcatcgcgaagccatccaccatggcatggacttgcctttactcttatgcgttcatcggagatgctccaccgccatccacatctatccgtaataagaccttggtgtcgatgcttgcccgagagctgatcatttgttctactccttcccttttcagaatatttttgtaccccttaatttgaaatctcagtgttaaaagttgtcagctagtggttcgatgctcttacgactgatttttggaatcaacacgtgaccaacaacacatcttcaccagtgatttatgaagaggagttagggtgtgtttagttcacgctaaagttagaagtttggttgaaattagaacgatgtgacggaaaagttaaaagtttatgtgtgtaggaaagttttgatgtgatggaaaagttgaagtttgaagaaaaaatttagaactaaaggtcgtttcacattttcctaatcaatcttcctaaagtttaaccatacttgtgaagaaaaatagcaacacatataacaccaaattaattttgttaaatctaacattaaatatattttgataatatatttgtcttgtgttaaaaatattattatatttttatacatatttgattaaaacgacttataatattaaatatagaaagtaataaacaatactccctccgttctaaaaaaaagacaaactgtgggtttccatgccaacatttgactgtccgttttatatgaattttttttataattagtattttcattgttgttagatgataaaacatgattaatattttatgcgtgacttatctttttaattttttcataattttttcaataagaccgacggtcaaacgttgaacacagacataatagtttgtcttttttttttttggatggagggagtatgaattagagagagtaataaactgttaaattgcccggaagctcgtgcgctaaacgctgagatttattttcattatcttaaaataaagcacagtattaattaagaagttaataatcgtattacgattcacaagctagaggagggttcgtggacacatcacggttttccactgagcgcgctgcgcgcgacgcgagcgactcggcgatgcccttggcgacgcaatacgccacggactcgatggtgatcatcgggttgacgccgacggccgtcgggagcaagctgccgtcgcagacgtacagcccctccgcctcccagctctcgccgccgccgtcgacgccgccgtgcttggcgctcctccccatccggcagctccccatctggtgcgccgaggcaaggagcgcccacttgtccgaccccgggtgcatcggccccttctccacgctcacctcgtccaggaacgcctccacgtcctcgtcacgcgcgcccttgcaccggaggcgcagcccgtcgctgcggttcgtgcccacctcggcggcgccggcggccaccaggatgcgcagcgcgcgccgcaggccggcgcggagctcgccggcgtcgccgcggctcggggtgaagcggacgcggccctcgccgccgacggtgcccgcggcgcggtcgcggacgagcaccaccgcgtgcgccgtgcgcgcgtaccgccgcatccgctccttcatgtcgcggccggactcccacggcaccacggcggcgaacgcgcccgggccgagcgccggcgtctcgatgatggtgcggtcggtgacgcggtgcatgctggtgatgatgccgccctcgtaggacttgcccgggagctccgccgtgctgtccgggaagtagccccacgccatggacccgggtggaggtgaaggttccggccgatgtggcggttcttgagcccgctgttgcgcagcagcggcggcgtcatgagcgcgccgcacgccgagacggacaccttcgcctcgatccggagcttcttggtgatgcctttgcccaagcacttcgccacgacgccgacgcacttcttgcgccggccgccgccgccgccggtgttcgtctcgaggatgaaccgttcggccttgcacccggtcaggatgacggcgccgcggccgacggcgtcgacgagccacgtcgtgtcggtgccgcgcttctcgccggtggggcacccgaggttgcagctgccgcagaagtgcccctccgacgagttgcgcgacacggcctcgacgcgcagcccaagcgcctcgcagccgcggcgcaccgccttgttctggaacccctcctcccggcaccggccggtgacgccgagccgagcgcacacggcgtccatggcctgcacgtagccttgccccccgaacagagggagcccatggtcgttcgaccactcctgcaacacgttcgccggcgtgcggatgcaggccgaccagttcaccgccgagccgccgccgaccgtcgcgccggcgaacatggtggtcgtcacgttcgccgtgctgaacacgccgccattctcgtagaggcgctccatggtcgggccctccagcgagctgtagtccctggcggcgaagtagtcccccttctcgacgacgacgaccttgtacccggccgacgcgagcacggcggcggccacgccgccgccgcagccggacccgacgacgacggcgtcgcacagcaccgtgtggtggtgcgcgctcggcgacgacgcgcccgtcttcagcgcgaggcccttctccgcgagcgacatgagcaaggcgttgtcgtccagctgcttggtctccacgacgccattgtccagaggccggcacggcggcgccgtcgccggcgccggcgtcggcgttgcttctgtaggttcttctttctgtggctcttcctcggccgccgggacgctgtacccgattgccttccaacttgggttctccaagttctcgtccacctacatatgttgggaaaagaaggttaaatcgttgataattcgaattttctgtgaaaatgtgtatgcttgcatttcttttatgatttttataatggtcagatttttcatgaaccaaagaaaaaaaagtacaattcttaataaggtatggtaaaatactaccaaaactatagtaagttaacttgtggtaatttcattatgtaaaaattacagtattttaccattcttaataaggttccaagtgtcaatatattctatagtaagtttacactgtgaagtactacatccgtcccataataattgcatttctataaaattagagacggattaatagtaaacacaatttaccacaataagggcatgtacaaagatagagttaaatatgagctctacgttatatagagactagcatcctataacagttagagacaatatggtctctaatcattaatgtatcaaaatactttttcttacttttctttcctttctttcaccaccatgcaacaaaatttgctctaataaatactaagagtcgactctgagctgttgtcatgcataacaaccatacacatttctctttcttccatgtcatcaaatttacttgcatggcaatagagagagaccactaataaacaccgttgtacgtgcctaagacggattcttaataatgcaattattatgggatggaagtacttcacagtctaaacttactatatgatatattaacacttggaacctaccaaaccaggagtagattttttaggggctatctaaaaaaaactccacaagtttattatgtaaaaactttcaaatgtaactgtattgtaatataattataccgtaagtatattttaattacattgtaatttttatgtaatttctgtataagtattaaaaaaatatatgtagcttgaatcatagagattactatttaagttaaagagtgattacatatagttgcactacatgcttatatttgaaagttttttttacccaaactttttttagcaatatcctttttttttactatgcaaagttcaaatcgaaacaaattcggaaagtacgactagttgtaaggtggtggagttgtggcctcgttggtgtatgactcgactccacccgttagggttatcgatgaatatacgtgagtgagctttcaataaaaaattactagttaagctagggatatatcacccgttcatgttttatatgtcttacgcgtaataaaaaaaaccattttcgttagaattaacattaccgcggtgtagaagacgaagtggcagaggaccttgatgagggcaaagatgatcttgagcgcttcagcgccgcctcccgccgctccaccggcatgtcggcgaaccggcgcacgtaggggaactcaccggagacgcaccgccggccgcacagcgccagcgtgccgaccctcgtggccaggatccacaggatgatcctcaccagcacccctgcctcccagatgcaccgtgtcatggtcagctcagcaaccttttcttgcaagagattagagacaaagagaaaaaaaaatgttaagttaaacacaacttgttgtatatcaaagttatctgaaatagttagaagaatcagagatttttcagtagttattaaaagacaattgttcgagagttgacttgaatagttgggactgaaatgtgcaaaaaataataataataataataataataataatttcgggcctattgtccgaagtttcttttttcgaaagaagggggcaaagttggttagttggttagtgtagctatcataattagcacgagaaaactacgtctacgaagattagatcatgataaaaatgcactgcatctaatgtttcagttaactgactgatcaaatgccaactaatcaactcgaagaattggagtagctagggtgaagacagatggaatttctgttagattgctacagcttatcagggcttgggtcgagctgtgttagtttcctgttagtctgtaatgggcaggttggatgtttcttttgtggttatcggctagggacctggtctttctatcgatagctatctctcttttttttttcaagacttgctgtagtttattttcatttttagtaatgaaaatgggggtgcttggcgccctagttctaaaaacactaatcaactcgacactggcaaaaagtattttttaacaaaataataagtggacatatattgaagctttcaaaagttttaaaatgaacacatggagaaacaaaaattgagtcatcaggttgatgagttgattatcgtctctgacagcgctgatcagtcgcgacgaaatcatctcaatcaaatcaataccatatgcgtcgtcaacactgatcgatgacgacgcatgcgctcacctcgtcggggacggtggactcggcggcggtggcgaggtagaaccgctcgacgtccatgtcgccgccgccgcgggcgccgtcctcctcctccgccggcagcgccgggatgagcgcgccgcacatggccctgagcgcccccatctgcgccgccccgagcccgtgcgtgtaccgctcccgcctcgccgggccccgcagcgccgggtgccccctcgccgccggcgccgcctccttcgccttctgatccatggcctcctcccgcggcggcgacgccattaaccaattccctgcagctcgcgcaagctcagctgctagctatagcacacgtacgtgtgtagatatagagtaagtaccgaagtacgtaccggagcttgcggggcacagcacgcactagcctcgcagcgacgtcgacgtcgatctctctctctctctccgattttgtgaagctgacatgtttgtacacacgtatgttagagtacagtataccagagaaatcttgtgtagctgtgtttgagactttgaggagaaggagatagagaagattggaaagatacgcaaaacgaggtgggctattagcgtattattaattgagtattaattattttagactttaaaaatagattaatatgattttttaaagcaactttcatatatattttttttaaaaaaacgcatcgtttagtagtttgggaaacgtgcgtgtggaaaacgaaacaaacaaactccctttgttctccgaacaaacgcatacattatattagaaatctcttacgtgacctagaccgctgacacgttaattagaggaagtaacactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttatcaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccccggttggtgttaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaactttatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaaataaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtattgaaatggaagaagatgaagtggaagacgacaatattccggactttgctcagtatgttggatttgaaggaaatcaaacgggcgaggaggaaatagctgctgatggtaacgacgttgcggatgatcttggtcagatgttacaggacgccagggaggactgcgaaagtgaaaaggaggcccataaattggacaagatgttggaggaccacagaacttcgttgtacccaggttgcgagcaggggcacaaaaagttggataccactttggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaatcatgccctgtttgcaaagcactacgatacaagattagacgggacgatccaggagaagttgacgggcagctaacaaagaagagaattcctgctaaggtgatgtggtatttccctataataccatggctaaggcgtttgttcaggaacaaggggaatgctagaatgttgcgatggcacgctgaagagcgtcaacaggacgggatgctgagacaccccgccgatggttcgtagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacagtaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaattctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaaacatatggaacaacgcggcgaccttcacccggaactaa

SEQ ID NO: 74877 - DNA, 1046 bp, Oryza sativa
ttcctctggactgggttcggtttcttaccaattgatcgcggtaccgtaaggctttggcgacactgtcctccgcatttgcaggctccatctccactgattgtctcactgcatggaaaaaaaaagcattgtgtcgttctgtaatttgagcaagagctagcaatagataagcacctaatccaaagcaaatctaactgataaatctacctaatctcaactagcacttcctatgctcctgtctgcccaaataaaatgctgatttgcatgtaacttcgccgttcaatcccgttgaaacgcacctgccgttgtgtgacaaatcgtcgggtcccagtggattgaaaaaattcagtaattttcctgattacatcatcagctgtgagacacctgcgtgcagtacattaagaaaattcagtgtttgatcaatttcatccattcattcattcagtacagtagaaaatatcatccattcagtgtttaagaaatttcacatatagcaacctacaaatgaatgtgctctcaggtgatacacacatatgtaaaatcatgtgatgaaaagcaacataaagggaaattcaatttcttcagttccatggcatgggacaaatttctgagtgtgaaaatcaaacaaatcaattagtgttgagagagagaaagagagagagtactgcatccaggagttggggccgcgtcgccgcagcctggagacaaaggcggggtacggagtgagggcagggacggcggtggcgcggttcagggaagaagacgggacatggagttgggaacgcggcggcgcggccgggggtggagaaggctgctcgcgcgccgggggtggagaaggcggcgcgattgggaaagaaggaggtcggatgcgcgcgattgggagaggagatggcggcgcgaccgggagaggaggagccgagttcgcgcgctcgtgtagataggagagggcaatctgttcggttgatggcataggtgggtaattttttcaattatctaggggtagtggatctttatccactcaataatctggaaaaagctcttttagagca

SEQ ID NO: 74878 - DNA, 2784 bp, Oryza sativa
acccttagattatcttaaaccctacttaggatatgattatcacaagtaatatataaattattagtcgagttcactctaccatgatctttccatgggataaaataaatacgatacacttaaaatactctcgggtgaaatgctacaatggtatatccgtgcgcttgcggatgaattctgtaaccataatatagcaggagtgtttctgcgccattgtttttagtaatgacgttaagaaataccaacagtagccttgttaagtttcctataatctatgcacatcctccatccggttacggttcgttgtgggataagttcattttgagcatttgcaaaaaccgtcattcctcccttcttcggcacaacgtggatcgggctaacccactcactgtatggtacgggataaataatcccggcatgcaggagtttcaggacctctttctttacaccttctcttatcgcattattgagccatcgttgaggttctctggagggagtactctcggggtcaatagggatacgatgaatgcaaagcgacaagaacagcacaatgcttttctaacacagtcagaagacgttgagtctcgactttggagagcttgtcactgattatgacaagggcttctttgtaattgtgcatgaaggcataccataggccttgaggtagaggtttaaactcaagcggaggtcgaggtggcggttccaagattggaagatcgagagtctcttcgggttccgcttcttccttgatgaagtcagggacttcatcttccaaaagggcctcgggagactcgtgaggaggaactgttgtaaccttctccgctgactcaatctctaggagagaatcgatcaaggcgaaccttgcccgtgagaatgggactgagaattcattccctcccaaagttatcttgaggctatctagccggggtgtgcttatgaggagttgctcaatgggaagcccgattagaatgtcaaaatcttggatttcaaaggcatggacatccaagactggctccttgtcacgcccggaaattcactagtaatttccgaacttatttgtgcataaaacagtcatccaggaatcagccgaggtacataaactgacaatttaatatacaaatccatcaaaataactaaagcaattaatacttactgaagaggcacttagtcctcacaacgaagaaaactacagcggaaaaataaaatctagcgaaactccggctccactcccactagcaactcaactgggtataagccaaacgtcttctccttttggatccttttcttcaactgaggttgattgattattgcaaggtgagcatatgacatggactccctagcgacccccacggacttctcgccgcttctcagtatggtaccccgcaatgaatcatgctatacagaagataaagccgttgcccacgctggcttgtggttagcatggttaatgtctcacaacagtagctcgcaaaccggtccttaattgtcatgagcacgaccttcaaaaccatgtgctcacaacccaccattaacaagttttaattatcaattaattatcataacacgattaaccatcgtgagctaccattaaatataatcataaataataatgtagtatgattcatcccattaatgagctaatgtttctaagcatggctaagcaattatatatatatagcttttagctgaaccaaaccaatatataaggttcaagctaatcaatttgttacccaaggtatcaaggaatagagtaatcaatgcaaattggccataacaaaggaataggttcacaccacccggtgacattcgaaaataaatgcacagttgaaataaatagagaatttaaatataggatcaacatgctcaaaggaattgtgtttgggatctgtgtgacttgccctgcaataatcggtcttcaattagtcttctgaatctcttccgacacactcacgagccttcgcaacgacggaaacgacaagctaacacgcaaaacggaaaaaaagactaataaaaaccaaataaacagtacatataaagtaaacaaacatgtagatcatgattttaagtgaatttagcagcttgaaccactcgaatccgagttacgatgatttagttatgaattttctaagattaatctgattttaagatttatttttagaagggaaaaaggcttcatgacatcatcgatgatgtcaacaccggcgagaggctcgggacatcacggtcaccggcgatctaggtcacgacggcgagaacggagggcaccaacgcgacgagcacgacgcggggaactcactgaggggcggcacgatgacgaacgacgatgggagacggccggtgacgagatcgaatcggcgacgggctcgacttgacggcgtcagaggcgctacggcaggcttcggcttcgacccaggggtcgacggtgtgcagttcctccttgcgaagctgggagaggcgacagcgcaggtcgacgacggccgaggcggctgctaggggcggctggagcggctgccggcggtggacagagaagacgaacgcggcgacggcgctacaagcgacggcggagagagggagaggtgccagccgaaagaggagagggaggggactctatttatagccatgggagagagatcgatccaacaacgagagaatcggagccgggattttctagggtttggtttggagagaaaaacacgaatcgagctcgattctgcgttgatttcttcgggataaagtccgattcttgggggaaaagataaaggaggataacaggaatatttcccctca

SEQ ID NO: 74879 - DNA, 26006 bp, Oryza sativa
catgctcatgcttggtcgccggcgccgtgaacgtctggtaggtcacggtgccggcgccggggaagacctcggcggcgcggcaatggcacgccaggccaagcggctccagggcttcggccaccggcgtgcagagcgacgacgcggcgctggaggtgtgggagatggagaccgagacggtggccgggcggaacgcggcgacggcgcggcggatggcggcgagcgcggcggcggcgtcgtcggtggcgcactcgaagctggcgtagcagtggccgtcctccggcgtgacgtgcacggtggcgtagcgcgcgccgtcgagcgcgttcatggagtagccgcacggcgcgaacgcgtaggcgcacaccagggagcgcgggtcattctcgtccaccacgccgccgatccccgacgccgccgtcatctcgtcgccgatggcgtggctggtccggccgtcgccggggcgctggtagaaccgcgcggccatgccgcggtccagctccgtcatgcacacctccgccgtgagccgcgccgcgccatccgcgtcggatgacgacgccgacgacgacgccgagtagacgtgccacctgtgcgaggcgccgggcgacgacgacgacgacgacggcatcacggcggagcggcggaagcggaggagctcacgggggagggcggcgtcgaggtacgccacctcgtcggcaaagtgggcgtgcgggaacggctgcgcctccgggaacaggtactcgccgcgggagtacctgcacgaccggagccggagccggagcgcggcggcggcgcggagcagcacgggcacggcgcggagcagcggcgtggtgccgcacgtcttgagcaccacccgccccgggtacacgaacatgctcgactcggacagcacgtacgcgtccgccgccgcgttccccgctgccgacaccacggcgcactgcgccgcgtcgagcacctcccgcagcgcctccgccggcagcaaccggagcccatgccgcgccacctcgccgccgctcgccgggagctcgaacaccagctccagccgcttctcgaagccctcaaacccgcaagaagccattgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgagccgcgccgccgccatcctggcatgccgcgcggtttcaggcagcggcgaggtgggggagaaagatggagggtggcggcggtgtcgggaaactagggtttcgccccccgtgttgtccgcgcatgcacgatgcccgggggtggggtggactgccttcaattgaaaaactctagtgggaatgagatcaaattcaacttatacaagttaaaaaatttagctgtgaacatacatacacattaactagttatggtttaatttcttgtttttgctacagtttgtatgtataagttgaattttaatatgcatttttgtaaagtgatatatcacgcattagtctatcttattattattattttatatgaagacatttgaaacaaagtattgaattctatgttatcttttgcaattcctttggaatggaaaatcctatagacattttggaggaaatttagtaaggaatccaacctattggaaattttcctctgagtctatctctcttatccgattcctgcatttttcctgcggtccaatcaaagctattccgtgtttttcctatattttacaatcctctattttacacttacatttatattagaatcgtttgtttttcatgttcctgtattttttgcattcctatgatttaaagggatcctaagtaattttagtcctcgtatatagtagcgacaaaataaaaacactaaatttttatgtctttcctagttagactggataaacttgtatagtcggtcaaggattatccataggttgaccggtccgtgcggtgcctatatccttgataaagcagctttatatataggatcaaattgtgatgctcgaagacgacaaaatgaagttgacagtgaacctcgcaataatattaagaaatgacctgcgcatattatgcagacatgcagtccccttcctctctgcgtgatcatgaatcggcgcacggtttaagttaataacaacgaagcaaacaaaacaagattaatttgcaaccccattggattatgatacaattcaatgtactccttttggcctgcatgcaatgagtgggccgacacttggagtagtgtgcatatgctgccaacaccaacaattgaaatcttcctcgatcgttgcgggtcctgtttgacttatttttatatccaagattttgtgtactcaaatacgttctttgttttatactccattcgtttcacaatgtaattctttctagcattgcccacattcttttagatatagattcattaacatctatatgtatgtgggcaatgctagaaagtcttacattgtgaaacggataaaatagtataatttggtttcactttttctaaataagtttcattgaaaaatgtagcaatatttataacaccaaattagttttattgaaattaatattgaatacattttggtatgtttgttttatgtcaaaagtattaatatgttttttttataaatttgatcaaacttgaaaaaaataaacttaagaaaaagtcaaagcaatttataatatgaaatagagatacatagtgcatgaatttgaatttgtgattaagttgataatgtctggataaattatttcagacaaaatataaaattttaaaacactataatttaacatataaaattcaaaatcagtgtggatatagctgagccaaacatgaccttaattaacaacttccaatggatcaactcgttagctaagctagtgctatgcacagcacttttgggttaattcgtgatcgccatggccaacctgcaggctaaactagctaatgatcgagcgagagcatgcatgcacggaagtatgatggaacccgccgacttgcaaataattaaacacactcatgtttgactagagaattgtcgtgctctgttttgtttgaatccagcttaattacgtgcaggaacttgaattttttcccccgaaatttaaggcggatatagccgtctaaatatcgtatattactagcgtgtgtgaattatgtaatttgcatttctgttccggtgtatgaaaagggaatggctaaatttaagataatttcagtcaccttcaatctagtattggtattgggaagggaggagaggtgaaactccccactaatagtaatgacgccaaaactccgacgacatttagatttgggaaggtgactccctggcaggggcggatctatagtaccatggccagtgtcaggcgacaccgacaactttcggcagaacctatagtaaaactgtttatccatatgttataacaccgatagatacgtcatgacaccaacaaattgattttttgaatctgccactgctccctggcagtggtagtatagctagcaataagaaggttctcttttccgaagatggtaataacgtcaaaactccggcagaaaaatctgagattaggttttatggtaagagtccaaatgggagcggaggcaagggaattgagccggtttcctcaagcttaaagggatggccttatgcaatgggcccagggtagaggaggatacggagatatcaccacctgggtgtgtttggacctctaggttcccaacccaaatctctcgtttttcgcgcccacgtttttcaaactgctaaacggtacgtttttttgcaaaaagtttctatacgaaagttgctaaaaaaatcaaattaatccatttttgaaaaaagaaattagctaatacttaattaatcacgtgctaatagatcgctccgttttccgtgcggaggcactatgttcccatcatccactcgcgaacaccagaggtgacggcaacatatcgactacatgcgtgagcacggagaagaggtgactctgaaaaacttagacagacagtcccttaataaaattcatggtccgttccccattaatctctatagctagctgtaaattatctgcaggaagcaatattgtgtcggtggcatgtggcagcgtgactgtcatatgtaaatcatcctcgtacatcgcacaggcgcaacagacgttggtagagggattctaatcattcgagtaggtgctaaaaagagtatccaaaaaggaaaaaaggcaagcaagtagagacaacatatagctagcccggtacaacatgatcatgcaatgtctggtaccctaagactgtactgttgtcattaaccaacttaatttgcatctctacaatgtagatacaatgctcatcgatcgatcggaagggtccaaagattttgtcagcagatctggagcagcagcttgagtggaagtgtctatctctgatttgctgtaattagagaaacaggtgcaaagaccggtcgacatgccttgcagcgcagatcgatgattgtatgcaatcctcatgtcgggaacacatacgaacaggccggcaggccctagctagcaaaatcatgggtttttacactagatcatgtgtgcttcaccctgtactgttctaaaataattcagctttttatatcaatctaaacacaatctatattgaaattcgatcatcgtatcaaatgaaaagtaatatttagtttagattgtaaagacatattggtagccatagctctcccatgatatattgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcatcaccaacaacttcggcaagatctctctcctagactcggagtcaaaccagtcgggagagaaccggatttcggtcccgttcgaattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtctccaccacgacagcgtcttcatcccgtaggcctaggcggaagtcggccttaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagttctcgctacaacgacttcaacgacttcgacgacttcgacggaagcctagatgacaactatacccctctctactttggcgttttcatggccaataatgagacggaggagcaacgccaagcccgggagaccgaagaacgtcgccgactggaggaggagcatcaggcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggtcgccgcgatcacccttctcgacaccctactcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcacgactaccgtcatccaagcctcagcatcaccggcgcgggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggatcgccgcgatgacgaccttgacggagttgcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgctgtcaccgcatcaaagcagtcgggtccgagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcatctacaagcaattcgcggatcaatacaccaagactgcacggaagaattctgacgaagaacaaagcacgtcaaggaagaaggacgacggtgacaccccggcaggttttcaagatcaccgcaaggagctcaaccatatctttggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaattccaggattatccgcaactccactcggccagatcaccctcccagtcacttttggcactcgggaaaatttccgcacagagaacatcagctttgaagtcgccaatttcgagacagcataccatgccatactcggacgcccggcgttagccaagttcatggccgtcccgcactacacttacatgatgatgaagatgtctggtccccgtggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgccaccaagacttcaaaaagtggagaaagcgaagccaagactaaaaagattcccctagatccctctgatcctactaaaaccgctgtaataggcgccgagttagattgtaaataggaaagcgcgctcatcacctttcttcagaataataaagatatctttgcgtggaaaccttcggatgtgcccggtatccctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccctttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttctcaacgcagatcggtcgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgaagcacagaaggccttcgaagatttcaaaaaactcctcaccgagccaccagtcttagcctcaccacacccgcaggagccgttgttgctgtatgtatcagccacctcccaggttgtgagcactgtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggttacatcatttccactcggtgatatactgcacaaccgcaaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagccggagtggttttgatttccccaactggagaaagattgagctatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcttgccttgacgacaacatgatggcatatcgacaagaggtacgcaaattggaagacaaatttgatggactcgagctcagtcacgttcttcgacacaacaatgaagccgccgacagacttgccaattttggatccaagcgtgaggcggcgccctcagatgttttcgtcgaacacctttatacaccgaccgtacctcataaagatactactcaagatgcggacactcatgacgtagctatggttgaagccgactggcgagagcccctcatacgatttttaacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgctgctgcacgcaccattgtcggcaaagcttaccggcagggttttttctggcctactgcagtgtccgacgccgacaaaattgtgcgcacgtgcgaaggttgccaatttttcgccagacaaattcatctaccagctcaagagttgcaaacaatcccgctgtcttggccgtttgcggtttgggggctcgacatggttggcccgtttaaaaaggcagtcggcggttacacgcatctctttgtggccattgataaattctccaagtggatcgaagctaaaccggttgtcacaatcacagcggacaatgctcgagacttcttcatcagcattgtgcatagatttggagtgcccaatcggatcatcaccgataatggcacacaattcactggcggagtttttaaagacttttgtgaagactttggaattaagatttgctacgcttcagtggcacaccccatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgggtggatgacttgcaccgattagaagaagcccgcgaagcagctttgattcagtcggctcgatatttacaagggttgcggcgctatcataatcgcaacgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcggcgtttctacgcttaagtttatcattgtacttccctatcttgactgtcaacatcaagttttcttcttgccgttgtcagtcgggggctattatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgttacaatcatgctcagtcagaatcagtcctttcatcatcagagttattgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattcttgggtacaaggatttggtcatcgctaatgccatgctagctcccatgcttccagctttcttgatgttcttgaagtatacatccggtgcaactcttaacttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgcgatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgggccattctggtggcttgcgctgtttgaaatccaaatgtttgaggatccagctatgacagtataaatgggacagatctagagattaccttttgatgaaccactcagctcgaagttggagtcctggagctgtgcaattcgttcccttaattccttctccgttttcttggcatactccttggcctcgtgtagctgttccctaacggcttcaagagttcccaaatgtggaaccagcttttctaaggttgcagtcttggcctcattacgaagatggattctctgcacggtggttcatggattagttttgctaacaagaaaacaaagttattaaaggcagtcacccggaagatttacattcacaatgcgagtggcttctccaagtgctttcttcagctggcacacttcctcatcttctttttggcgatttataacaatgccggaaacttgagagttctcgtcccaccatttgagtaagatagggggacgggagtcatcagccgcctttatgcgaggaattgtttcttcgtcatcgcctagtgttcctgatgtatttccaagacattagacgagtaagctggagttattcagaacgatatcacttgagaagatgagttacctgaggatgtgcctggctgagcgcgagatgatccttgttctttatctggagagccaaccaccgagtcatttccagcctttggtccttgagaagatgtcgcttgcgcttcaacttcagggatttcttgatcaggacctacatccgactggtttccagttgggggctctcgggttgttgcagtttcagttgttgccgactggtttccagtcgacggctggtcactcggattggccttgtcatccgaagcatgggcgccagtcggctggctttcggcagtcggctggctttcagcagtcggctcagcgtctttggataaatttggttctgtcactgccggatcaggatcttttccagttggatctatgtcggacggtttcctgcgaagtatcctttcgatattcagcgtaatttctatgagagaagcatatcaaagggagttggtgccgagaggtttatacctggacgacgttctaatctttggcgtttgacggccagccagttttttcctgggcatggtatgcttcgggagtttgttgggcgtgcccttgtccccagatttgttgctgtcgtcgccctcgtcgtcatcaagcaccagctttctcttgcgaggacctgtctgcccagccggtttggaggtttgaggttgtgggtctgacctgattgtcggccctccacttccctgaatggtgtgctggcgaggagatcgtcgctgagcaattgggggatcggatttcatcaatacatattcctgaataagatgcctccatggttagttaattcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtcaggttcttcacggttaggatcatgcttgccgtcgaactcaaaagctgtacgggatctttctttaattggcgccagtcggcatttgatgaaatgccgagtaatctgctctccttgcaaaccttgttctttgagttttaacatgcggtccatcaactccaaggcttggactgcttcatctccgattggaagggagttccaggtatcttggtacaccggaggaagacaagagtacccgggaagagcaggctcaggattctgaacgtagaaccagtttgcatgccaccctttgtttgaagtcttgaagggcatagagaaatatttttggctcagagttccccttagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggatttttaatcacttttcgaaggtggatttggacggattgatgaaccctagttcgccggcgcagctatttactgtagcaaggagtggggaaaatggcgagcgttccggcggggaagacgaagcgtcgcttggatctcggattttttgttaagggtatcggaggtgcaagtgggcctaggcctgaacagtacctcagcccaatacttttaacagcgtggcccattgtgttccttagggacttaggcatattttgctttggcaatatttatgcacacaatagtgttgcccaatgctgacaaaatcctttttatgcggtcatataattctttggagttattgcaatgcaaattaaaaggtgccctgcagaaaagcgttatgctgtttttgtaagcttttttaggctacaaaagctgtttgggttaacttggaatgacttgtttttatcatagtcatttccttggtatgttatatacctatttttattgtggtaacttgacatagcctaggctattagtctttttgttaccataatttttataatatttggtgggtaatctttatagttttatattcggatgcctgtccagtgtgttcattcgtgaaccttttcgagtgtaaaccactcggattctttttattatggctaaaaagcagtcggctagaatgcctctttaggcgccgcgtatgcttttgccatctaatgcatgattgtgttattatattgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacatatatggagtataacaaattctcacctattacctcttatcttaaccaatcataactatctcattttatttcttcatctacattttcatccgggacatctacatttttatcacaattaatcacaaccatttcttgtttaattcttgagacagaggggaactctaccatttttaagcagtgctgctataattatgtcgacacatttttttagtaaccacagtcgattttctgatcaattgatctccgttgagattggtgctacgattgaaataccaatgcactgacgtctttgcgtattgcagcgtgaagccaaacaattaaatttaattcctcatctcatcggcatgtattttcatgaaaaaaaacatattgtagggacttacatacatgctaactatttttttttcgtgaaaaaatatggtggtataaatatcggtaatccctttttaagttttttttggacgaacctccacctccccgctaatagtccgcacgtgggtccaccacaactccacaagcctgttatggcccacccaaaacaggcagcacgtccattaagccaccgtttcggcccaacaatacatgggccgcacatcgcttcaattccgttccgggccaaaccacaaacgggccacacatctgtttatttttttcccactaatttattaagatcaacttcgattcccaactacaagagatcaaaccggtcgaaatgatgaattagagctttctcgccggcgcccagccgtgccgccgccgtcgtcggcgccgtcgagctcccgcgcaggaaccccaggaggagcttgctgctggcctccacgtcggaattatagcaccttgatcgtttgacactgcatcccccatcttcttctttgtcgatctgtcgctcgatcttggcaagaaatccaagactacaactctacaagcaaattgagacttgctgtccatttacaggacaagagagctactcagtatatatctagccacagccatgcctccctaaccttccatgtccatgcagcagtccattagctaatgtttaattatattttaggttgatttattttgagacgttgagtggcagataaggcaggcaggcaggcatgcgtgtgcaaccgtttgcagcggcctttgtttcctattgagctttgcagaaaatgaaccggtttgtctattgctaacagatatatgcatggaaatttttgtggagcgattagatggagaagatgacgctaattaaaggggaaaattaacccgtgcgttcttgcggttgtgcgtcatgtgactgtctcgatctcggcgtcacatatcaaccaacaaaggcagtttgttcttgattctcatttctgaagacatgcgtcactgttccagactatctcgggctcatcttgattgtaacctcgatataatttggatgaaatggtttacttcaatttgcccccaacagcaagtatataagtttcaagaaagaagtctcgtctgaattctgaaaacggggacagtaacatcccatggaaattaaaagctattcatgaaatatgcatgcgagtttctaccttactaaaccaaaaggtaacaactttttacgattcttcgaaagttcaggttaattatgagttggaagttagaacaagaaaatagtcctagtttaaattctgaattacgatccttcaatagcttaatcctttcatcttgtcttatcctagcttaagctctgaattggggaagaacctgttatccgaacaaggtcttcaaaaaatgggaccaatctagaaaggattaaattgattttgaattaaggagggggtgaggccgtgaggctagctcgaacctggagtggtctagctcgcagcttgcgttactagccaggaagaccctgggcctttctctatccaaaccagggttttaaatttcgaaatcaacatttctgccgcaggtgagcgatagaaccgaaattttcaaaatttcggaaaaatttcgtacgaagttttttgaattttcgaaagattttgaataaatttgacaaaattcacaaaaaaaaatgcaaaaaaccgaaattttcgggcaagatgttagcatttcggtggggcgaaatttcgaaccgaaatttcaatccctgatccgaacaaggtcttgaaaacccctcaaaactcaacgaagcagtagatgattcatgcatatgagactaataaaaaaaatactcaaatataatgaaattatttagtccataaataatcatcatcacgtcgtcctaagtaggacaaataattaatacatgcaccgccatctataaagttcatcatcagttctacctggatcatgataacatggctatatatcacataattaagtagatattaaataattaagctccttatttgcagtggcggcatatacggcgagtggatcgatcgatcagaagagtttcccatcacggccggccgccgtcgccggcggcgagccggccggctgccggaaggacttggtctggttgaacaaccttgccctggtcatcttgatgaacctgtcagccttcttgttgatgtcctctttgatgctgtcgatcttcctgaaggtcggcttgggtgccaggttgtggtacaccttctgcaccgccacctcgccggcaccgccgccgccgatgccgccggcggcggcggcggtggccggagcagcagtactgcctcctcctcctgctcctcccttgcggatgatcttctggctctgccaccagctcatcttaatttgctctctaagctaagctactagctgttcttgcacttgcactaaactaatgttatttagctagctagattgctttgggatttttttgcttcttgttttttcttggcttgctttggttggattggatttgcacctagcaaatgggcgtcctttttatagccaatataatattctatattccttttgcattaaggctgcatatatgtgaaatgtcaggctttctcattgagttatttacttttttaatttcctccgaatatattggcctaacctaaccagggtcagggtgcgtgcttgtcaatcataattaagcatcaagacggtcatcaagctctgaagttatcaattttgtgtcacaaatgttttcaataaaattgtttaagacatacgaataactgatggcttttcaaaagaagtaaaaaaaatgactaacaatataaccttttattttccaggttttgatgtaggggtggataacgagccagcttagctcgtttgatctcattatcttaattaactagcatggtggcccacgcagattgcgcggctagcatcattatgttttctcccatataatagcatatatgttttctcattatattattcaaatatattaaaatgacaacataattttaaattttgcaataactttacaaaactactaatacgtaatattcatattatattttatatacgtgttagttattaattatttttaatatcaaattttagttatttgtaaattatatatatttctatatggactctagactcgtgttttaatatttcttttttttaattccgaattttctgtaaattgtatttctatatagactctatgctcttcttccaatattatttatttttatttctgaatttttattatttctaattgtatttctatctggactctaaactcatctttcaatattctttaatttttaatttcgaatttcagttacttctaaattgtattcctatagtgactttaaactcttcttcccatgtttttcttaatttcaaattttagttatttataaattgtatttttatactgactctaaactctacttttaattttattaaattttattatgtttattccaaattttagttagttttaaattcctatatggactctatactcaacttctaatattccttatttttttatttcgaatttctatttttttttcttcattgaatttctatatggactctatactctacttctaatattccttatttttaattccaaatttcagtatatggactctatactctacttctaatattccttattttgaattccgaatttcagttatttcataattgtatttctatatggactctatactctacttctaatattccttatttttaattccgaatttcagttatttcctaattgtatttctatatggactatatactctacttctaatattctttatttttaattccgaatttcagttatttatttcctaattgtatttctatatatggactctaatctcatcttctaatattccttattttttaattccgaatttcaactatttctaaattgtatttctatatggactctagtctcatcttctaagattccatattttttaattccgaatttcagctatttctaaattgtatttctatatggactctgtcttttctttttccctaattaatgtgagaatttatagaccatgagagcaaacatggaggcttctttttctattcctttaataatataatagatgagcctgcttggctcgacttgctaatgttaacaagctaaaaggttagcttgctcattaaaattataagtttgagccaattcgagccaagcattttgtcacgagctaatccaagccacgagttttgagttttttgttcacccttattttttatgtgtgcaagtcattttaaccgagagcttgaagaaacatgtaacactagctcctaatttggagttgaagttgtcagggttaacaatatctccttttcaaggtcaattaattgtcagttactccctccaattcatgttttcatgttgcaagttatgttagttttttttattatgaaaattggtttatatatatcttcggtttctataccaatatatattcaaatttgtttcgtgaaagaaaaaacagtatcaactgacgggacaagtcctcagctcctcttgaaaaatgatcgtctgaatgagatgttaaagacaaataatatagattctaacgaataattccgtaggtattatatcattatattcaaagcaagaaaaacccttaaataccaattccaaaaatatagcaccgctgtgcgtaccatccgctcctcccgtggtattatcaaagacgataactttttgtagaataagccagtttttaacataaaaagtttatcatttcgacaacatcaaatcaactaatgtagtacactggccctaaataaaaccaattttatttacatgggcattctcataagctaatttctaaaaatattttagttttgttctatatatgctatttttcaactttatgcattgaccgagtttatgaaaaatgcacgacaacaactaccatactaaattagttttgtcaaatccatcataaaatttatcttaatactaaatttatttataatctcagttaaacttatagttgttagacttaggaaaagaataaaatgtgcatgaaacgaagggattattttcgatgggcatattctaaggaagctggcgctagctgcgacaatcatcggcgccgttagtcgcagcacacggcattccatcgccatctcatcacctcatcgatgattccattggcatgcattcatacaggggcgtgatgctagtttcgtacttaagatcctgcaactaattaaccttaagctttagttccaccgttaatgccaatttccagttgggggttaaagctaggaaacgtgaaaaaaaatgagcacatttttggttcagcccagcattactcacttatctgactattgctaagcagttttggaatatcaaacgcccagatgataatcttaaagtggccaatttatcttcttttgtaatcagtttcgctacagcacctgctgctctagctaattgttcatcctttccacgtgtggtttctatattatatatggccgtgcctctcttcaatcatcatgattcatgaatatttggtgattgggtggataagatttggtcaaacttttggtacaaatattcggtcaaacttttggtaaaaaaattcaatcgaacttaattgcggtgattaattttgtggggaagttagttataaacttaaaaaattatgatagtatgatagtatgatagtattattcaagacagatttttcttttagaaaaaaacaacgtggtatgatctttgataaactaagcattcgagaaattcttgatatatttagatttttaaattgtactacttttctaagtcgtatataaggcggatctagggaagcccaaggcccagctaattaagtttctttaggtcaatttctatacatatatatattgtatattggcatgttatatatatttgtggtatttaaaaagtttatttaaattggaccaccatacttacttcctccttttcacgatgtaaatcattctagcatttcctgtgaaacagagggagtacaaatttggatacatacgccaaccgtcatataaagaaaaatggagggaataaatatttattatcagagggagtaagtttttttcttaacttaattgatcacctctgagtctcctactttaaagtttcctacgttatatattgtatatgcccaatgtttatttcatcgtgcatgcacaccgtaagcaaaagtagcaagcttaattttttttagataatggaataaaacatcccggcctttgctcatcagagctatagccaattattacaaaagtaacacccaaacactgagtgtagttcaaatgaattaaacacacccaacaaaataaaaaattaaactaagataaggagagcacatttattcaagtctatttgtgaatctccatccataatttgcaaagagttgcatgaccgttgtctcaagcctacgacatgtaaccttcgtaagctctcgatcatcttcacacatttgcagctgtgcccaaaatcggagccaatatatgagatagatggtgatttgtcaaaaaccatatcattcctagtcaaccacagagcccaacatatgatagaagctcctacaagtatgagtttactcttcttcttgtctaccccaaaacccaaccatcaaacatattagatatggtagtaggaaggtatagaccaagagagaactgtactgctctccaaacaaattttgcataatgacactctataaaaagatgttaaatagtctcatttttcataaaaaacatcttaaactgccattccaattttgtcttgccaaattatccttggttagcacaaccccttgaaacaagtaccacataaaaatcttaatctcaagtggcatcttaagcttccaaataatcttgtttctctcaatataactattattaattaaaactagatacatcgacctaacagaaaatattccattctgatgataattccatctaaagctatcagagaattgattcaattgaatatgtacaatagaagcacacaattcatgccaatatgcaagattctgatcaactaaatgatctcctaaaggaaacattaattgagtcgaacagatctcataacatcagcaatagtagaacttttccttcggacaatagagtataaagatggacaatagtagcaagcttaattatggattaataattaacctgttctactaccgaattagttcggcatgtggaatccattacagatcactaattaggcacgtttgtaggaatccaaatggatcatgacggcgacatgtgtatagcgcaagagactgtatatcgccatgcgtgtggccatccaagctctgagctatactgttaactatcactatacatagaatctgccaaatatgacgtcttatcggtaacgattagataagatttgcactggacggacaaaaactgatactgtgatgaccccgtatcaatgccggttcaagtgaccaaccgacactgatgtattcattatgattttttacatgaactggcatggaactaatatcaatgctggttttataattaaccgacaccaaaaacagagttaagccggctgtggtttcagtcgatctcgccctgctctccttcctcactctcttacttttccctcttctcttccacctcttcctctttgtagcgagcggcggccatctttccttgtctaatgatggctatctccctctctcctgtgatggcgcccctcccctcttcatggcgatcagtgacaccgtccttaacatagggatggcaacggggcggggcggggccggattgagttggaacgaccctgcatccactcctttgcgcgtctactcggccctagcctcggactggtggccgggtcaaaaatgagccccgtccccatccctccagggcccgtcactcgaccgggggcccattgcacccgtaggcaaggatgctcgacgcagcgacggtaagaagcagtatgtggaggcgccaccgtgtgccagcaggaggaggcggcgtagccaggctaaggctgatcaacgacagacggaggtggtgcgacgacgggcggaggcagagctgagacggcgacgagcggaggtggtgtggtgacaggcggagctggaggcggcgggtcaaggcagcgtgacgacaggccgaggaggagcggaaacatcagcgacaca

SEQ ID NO: 74880 - DNA, 2478 bp, Oryza sativa
ttggaaaaatgtcttaactccctcctttcacttgcctttagatgccgcgctacaagcctgagtacttgtttggtgttgagggatttgtccaagagttgcgtacgatgtcctttgccataggatttgggactgcccctttttatgcccagattcctcatgatcgtcacgaagaaaagtgccgagtcaaagtcaccttgaacagtaatagtgaagatatcccctcagagatgttcgaagctggaggaagaaactacatccatgcatgtcaggaggtggcaaggatcgccataggggagctccgcgatagctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactatgttagcagttcaagatcgtgaagatcggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgttaacgtaagtgatgatgaagaagaagaatccaagcacgcccattccaagatcgagtggggagcaactcaagatgatgaagacgaaccgaacgaaccttcaatcaactccgatgcccggaagaactagaatgccttgtcaagtcattgtcttagatcgttgtgttagttagtttgtttaagtttggttgtgtgtgtctcgcatgtgatttacatcagtggtgggatgtaagtgcatgcgtttgtttgctttcgagtgttaggtggttggtaagtttagtggtgtgagagtcttcagttttgtattaatgaaacacacttaagatcaataaaagttaaattaattctctgtcctaagtagttttccccggtttctcttcttgtgcttctgcccatgccagatggtgctcactcgcagcaacgggaatggccccaacaacaacaataacaacaacaatggagagaatcccacacttgcccaagtcctggctcaacaggcacagcttatgaacatgatgatgcagcaactccagaaccagcagaaccagctcaaccaaggaaacaacaatgctccgccgccgcagaacaagttagcagaatttcttcgtgtgaggccgcctattttctctagcaccactaatcctgttgaagctggtgattagctgcatgccatagagaagaagttggatttgctccagtgcactgatcaggagaaggtctcatttgcatcacaccagctgcatggcccagcctctgaatggtgggatcacttccgccttaataggactactgctgaacctatcacttggcttgagttcaccgctgctttccggaagacacatataccatcgggagtggtgtttctcaagaagaaggaattcaggtcgctcacccagggatctcgctctgtcaccgagtatctgcacgagttcaatcgtctggctcgttatgctccagaagatgttcgcaatgatgaagagcgccaggagaagttcttggaaggacttaatgatgagctttcttaccccctcatgactggagattatcctgatttccagaagttggtggataaggctattcgtcaggaggacaagtacaatcgcatggaacaaaagaaacgccggattgctcacttcaaggcacaacaggggaatagtctttaggaccccagtccatgccacagggaggttcttcgtctgttgttcgtccgcagcgtcagttcttcaacaacaatgctggcaacaacatccgtaatcaagctccacgccctgttgcagcttcgacacagcaacaacctgccaagaaggagcaaggcagcaagcccgtagtgtgtttcaactgtggagacccaggacattatgctgacaagtgtccgaagccccgacgcgtgaaagttgtccctgcccagagcaactctaccgcaccagcatccaaggctcgtgtcaatcatgttgctgctgcagaagctaaagatgctccagatgtgattttgggtacgttctttgttaactcagttcctgcaacagtgcttttcgattctggtgctacacattcattattatctatgagttttgcgggaaatcatgggatggaagtagaagatcttagacgtcctttgatggttagtaccccaagtaatcaagcactctctttgcaacgtagcccctctgtcagaatagaaattcaagaagtaccatttctggccaatcttattctgttagaatcctagggatggactggttagccagatataaaggtgtgatagactgtgc

SEQ ID NO: 74881 - DNA, 13559 bp, Oryza sativa
atgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagtcgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttacccattttgttcgtcttttggttttttcttctgcttcagcgatgtcccgtcgcattcctcccgccgccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcaagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggccctcgaggcccgtgccatggcgctggaagaacatgccggcgccgtggagaggagcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcaacggctggcggacagcctctccctccgcgaggcggcgcaggaggagcaggcgcgccgcaaccttgaaagcgtccgcgccgagagagccgcgctggagcagcgggctgctggcctcgaggcgcgggagaaggagctagacgcgagggcgcctatcagcggggcggccgcgggcgaaagcgacttagccgctcgcctcgcggctgccgaacacaccgtcgctgacatgcagcgcgcgctggactcctccaccggggaggccgaggcccttcgcttggcgggcgagatcgggcccgacatgctctgggatgcggtctcccgcatgaagcgcgccggtcggcaagcgggcctctggggaggccagacgtcggtgccccccaccaatctggaaggcctcgctccgcacctcaacaggatggcttgggttctcgagcgactccccgaggagcttgagaagaccatcaaggcatcctcgagggacctcgcccggggggcggttgaactcgtgctggcgagttaccaggcccgggatcccaacttctccccctggatggcgctggaggagttccctcccgggaccgaggacgacgcgcgcgcgcgggtcggggacgctgccgaccacatcgtcaacagcttcgagggctcggcccctcggctcgcgttcgcccccagctccgacgaggagggcgacgccagcagcgaggacggcggtggcgacgaggccggcgacccgggcgcatatgaatgagcccccaggcccccgccactcttatcttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgagggggggtgcggggttagcccgagccaaaacctgacacccgacccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacactctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgaactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcctgggtcgagtcagcacagggttagcctcggggccaaagggctttaagtgcagccttccctcagtggccttggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccctgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcatttatgtataacaataggttcctacgggggtaatgaacgcagttttttcctcatcctccctagccatgcgaatctgatggtaaccagagtatgcatctagaaaacacaaaaggtcgcactccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccaccacatcgaagctcacccgctccgtgcggaagttggcgggtccaccgaaggtgaccggtaggtcgatgtgacctaacggccacgtgtgccccggcgtcacaccgatgatcggttgtgacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggtcagaagctctcgcttcatagccttgaagctccggcgagagacgtgagcacatgctcctccatcgacggtggcaatggtggctccaggttcttggaaacctagatcatcatcaccatcatcaatgtcaacagcgggggccttcttcttggcctcacttcgccgtttgtcggaaggaaccgccggggacttgccgtcacggcgttcctgcctcctgtcctcctcccacttcctcgttcgctcagccaagtttttgactgcacgacagtccgcgagatcgtggagggaggtgttgtggacggagcaccacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatggttaggatgaagcctggcatatatcgatcggggctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcgtgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaggggcagagcaacagaaggctttggatattattaaggaatatcttagctctcctccagttttgatttctccacaaaaggggatacatttagattatatctatcggccggtgagaagtcaatcggttcagtcttgattcaggagcttgacgggaaagaaaaagttgtattttacctaagtcgtcggctcttggatgcagaaacaagatattctcctgtggaaaagttgtgcttgtacttatatttttttgtacaaggttaaggcattacctattgcccaatgaatgcactgtgatatgcaaggccgatgtggtcaagtacatgttatcggctccgattttgaaaggaaggattggaaagtggatattttccttaacggaatttgatcttcggtatgaatcaccgaaggcggtcaaagggcaagctatagccgattttattgttgatcatcgtgatgattcaatcggctcggttgagattgtgccatggactttgttctttgatggatcagtatgcactcatggttgtggtatcggcttagttattatttctcctcggggggcatgttttgtgtttgcctatactattaaaccttatgcaactaacaatcaagctgagtatgaggcagttttcaaagggttgcaattacttaaggaagttgaagccgatgctattgagattatgggggattctttgctagtgatcagtcagttggcatgggagtatgagtgcaaaaataatacattgatagtttacaatgagaagtgccaagagttgatgaaggaatttcggctggtgactttgaagcatgtatctcgagaacagaatattgaagctaatgatttggcccaaggggcgtcgggatataagccgatgatcaaagatgtcaaggtagaggttgccacattaacagctgatgattggagatatgatgtacatcattatttacagaatccatctcaatcggcttctcggaaattgcgctataaagctttgaagtataccttgttggatgatgagctgtattatcagacgattgatggggtgttgcttaagtgcttgagtaccgatcaggctaaggttgcaatcggtgaggtaaatgaaggaatttgtggcactcatcaatctgctcataagatgaagtggttgcttcgacgtgcaggatatttttggccgacaatgctggaggattgtttctgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgt

SEQ ID NO: 74882 - DNA, 678 bp, Oryza sativa
cccatcacgtgctcatgaattatcatgttttacatgcgccagagaaaattcccaaccttctctcctaaacgcaccctagttattggggaatttaactattgccattattagatttggcaattatccaatgctcatcttaaaattgcttttatttttttccctctaaggtggtgtttttttcaactatttgtcacatttgcccatgtaacatgtcaacatggtagtccaaggtagaaactatatggaacttagtagtcagtctccccctcacatggcgacggcgacgggttcacatcctctaccataatgacactcacattacaggcactgacgtgtgggacaatagaaggatggaacccatataacaatgactataatgatagtaacattatgatagaggatctcacccgacagcgacgatgtacaacccagcactggtgacacagcagtccaactaagctcgcgcaaatcaagtgaatttttggcaggaacacacaaatcaagtaaaacacttgaatcaatgagaagaagcacaaatttcccctagttatcgcttggagggtaacccattaccacccctcctatgatgttaagggaaacacagtaggggtgtaccatccattctattggacttatatatgccgctattgaacattaacaagcgggcctcgatcgcca

SEQ ID NO: 74883 - DNA, 4132 bp, Oryza sativa
cctttaatttcgctatatgcatgtcctagctctctgtccttctctgcaggtttaagcacgagctaggcgtgagcatgaagctagattctaacattaatttagttcaactgctagttaaagacttaaaagtttgaatttctgagaccatgtcgatgtacaaaacgtattatttgagtaacttttcaaatttcatagttataaatgatggactagaagattatactgatagcttatttctcttgggtctttgacccaaaacgaacaaaaaaggataaattattaatcctttttatgtttgtaaacaaaaagatattttactgctccttgtttggacttcagagtgaaattgaagtaactagagtcatcaatgaactgattgaatgagacagatgacaataacagctttgaacaaggaccttttgtgctaaaaagtgtagagttcaatctaaacatagtattaatgactgatgcagtgtgagaaaatctttaggtaattctgctaccgggaaaagggtatatcagtaaaacgtttaggtcacaactaaattgaatggcagtttggcgccatttagatcatgaagaaatatttttagttcctagaatgatgcatgatgaatatcatgattcaacagtagtactcctatatgtctgacaaaattgactagctagcctgaaatattttctgcaaactagagttctagaaacaagtgcattctgccatccaaccagggcttaaaattttggttcttttttttttgagaatttcgggcccctataagaaccttttttttcaaaaattttaccgttttgtgaatttaataaaatttattgaaattcagtcaaaaattttcacaaaattcaaattatttttgttctgaaatattacaaaatttcgaaaattttggtcctcctggtagattgtgctcaccgaaattataaagcctgcatccaacaccacgttaattcttcttgccctttattgacgtcctaccaaccgtccaaccagccatactaaaattttcagggttttgtcacacctatatcgtagaatctgagcaaatatctcttgtaacctacaagattgggttacttagaccactttttggtgtctattttttgtcatagttggaaaagcttgcatcatggataagaaaaggcggacaaaagagagattttttctttctttctgaaaaaaaatatggaactgtagcatgccctgattccatctcaacaaattggtgcttgtcaagttaatgtatctgttcttctaaagaatacttaaaaaaatgacttaggtacgaatagtttatctaaaactacatagtacatattcacgctcaatttttctatttcctacttcaccaagacgatcacagcgatcgtactacgttattgtaatgaactgatgtactcaaattttcagcctacttgtgaactacaagtgtctgactatgtctcagtaactgatacagggaaggggatatgtgtccatttcgcttacagtatcactactggtacagtagtacttgatatgaccaaagcgtgaattgaatgacttatgttgcaaggtcataattaactagggcttcagtttgatcaatcagtatgtcatatgattaaccatttcaagctggcgagatgcattgagatgcattgcaccacgaggcttaaacacaacgatcaaaaactgacggtggtttattaattagctatatagccaaacgagcaaattaattacctctgaggagattctccagcctgttgagctcgtcgacgacgggatcaggatggccatcgaacggaagcatatccttgctgacgccatgctcgacgacctctcccaagctgcccatcgtcgctcgatcgacctcctcctgtatgtcctcctgccctgccttttgtacacctttcttgcagttttgctagctgctagcacctagcacacaagataaacccaatcagctacactctatctgtctatctatctatctatctatctatctatctacctagctagttttgtttagctagctatatatgaaagcccagttgatgttcttcttcccacctaagtggaagaaagaatgctcgcaaagatcacggctgcccccgggagctgaatacttgcagtggttgcagtgctgcacgactaagcgagagtgggtttggttggattttatggaggcgcaatgcgtggggtttcttgaggagcaccccattgctggggctcgcgagcgcgcgagaaaggaagccgacggtgcaagcagcggatggatggatggattggatggaggcgggaggagtgcggttgaagcagagacaaatggagccgcggcctcacgccggctttgctgctgctgctgctgttgcatagtccagagctggcacgagagcgacgccaaaagttaacttctgcgatatgccgatgtattttcccttggagaaaatccagtactcctgcaaaataaatatgattgtggttaaatatatgtgaaatctgagtagctaatactccctccgtagttttagattataagacgttttaactttggtcaaaatcaaactgctttaaatttaattaaatttaaagaaaaaaattagtaacattttttacccaagataaatttattataaaaatatattcaattattgatttgatgaaactaatttagaattataaatattatactataattgtttataaacttagtcaaacttgaaacagtttgactttgaccaaacagtttgaccaaagtcaaaacgtcttataacctaaaacggagggaatagctagttaattaactactgctgtatataacttaattaatggtgtggcactgtaattctcttgctaatgatcggggtcaatataatatggtcctaactctcgtcggtgtgatacaggggtaacaaaaatcttagtagtaacttactacactagtggtgatatttgtgtcctttttgtatctgtccttctcagaagttcatcgttttgttgaaaaaaaaaatatgctagcatcatgcatctagttaatgaattaattaattggttgtttggtaagacctggcagtacaggaggatatggttaattgaatgataatctcctattatgaacacgccggttttgacgaaaagaaagaaaccgtgttaaatgcaattagctgtagctggctaagctaagatgaagtgatatgaacaaggccttctcacatacactgcactgtgctgaaactgaaagcatatccattatccgtgtttcgtaaccgtcaccggtcgagggacaaactataatggtgcgtgcacactggaagggtgcaacgggccaacggcccatgctgatgttgaccatggaaggagccttcccttcgccgtctgcatcgccacaaaattactcattggatgaagtggtggcaaactagcttagcttgattagctcctatgtgtgttccaaatggcagctagctagagatggaggaagcattgcaagcattagtctttaagggtaagaagataataagaggctttgcttgattgcttctgctgtcataacacattttgaagctttcaagctactaaaaacgaatcaacctaccctctatatgacagtcttcttcagataaccaagtaactgggtactgattggtgtgtagttttttttttcctacttaaaatattgaatatcagcaatcaaaatgcttcaaatattataaatcaagtccagggtgttcaactagtttaggtggtcaaactaaaacgtgtgaatatgtgtgaggttattgtggcctgccttctctaggtagaagcttgtgttagttagaagatgacaggaggaagaggataagaagttagaaaacaagcttcctgaatggcctgatcgacaattcgacaaatatgatgttatgatgttggaagcatcgaacagttttgtgctggacggactgagactacacagttcgtttcttctcttttttttgccttttctaaaggagatgcttctggcaacttgaatgaagtattcttcttgtggaagttttaacttctcattaacatctatttttgccaaagaaaaacataaagagaagtgaaaagaggaagagcttaattattcgattattacatgtctatattttt

SEQ ID NO: 74884 - DNA, 9009 bp, Oryza sativa
ctgttcccataaaattactatcatggatgttcattatattggtaggtaaaaaaattactatcatcactacaagaaacttgttaatccgtgatggattctccgtgacggatttacggatcgtcactgacagacatactccgtgacgatattttgtttttcgtcacagatgagcccagtggatattcacagcccacaaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataattttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccgcagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagtgtggcccagcagctggagttggcatttcgaaaatggggcccagcagccggagttggcatttcgaaaagaaaaaaagaactcgaatttgtaaaatagaagaaaaaaatgcaaccaacgagaatcgaacccatgacctactagtagaaggcgccccatcctaccactgcgctagttggtttgatgtgttattgtaggattctgtactctttttgacctgtgtatgtatggaggagtaaggtttcctcaaccgtgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcagctgttgaccggactcctgaagcctcttctcccatctgcctcaacagccagccaaggtaatatcttcttcttcttcttcttcttcttcttcttcttcttcttcttcttcttcttcttcttcttcttcttcttcttcttcgatttagttggatgtagcatttgaattggtgcagcttgctcattgtggtttatctacaatgtttgattagatggatagaagttgggtgcacagcagactattttcccctgaatacattgacggcgtcaaagaatttatgagtttcattcaggggaaattcaatgagaatgttgaaattctatgcccatgtagcagatgccttaatcagaagtaccaaagacaggctgttgtgaagaagcacatactgatgaatggtatggaaactacttatactcggtggattcatcatggagagagcttagatgtcaatgttattgacgatcctattgatatgaatgaaaataatgatggttccacaactatggtgacagaggatgacaactatggtgatcgtttggaaggaattttaggagacctacagactgcagcggcacaagcaagaccggatgtagaaaatcaagttggtgctgaagaacctcgtgataaagagtcatttttgaatattgtcatgagagaggcaaagcgtcaactttatcctggttgtaccaaattttcaaggttctcatttgtggtaaggcttcttcatatgaagtcattatataggatcagcaattctgctttttctgcacacatgaagctattggctgatgctttcccagaatgcaatacactcccaaaatcatatgatgaagcaaaaggcattctaaaggaaatgggtcttggttatgaatcaatacatgtgtgctacaataattgtgtgctgttcagaaaggaatatgagaagcatgacaattgctcggtttgtggtctctcgagatggaaagatgcagaaagaaagaagattccacaaaaagtgttgcggcattttccattggcacctaggctaaagaggatgttttcgaccaaagaagcatcagaagcggcacagtggcacaagttaaagcgacagcccgttgagaataatatgagccacccagctgatggcgaggcatggcaagattttgaccgtgaatatcctggttttgcaaaggatgcaagaaaccttagacttggcctagctactgatgggttcaatcctttttcagaaaagaacacaaaatatagcatgtggcctgtgtttgttgtgccctacaacctagcaccgtgggagtgcatggaggaatcaaactttatgatggctttgcttattccaggtccgaaatcacctgggaaggactttgatgtatttttacagcctcttgtagaggatttacttgagctttgggcaggtgttgatacttatgatgctattactggcaaatcatttaaacttcgtgcagcggttttgtggtgcatccatgattacccagctttgagtactctctcagggcgtacaacaaggggctattttgcttgtctccattgtgacaagcatcctctttcatatgccttaaggagcaaaattggttattttgggcacttccgtttccttccaaaggaacatcctttgaggagaaacaatgagtttactggacttcacgaaagcaatgatccaccaggtaaattctgtacagaagagttgctggctgaattggagagagttaaagacgtcagacctgggaagccacaaggaactgggaaaaggaagcgttccaactctgaagggggtcatgtggaaatttggagccggatggttagtttatggaagttgccatattggaaaaaactaaaggtgagacataatcttgatgtgatgcacattgaaaaaaacatatgtgagaacctaattgggacaattctcaatataaagggcaagacaaaagacacagctaaagctaggcttgatttgaaagatttgggtattaaaaaggagctgcaatttagagaggatggagagatgcctcatgctagatataccttgtctactgaacagaagaaggctttttgtgcttttttacaagaggtcaagtttccagatggatttgcttccaacatctcaagatgtttaaatgctgagggaacaacggtacaggggctgaaaacacatgattgtcacattcttttgcaaagaattttgcccgctgccatgagaggatttctggacagtgatatttatgaagcaatagctgagttggggatgttttttaggaaattgtgcagcagaactcttaacaaggatgtgctggttcaaatgaagaaagaaatccctataattttggtgaagcttgagaaaattttccctccagctttctttgatgtgatggtacaccttgctatacatttacctgatgaggcattgctcaggggtcctgtgcaatatgggtggatgtacccaattgaaaggcgactatatactttgaagcgatatgtgaggaataggtcacgaccagaaggttcaattgccgaggcttatattgctgatgagtgtctgacattttgctctaaatacatggacgatgttgaaacaagatttaatcgggagccaagaaataaaggtttctccaatgaagaagcttatggtgttgatgtttttgggcatggagttaattttacttctgcacctgaatatgtatatgatgaaaatggcattgatcaaatggtgtggtttgtgctaaacaactgtgcccaagttgagtattacgtcaagtatgttctatatacttacttttagacttcttctatatgctacctttgtgttgcacactaatttatttttttttctgcagtttgttcatagaagagttagagacacaaggggtgcctaacattgaaagaatgcttcgacaaggatttcagacctggtttaggaaccatgttagtgttcattgtcaagttatatattgcataatgtaacttctatttttctaatatatgtgtgttgtatgcatgtggcagattttgaagaagtatagtacaaatccagaagaggtggatgttgatatcttctccttggcatgcggtcctgatttgagagttagaaaatactcctcgtgcatagtgaatggtgtgcggtttaacacagttaaccgtgacaagaacaagaagacactgaacagtggagtaatgtcacaagctacacataatggtcagttaattgatttttttggaaacataaaagagataattcagttggactataacttagaggagaggtccgtagttttgtttgagtgtgactggttcaaactggatggaaagaggactgcacttaaagatgatggcttttttaaaagcatcaatgttggaagtttgtggtacaagaatgattgtttcatattggccactcatgctacgaaggttttctatttgccagatacaaagctgggtgaaaattggcaagttgtacagacatttgaccataggcatctttataacgtaagtcagacggaggttagtgctactgcatatcaagaagacgagtgctatgatgaggaggatccacgccgaccagtttctagcattatatatgatacgcctttaaatagagatgatgagcgtggccctgtttttgaagctgctgaaattgctcggttgatgaaagaatctagcaaagaagtgaatgtcattggtgatgaagatgaagatgaagaagatgacacacttatggagtattttaacgaagaagatgactcagttatggaggtcgatagtgacgacgaatagttctgtttgaattttatgttttaatattttgtcgtaaggctcaattagtatttgagaccatgttctacttatttgagaccatatgttctattattttagatagcctcaatttgtatttgagatcatgttcatctatggaatttatgtataattggttcgatgccaaactattcatatccgtttttcaagttttgattctttgttggcctaaatggcatttcaacttgcctgtgtcaatgaaactacagatttagtctctactagttgagcctttatttttttattaactagaaaaaatacccgtgcgttgcaacgggtgaaggaatccgatcgtctcaacttacttagtgtgcgagttttttatagagatttcctatacggttccttttgtatttccaaaagcaaacaaacttataaaccgactcaaatacggatttgtattttcaaaactgaacaaacttaaaaacgactcatatacggatgacataccaaagtaccagcaaaaacatcttcaatttttataatagtagacactttgtgatgggtactagttgagcctaaaaatgtttttaaaaatataatcgtgatgcaccactcacctaggatatgtacagcaccacatgacatgataaaccatgtgcggtgcttcacatacagctctcgccggacatcggggatcgccttgtttggcgttgggcgagtgacctattgtttttagtgcttttagtgcctgattcgactgaccttctttaaaacaatcatatctttttcatacggactcgaaattagacatataatatatccacagacatctacagaaaaagttacatccgattctccccgctttgccgggttcggtgaaattagaactaccaaattccgcttacaaaattatgttttctaggcgagaagctccggaaccccttggatagaactttgaaaaaattcctcatgcttcatcttttgtccgtttgagctaagaatttctatggttggttgcagtgtgctccgagactcgaaaaaaatatcaaaaaaaaaaattcgcatatctctcctcagcactagagagagaaagcaacattgactctgtgcgttcgctccgtaggtttagtacggtgtgctgtctcctcccagctgatcatgttgtgtaacataaactctgtacatattgaagtgcaatccttttgcgtgttcgcgaaaaagtaatgggatcatggggcttgtttggccaaaattcctaattcctaaatttagattagtggaatatgactaataccgatggaataagatagattcaagggaacaaatttgcttcatgcattgttttataccacttactagctagaagcactaattgggaaattatcaacacctatatagttttattaatcattatcaacatttttttaagataataatcatcaacataagggatcataacatgatgaactatgtgtatcatatatggtgcttgtctaacctgattttctaattccaacaaaaaaaattaatggagtatgaaggaatgagacagattcaatcattcaaggggaacaaattttacatagtagcaaatctcaaatataagacttattataatatatactcatctagaaggttccaaacaaaacaggggctttgagttttcaggataaggggaaatcccgcgcgcccaagcggcttggcgcgcttgatgtgcgccagcccgaaatatttcacagtccgaattaccttactacccttaggttcataaaatataaaatatagagaacacttccatcagaaaatttctcaagggtacatcggtaattatgaaacagcacttcccaattcctccaaaaacctagccgccactcatcctccaaaacccatcttccagccgccacccatcttctagccgccacccatcctccaaaaccctagcagccacccatcctccagccaccttatctcaccggcgcatcaaggcctgcccgccgccacgcatcctccagtttcccatcctccagccccgatggaaccctagaacgctgttggaaggttccatccgccgcccgcgcgcccatcgtcactgggaggctccgagcgcggccaccaccagcatcgctgttatggcgccgaagaatccaaaaggaaatcgggtagcaggtatagtcctaacatcacctcgctcttgacttttttgtggcgtttggatttgtggagaagaccggtggatttgggaaattgagggatgatagatgcaaagctctgtttgctggattatagttagaacttccatttgcagtgttggtcattttacctgaaaagatagggtacatgcttctgcctttgcagtaaaaaataggttcacaagatgattcttgttcataccctacagttatacatgaatatggaatggaatggagggggagagagtcatactttgcttaattactggtaaacaaaaatcaaagagtacaataattcatttagcatatggcactttcagtcttgttgacaaattcctgatcagttcatctattctcctgatgcttgtgcatgcaattcatgacaatattttaaacaacgtttagttgaaaggcatctcaaagagccagcagtatatatcatttttttactagcaatatatatctttgagtccactaaccattaataatattccaattcatctgtacctcatccaagacatggtgtgctattgctactcttgtggcttatctattgttcactgagtcagtaacacattaatttattgttgctgtctaccatccaccagttcatctgagtccatacgaattggagcgcctaaaagaatgcatgaagaacagtgcaaggctgaaggagcttggacttcctgatcgctacaccccagttttggaaggctatgttggtgttcattctgaccagaatcaaagtggagattcggagtccgagtatgatcctttaaaggatgatactggtgaaggagatttgattgatgatgagaatgcaaaggttgtaattcctttatgttgacaagtcttaacttgttatttttcttcctaattcaatgtaatactatgttgaccaatccatgcttttctttccagcagtgctctaaggagaagactcgcaagaactgtaacaacaaaacttcaagtatccagactggtggagtcaagtttcggtctcgcaagagagtttatgcagagcaaatgactcctaaagttacaaggtcaaagaaaagcattgcccaacaagatgcaagtctcacaccaagtgatatttgtatgccagctacatcacaagctaacgctggagatctcgatggcaacttagatgaccacacacaggctgctgttgaaggccagttctactgccacatttcttggttacattccattaacatgagtcagctataaaaatgtttaacttgctgatctaagtttattgcttgtttaccttttgaaaatattaacttgagttttaagaataaaaaaaattaatgaaaccaattttcacatttttacttgacaacactcacatgaccaccgggtctgatgctatcgaccaacataatcagcacaaccatatggacaatggaggtgatgaattcttactgtcgttatgtaagttttgtttgtatgatgaatgcttttcttacttgctgcccttttttagatggcttcacccagcatgatgacaacacccttgtggctgatgtagttgatggcattactcaacacggtgaccacaaccagattaccaacgaaggtgagtttgttcatctattttccatatttcatattgtctcagttgatcaatatttgtatgc

SEQ ID NO: 74885 - DNA, 30460 bp, Oryza sativa
caagaaatatgcattaaactcaaagtgagataaagagagaggatgaaaaaaataaagctaaccttatagttaatctattatacatgttagctctaacattgacttataataagtagtgaattgtactattaaacttgctcttagggcaagtactataggcattttaggcatccaagcacagacccaagataccacatagcactaagggcaagtactacgggcatctaagcacaatctcctagtgccacataagcttaaatagtgaggtggaggagagaaaaaatgagagagataaggagccacccctcatgcaagaggcaactactacacaaaattcaagacaaagagagcgagagaggaagagtagatagggcaaacaaatattggggctagtgtattataattagtatagatgtgatatattgtacatgttacctctatatttattagttgatgatgtggtcaagattagatgtaacatccacctcttttataaaacttgccctaaatgatgagatggaggagagaataaagataaaaaagaaatagtcacctctcatgcaaggggcaactcctacacaaacttcaataaatatgtgagattgctagaaatattggggatgtgtggtagagacaatctattacacatgttacctcttaatttaatggtgtatgacatgcataaaattagatgtggtactcacctctaccataaaacttgcccttagagcaagtttaatagtatagccaaatcatctatagtcaatttaatagctcatttatataatatagttaactataaatatactatatcattaataattggtcacacatatcatacacacgtagcgttttagaatccgtgctgcagctggctacaaatatatagtccgcttatcttctctcttttcttatcttccgtaccgcagctggctataaatatatagccgacattatgttagggcctcatcggatggatgtatgggctgaggcttttcagccaaagcctatcgaattgcttattgggctgaggactttaaaccgaattgcttattggactgaggactttaagcctcaataagccaaataagccaattaatggcttttctttagcttaaggagaaaaggtaactttgactattcagccaaagctctaggttaaccgatgagggcattattgtacctgctcttaacgggtcccagcaaggccgactccagagatgggcctacagaaatggtcgactgtacagtgtacacatgtgtctagtggttactcgaaataaagattttgtcgggtggtgataatgatccacttatctgtgctcggctagttgtacaagtaggcatatttttttttcttcaaaacagcacaaatacatgcacttgtataaacatacacacacttattattcttaatacacacactcacacaagagaacacacgcacccatgattcttatgtgagtgtatgaagattgaacttgaatatcctgagatttataaaatcaccatatattacttgatatttgatattgataggtacgttggctatcagtgctataaatacaagatgatttgataggtggcaaagcgatagcgctataacgaccgtgatcaccttaacaaatcatcttagttgccttatataaggcgcttcatcgtgcatgtgaaagtcaaagatgtatgtatgcgttgtgtaaagggccagagaggtatctttggaagctttgtttattaaaaaaaagattcaatggtttaaataataggttcaatggttcgaagggaaactattttttattaaaaaatagtatgttcaccgttttagtttaaattagttaatatagaccataaaatgttaatttattgagtatataatataatggtgtagtacattatttgaaaataatagtccaaagtaattagttccctaatttaaataaaaattatcttatattattattaatttaatgggtaaatatagtggtgaaaactttattaataaacattgtagagctaattaagttacacattttttaaaaagttttatgatgatataatctttataaaagtatgattatttaaaatttagagtaaattgcacccacggtgcaacaacttggtaggtgggtgcaatttagtgcaataacttgagaaatgagggttccagtgcaacaacttggtaggaaggtgcaatttagtataagaactttataagtgatcgtataaatacaacaacttgcaagtaggtacgattttgatacaataaattaagaagttatatgataacttaatttttttggagcattttaattttttgagtatttattttgacaatattctagcatggatttgtataatcatatttatatatttatcctaataactaataactgaaagttaataaaactggatgtagaattattatatttcggttgatatttgagatggtgaagaaagaaaaaaaatcttaaagttaattggatgtaaattgtatgtgcagtataattcttaaagattaaattcaatattataaggtaatatccgtaggaatattgtgtaatggcatattgacatcgtgaaaaaactcacctagcatatgcttagccaagttgatgcaccaaaatactataaattgtagttcttgtactagaatgcacccacttgtcaagttgttgtactcaaacatttaattcgcaagatcttgcattatatcgtacccacctgccgagttattgtaccataggtgtaatttactctaaaatttattatcactattaatacgtgtatccatgaaaaaaaaaggagaaaatgtacgtatgtacctacctatgcaacaggagaagaggtcgaatttttcccatctaaacacatgtggccccctaatttcaaatgtgagcacgtattgttcagaattcttttctaatcgaattagttggtacaaagcaaatgatcgatccatcaacacgtgtagctagtaaattacagtaccgtgttattttttccctccttgctgatgttgtttctatgtaaaacaaattaatatttgttagcacaaattacaattttgatgatccaaacaaatggactagatttgagcttaccgctgccgttctaatttcctaaacgaaaactcgagactgacggcatgatgacagggtgccctatctcgtaatggttgatctaacctattgctaatggtatttgggttttctttttcataacaaacagtgtcaagtaggcctaataaacaagctgctacgagcaagtgatttgtcctaacgatcaacagccctttagtttgttactactccctccgtcccgcaatataagagattttcagtttttgcttgcaacgtttgaccactcgtctttttttgcaaatataaaaaacgaaaagttgtgcttaaagtactgtagataataaagtaagtcacaaataaaataattaataatttcagaaaattttgaataagatgagtgatcaaacgttataagcaaaaactcaaaatcccttatattatgagggagagggagtacattttgttgcacatcaagtccgatgggacgaccactgacacacagtcacacacatgagcttttgatttcaaatagaattccagtcattacatgctcacatttgaaattagacggttgcatgtgcttagatgggaaaaattcagggaatgcctgatcttggtcttcgacacaaacagcaggatccgatccccttttagttatttggtagagccaaaatctggctctaccaattctttggtaggattagacttcatattatattgttggttcgctagcaatatcctcaattggtacatggtgaagaaagtttttgagtgttgccaaattgaacgtttgggcattttccaatgatttggctccaatttaaactaactactgtttaagttgttgaacaactcatttgataaatttcggtttagatccaacgcggtccaaaaaaaagttgaggattgggctttacttgcacgaaaaaagttactccctccattccaaaataagtttattttgcatcccatctgtttatcccaaaataaattcattttctagtaatcattgcatcggagtttgtaaaagtatggataaatgcaatgagagtagatataataggaaataattacattgtgattaaataaagttggggtattctagattttttattgatatatgcaatatgagtaaaaataaacttagggttgtgttcgctgaggtaggttgagaactcattctctccgcacgaaaaacagagtggtccattagcgcgtgattaattaagtattagctttttttttcaaaaatggatcaatatgattttttaaagcaacttttgtatagaaactttttacaaaaaaatacattatttagcaatttgaaaagtgtgcgcgcggaacacgagggagaggggttggaaaccctgagcaaagaacacagcattattttagaactaagggagtacagataaagagatgcttgctcaacaccaaattgatcatctcacgggaccaggagtgcacaaaaagtggaaatttgtattatattgaattcggttgaattaagaaagggcataatcgaaatcatttctttgatatgccatatgctttacgaaactgcatacacatcaagaaatgaaaattgcatacatgcataatacaactaccggctggtaggtatatataaaaagggaccttggaaaaccaacaagaacaagttccccatctgctaagcctggctacgtgatctatgaaccatcaaattcttctagcagattgcattacgcgtactatagttatagaccttttgtattgttttggtgcaaacccgcaagagaaatctcgctcgtatgtaggcacgtagtaagctgccctgccctgccctgtcctgcccatctctagcagagaagacaacgaccgagcagggcagcagccagcatcacccactgattagccgatcgatcagcgtgtcatcccagggtacatctccggcgccatggtcgccgccgggttttgcccttgcttctccatgtttgcgtgccatcctgcacaaaaccaacgaaatcgtcatcgtcacgatcatcaacacgcacgacagccaaccattccattagaaaatcgatggctatgctataaacatattttaacatattttaagaagataaaagagtagagagacgagcagtggactacagatttgtagccagctgcagcacagactcaaatacgcaatgtgtgtataacatgtgggaccaggaattaatagtgcagtagataactattgtatcaattaactattaaattaattataaatgatttggagttggtagttggctgtactgttaaacttcctgttaccgaggctcatgtcgaagccgcgcttcttgagctcgcggtactcctggcagagggcgcagggctcgcaccacaagtggacgaggcagtcggggcagggcgtctcctgcaggccgtactgggaccgcagcttggagcggtagatgcaggagtagatacagctgcagcccgtgacgagaaacaccagcgcgtacagcgacccgctcgtcccgcacgacgacgacccccggtcgacgatctccgcgatctgcccgaacgtgatgcacgggcacaaccacgtcataaaacctgcgcccgacaacaatcgatcagcacacacgtaccacgccaagcagagaacacacaatcgtagcccggcttgcttattttacagttgctgctgtcgtcgaagcagtcaaagaggtcggtggaccatgggacgggggcggcctggtcctgcatggcgaagggtggtggtggtggtggcgcctccaccgtcctcctccggcttctgagtatatatatgctggcccgacgtacggggcgccttcgtcgatccctcactctccggcccgcgagggtgaggctttctctccgacgaggctaatgatgagcgcgcggtgtggtggtacaagtagtagagggtaaccggccgaatcgcggactggtcgtccgcgcgcatttatcgggcgaggccgcgaatgttggcctatcgatcataattttaaggacgtaactacgcatcgggtgctcgatttaacgctaaaaatcgggtgcccacccctacaaaacatcagctaaactggatgcatgcacaaagccatgcgcatatgcaaagagacatgcaacaagcatggaggcactcaatagctgtgcatgcaaagtacataactatatctctcactcctagtattaataaacaacttatttaacatgctctaaactttttttcttataaattacttatctcatctgtgatatgattacaccgttatatttgttacaattaaatatttaaaataagatctcacacgactatattttaaattaaaaattaatatataaatatataactaattgaaacacatttatattatatatgaaacattaagttgcaattgtttaaacatcacaaaaaactccttgaaaaatatctaaaaagaatatcacatgcaacattccaaataatttagtgaaacatcacaaaatacctaccgaaacatcccaaaaaacacaccacgtgcaacattctaaaatacacaatgaaacatcataaaatacctcctcaaactcaaagaacaccaagtgcaacatttcaaataaagtagtgaaacatcaactaaaacatcacaaaaaatacttcttcaaacattcaaagaacgctatgtgcaacattctaaatgacctagtgaaacttcgcgccgtttaagtaatccattgcaacaaaaaaacatttaaaatatttttgtcagaatataatcaagtaagattttattgtgaagaattaattataacaaatacaacagtgtaatcggatctcagattattagataataatctgtgaaagaagattatttgaagttatggaataagaaagtataagtatgtagtaggagcatatggatacagagggtgaacttaattgtacacgttacatgtatcatggcatcaccaatatatatagcaaaagtgattcatatagataggatccacataaataaactttaactataacaatcctcacaatgtatatagataaaaggtagcactaagagaagatagaagtagagacaaataatattatttattttatatgggtagcctatatggttttcttttttactttttagtcctttttttaaattaaaaaaaagacctttacaaaaaatatttctaaaaactgaatcttttggcccgattggctgccacaccagttgcacggtgtgacaaagttatttggctggccaaaaggttcagatttggaaatatttattttggaaggtctatttttaaaatttaaaaataaaaaaatattagtccatatgcatatgggtatcttttgttattttctttaaatggactagttgcataatagtattaggtggttgaataaaatattgtattgcctatagatcacttttgcaccacattgtggatgcccttaagtaggagagaataaaactacactctatatgatttttgatgggtaccggctcaaaagcagtggccttgatcttctttcctggctggaaattgcagtcatgaaggcttatctcccgcttcttattgaaagcaaataataagatcaaaacagattctagggattgcgttcgttggcggactcaacctgacatcttacgacatgaactgctcccaaagagggaggcctaaatatagtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatgatttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatcttatcagaaagataggcggacgacttgaccataaggtcggatgtttccgtgagcagtaagctgcggatctccccttttttgggggaaagctggtggcccttttggcgtgttaattctttcgacggggtggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttaggcacttgatcccttcggacctggagaacgtgtgacactgggtcggggtttggtgaaccaacaggtcgctcctttagttgaagtattgggcccctttttcgttgcctaggttacaccttcggaataccccagacggggattgagctctattccccccaatcttcactttacgccatgccgactctccgtcgtggaattagaccaagggtcgaagacccataccataggaccccatcccccgtatcttatctttcgcgcgtaggagatcgagacacagccttagggctatggggaaagtagatcgattgctctagaattacaactacatagagggtctctacaagtctataaagaagtttaaaaaaattgatagacactgtttgatggtgcatgctgcatgcaacacataaccggagtaggaggacgtccgattttttcaaattgggtcgaacacccgaccttaatcgttctcctaatttttcaagtggataattgcatttgtttggactctcgctgaaccaatcatgatgcagtgcgggcctggtcgcgcccacggtgttcacgtgggtggcgcgggctctgcatgcgggatagcacgacgggtggctacggttgtacaagcttcaataaacggtttggagtcagttgcaatacaagcttcaatacaagagagacgagtaaattaaatattaatatattaataattaactattgtataaataggctattaaattgacgaagctagtagttagttatattatattattaagggactaactagctgtcattcgacaaattttagtatagcttaactggttagattctttgtggtggaaccagcccacccaggtttaaatcctagaattgacatgggtgctcgtatttacgggctatttattctttcagtggtaggtaatatacccgtcaatagcgaggcacttacacgcatcaataacttaatgggcttcaacctaactggaccaaccaacggtgctcacacgggctaaaaaaattataacaggcccatggtcaacttcttttttatcacaacttattacaatatatctatagtgtaattatattgtaattataccataattatagtgagttacactataatgataatgtaattttagcttgtaactaaattaaattattcacttgttcgactgacgaagtgcatgttctagcaattagaattcatatgccatcccacaaaggcacttgctggaagattttgtcagcctacagtagcctagtgttggtaacttttttttttttggcaagaagataatcataatcgggacacttaaatgtcttacagtgatataaagtcgccaaccaccccgatatagccaaaggctaaatcaagatgagttttatataaagaaaagctaaaccggctagcggagccgatttagagatcaaaataagcctctaggccgatttagatcgatatgaggataactacccatctcgtgggtgaactgaaggtttacgggacaaacctatagaggggtaatcgcactactctcgcagcgacggcggacgatttacagcgcaaatcgacaaagatgtagtaaaacaagaaagtagaaaacatggctaaaagtaaagataaaagaacaattcgattgtgttcgggggggggggagagatatatcaatcgaaccggtcttgtcccttaaaaaggggttggtcttacctcctacaaatcctcctccacgtccaactcgggatagaaaccaatggaaatccgaaatataccttcccgagtaaggaaatccgagacccgacgaaaacaaactcaggctcggactctaccggtctgaccggccacacactgccggtcagaccggtcctcaagcaacgatctgaccggccaacatacggtggtcagatcggctctgtagaggaaacatgtgatatttccaaatcttgacaataatttcttaatttgaacctaggtgccaaatttgagtataaacaaaagaaaacttatgttctgatgtggtaggcccaagaaaaaaaggtgtcatttgaagtaagaaatctatcgacaaatttatagtaaaaccgtatgattaaacttgctcttaagcaaaagcgacgtcatcaatgaagtttacggatagtgcacgaacaagactcctctgacttaagtcagatgtacatagccactaacgtgtgagcccataaagatagtctcccctgtcagggaccatgtctctctgattttaagcctgaggagatcgctccggtagtacaccagtgtgcttgtactatgggtcggtactttttttggcgtgagataggattgatctgctggctggtgatgttgatcgaggcgtcgtccgcgtggtggtgctgggtggggtgtggctccgtgtgtgacgggggtcaagtcgtcgcctggaccccagccgccgcccgcgactcggcggcgagctttggtttgactggccaagccttgtttctttgtgatccgcgggtcgagggagtcgcttgccagagtccaaaaggacaccgcgatttttgcgaagcaccgcgcctggtgagtcagacagtcacgcacgacgagagggagttgtccccgggtcagattggcatgggaatcgtcggtcgtcttctctttaccttaacctgatttgagtgttccagtttcactgcgcacggtgcgagaccgaggtccgtcgaaaaacgtcgctagctgtttctgttggccagtcacggtcaccaggggaattcgcccagccatatatggcttggcaagccggatggcaactccgttgtagtgcgtttttttttatttcataattagtaaagtttagcttcaggaatgggatagagagacggttagagttgctgcataaatcccctgtgatactgcaaatatattaatattaacagcgactgacatataggccaaccgaaccctctgggtaactgcacagctgcagcctacaccaccaaaataacattggctgtgtttagatccaaactttcaactttttccatcacatcaacctgtcatacacacacaacttttcagttacatcgtaccaatttcaacccaaacttccaactttgaaaggaactaaacacagccaattatagatcacaacatgcgcatgcgaaacttccatgttgcaggcacgacgtccacttcgcacacggtaaaggcgcataccgatgctgtcatgcctcaccctcactctttttgaacaaggaataattaattatttgccactcttacggatggtgataaatgatttaccactggacccacatgtcatagacacgtaagggctcacatgtcatagacagcgagtggcaaataattaattgccacatcttaaaagtggccaaaagttaaatgtccctttgaacaaaagtagagcacctgaaactatgaaagcaacagtacagttagcaacttggcactcgactgcatgtccacaagaaaccgtaagccgtagagtcacctttcagtgaactacatagctctgtagtagagatcactgattagttcatgacaacgaaactgtacctgtaattcttgcagactgaagaattgacatgaagaaatgtttccattcacgaggctggcagcaggctcagtcagttacaaaagacctaagtcaacaactggactaagattttctttactgttttccctacaaagctgcatacatacagatcaaagaaaggccagcattgcagttctacccaactatgaacatatggctgcttgattggcaacatcgtgttgttttgaaggccaccatgattgctggggcacttcattcttctatatttcagaggctgaaaggttccgtagatcaatatttagaccgcaggaagttccagaacttttttgttctggaaattgcagcagcactttcgatggaccgacaaaaatggtcaaatatttaacatgcaattcaaatactcgaggtatttggcaactgatcaagccggctgttcagtatttggtgagctcgcgcacttcggtattgcagtcgctggtgtagtgcttctgacatttgatcaaaaaaatcaggatcccatctctgaattaaacggggatcctcagcatagcatatgtatatcgatgtaactgcactttcgacaactacaacagttaccccaacctgaaagggggaaaaatcaatcaactcaacatgatccaacaggggtcatagtagagaagtcctgctgtgtgactcctagcaatattctattgaatttgtccagtaagagaaatccttgtttccttgtaaatttcaattagattttgcatgaccataagaacttaccagtatcatgcccatcagcatagaggttgagccaaccataatagctttatcactttgtttaaaatatgtccaaacacccgtacatgttcctgtaattaacccacctaaaatggtgctcatcagaaggacagcacctgaacagtcataagcaacaagtgcttcaacgccagttgattggaacaactcccaagcatccctagctgagcgattgaaactctggccattgatagctatctgaaagtgaaaagtatgtgagacatttgtgcaagcccaataggatatcagtaatttgatatagtaatatccatacagtgatattgattcacaaagcatacaaattggtgtaacatcaatccaggtaaggtatcgggtatccatgtgcactttgacagtttgtatagtaaagttgaacttattaatagcttaaggaaacatttaaagttctatcagttcagaacataaatgataaagtggcaaacacatcgaacagggacagttttggcattggcatgagattatcaaaacttccacaaagataaaacatctgtcactgacctgtacatatgcatatttgttgaagaagcgaacaagagtttccacgatatgaaacaaaaagtcaacacagcacagcaaacactcattgttgcctattttagaacgaattcctcgaatctgaaaattagttaaaaaaataagaaaagggaaaattaatattttattgagagaatgacaataaaacatggtaatctgaaaatttcatgcggcgaaactctgttaaggtaaaggtacaaacctcccaacgtaaagtcctaatagcagccgtaaaaagtgatccatagcaaatgctcccaaatgaagttgttacagcgtactgaagtgattttagaagtggttttgggggcatcgatgcagcagcttgaccaccatgaatgagaacaagaaaaaccatccctgatactatgacatggactgtgttactaaggacagctccagtccaaaataaactgactgagaaaatctacagattacaagtgaaacaatcagaaaatatataaagaataggaaagacgttgaaattcgatatagaataaacaaaacttgcccgctcaccaaaagagcccaccattgccctccattaggtatgtgaaaagcaagaatgccagacactccaaaggaccataatgccatccaacaaagcatgactaacacaaatgcatatgctatcctcatcacatcaggaagttcccataccattcttactgccttctgcaatacaagcattgtgaaggggaacctagcaaaaaccaacccaattaatgccattggagataaacggggtatgtatttttgcagcaaatataatgtttatgagaatagaaggggttatttctcatgattttagcatagaatggaaggaacaattttagcataagaattccttatgaaaccaaaccagatattttcagggcttaaatagttttcttccacagacagccatgacatgcaaaaaggttgccataagacatccatgttaacacctaatgttcacaacaaacttttaccacctacaaagtttgtaaacctagctaaattctgtgagttgaagaaaaaacagttgctgtcaaattttccactgataacatgccggctgatattggatgacaaaatatcaataatcagtgggaacatttacaacctacaaatatagtaataatactgtttgtctgtttgatactggtttgggacataagctgattattgcagagtaatctatagaatagttgttttgttgaagtgacactgtccattaatgtaattttgcctaaagatctggttttactcacaaaagcaattattttcccatatatacaacgttatttgaaaacaggttatcaaactaaatttgcacattgcattgtatgatgtctctggcaaataccaaaaaaggaagcttgaactgtatttaaaaaaaaatgcttgaccagtgggtttaagacagcccgtgacattcaactaagttgagaaaaatcccccagaccgcagttgagcacactcaacttctcgtggggagcacgcttctaccagtgcctgcgaggggggatgttttttgggcaaaacctgggttcaagcctgggccggcatcccctctactggagtctctaccactgcgccgcaagcgcgtttacaaagcttgaaatgtacaaaaaaggattgtggaaaacccattccatttatcacatttcaatgttcagaagttatttagatattcattgtccattggtaagtttcatttccatcatggtgtagagcgcactacatggataaaacagaaatcaatagcatcttgtcctcatgtacaatcctactgggaaatgtacagaatttgtaaacaaatgtacatcaataacaattaactccaacaattcaaacatgtacaatcctactgggtacacagaatagcagagacaatctgcaacacctgcttaaatcttactccctctgcttttttatttgacgttggttagttcaaacaatatcaagaatggagggactactatgtacgcacgcaccaaaagaatggcatgatccctgacattgtagtttcttgtacatctttacagcatttgtaggcactaaagcctaaaagcaacactagcccatgcttaaaccgtgtgctaccatccaaatcaagttaactctaaaagagtgtgaagaaacaaagcactagcattgcacacccatacatatgggtgcacctgttggtaatgggaaccgacatggacacgcgccaacagcctagtaaaattcttataaaagagagctgcgcaattcatcgatttctccagtggcaggaatttagcttctgtcggtgtcagcatcatatgaagtatgaaccctcacctactcaagtctaagtttgcctcgaattgcatacgatttctaattttgtgcaggacatttgagaagacaaaaagggcagttgctgtgcattattattacctatcaagaactgacatgacgtagaggaagtgcagcgctccgccgacggcgaacgccacgccccagaagaagtgcttcccccagaagcagagcacgctgaccaccgcgaggtaggcggtgaggctgtgcacggcggccctcatgaccaccctccccccgtccttcttccccgcggccgccgccagccacgcccacgcgagggcggtccccacggcccccgcggcgccgtagtagggccagtacgactccgtgagctcggacttgggggtgacctcctcggcctcgagcgacggcggcgggggcgcctcccgagcgggctccggcgacccggcgaagcgaggcgcggcggtgaggttggtgaagcggtcgatgttgaagcggtccgcctggccgaagcggttgagccccgtcagcgcgagcgccccgccgaagacgagcaggtggagcaggaacaccaccagccagaacacgtcccggcaccgccgcctcggccacgccgccgcccccacccccacccccgccgccccagccaccgccgccgccgccgcaggccccgcggggcaggggctagggttcgcgctctccccctccgacgacgacatcgctccccgccccgccccgccggagatcagcagcagcggggaccgcaccgcaccgcaccggagcgagggatcagccgcgagcggatcgcggggaggaggccggaagcggaggggatgacttggaggagaagaagaggatggggaggaggagtaactgctcggcagtagtagaagcgaggcagtagtaaccgtttctggtcatcgacgacggcgacgactcgcgctgaaactgtgagaactgggaagcgatgggcgatggcgacgtcgcggcggtgtggggtgtttggggatttgaggggaaagccggggaatttcgggggttttgctgttgggtttggggggccgggcggagcgcgaccggcaccgcccccttcctccgtccgtcgctgcgcctggttggttggctttgtggattctagaagcagcagccagcatctcaaagcaagtggcagttgggattggagaaggcgaggccttggtggtggcgtggtgccagttcggaattctgatgcgccccgctgcacgagaggagattccgcgacggcaactcccaacttcttcgtccgtcgtttcgactccccgattcggcgattcgctaccggggatccaaatccatatccacggcgtttgtgttcgtttaacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgaggtattgattgtttgtacaaaaataaccattttattcttgaatattgcattttcacatgttaactaaggttcttaagttgatctgactgccatgtacaatatggagcccaacaaggggtagtgacacatatttctcaacttcagtatgcaataagtcagtcattttatatgtttttacatgtggagctgcggataatgtgacaaacttatgtaatcgtgaatgatcttttgatgtttctctgtttttctttcatgtagtttgatataggattcctttatctggcactattgaagttttgttgtaaataatgttattcttgcaaagattatcttaaatcaatcatttctggatctgaagaggtattgtaacaatctgaagctttgcacaaccaattgcaactaaacttttgtatttcttagggtgaggacttgaggttggtgtgatgggcatttagctaactgaaatttctctcaaacctcacagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtattacaatagttcctggcatagcagtctttaatttctatttctttatattgtcaagttcatgtgtttgaatgtatgtgtttgataggtacctcgcagagtttaagactggagctgagaggaaggatgctgctgagaacaccatggtggcatacaaagccgctcaggtggtttccttaacagtgaatttgttgttgcggcatcctgtttgtttgtttgtgccattttgcaattttgattcggggtattcagctaaagttatttgtgatgtgttctcctttggtctgttttgtttttctgaatattgttggtgataaaatctttcaggatattgccctggcagagttgcccccaactcatcctatcagacttgggctggccctcaacttctcggtgttttattacgagatcctcaactctcctgaccgtgcttgcaatcttgcaaagcaggtttaatttctactgcattctatttcattatttgtgaattggaggaccatatggagttgagaagatattttgaagtttataccattgttgtgaaatataatgtcttagtaattgggattgaacaaataacatgtatgaattagtaatacacctggaacaggttctacttagttctgttagcaaatagcaaagtgtaggctccttaatgcaagtaagctgaacgggttaggtgcattgtcatgatggattttcttcattaagaatacttgatagaaaatgatgaatcaaataagaggtgtaagaaattatagtttacagttacagatttgcccaccttgaatacttgagtgcttctaaataactgatgaagtccgagcatcactatggccattgtgacgtggaacaagcttgtctcaatatggccatcgttcattcatagaggcctaccagtttgttctgtaatttgttaataatagatatctgatgtatatagaatggtttactgcagacaagtttgctataagttcactgctttgtccatggatataattgatcttggacttggagcacacattatgtgccttactttatgaaacttgcttgtgctagtacttatatttgccatcataatagaatgtgacagtaacctactttatctcaggctttcgatgaggctatctcagagctggacactctgagtgaggaatcctacaaggacagcactttgatcatgcagcttctgcgtgataacctgacgctgtggacttccgatatctcggtattttcttcgccgctagcatatatatttgcacttgcatcatattgtctttggaatcatcttaaatgcgtaaattccatgtgtgcggcttcaggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaatgctgtagggacccaaatgttcactggcatcatgtacagatacttgtagtaccaaaattagtttagcagatataagcaccagtggtgtggttatggccttatggattattacgcacacacgattatgccatcactagaaatttagtgactaagatttactaatgacttctgcgtccactcaacgtacaaatattgtagttttctagatgatttttttattttctataagactcatcaaaaaatattatatttgataggatcccttgaaatttttagttgtgtttttcatgagaatgagcaactaaacataactaagcataggggtgccttctgcttgaaaatttttatcattaaaaaaatggggttttcttcttcaagtttgaatatttaatttctttcttttttctacaacattttaaaagttggcactaaagaagacaattattatgcaaagaagataatacatctatttcaatcctaccagaatggaaagctctggaagctgttaaatctttttttccctttttttaccttgcttccagattgtggccccgacgatggtgtcaccttttctattttcttttacatttggagcttaagcatctctattgttttatttgagctccgattctagagacattcttagcatctagaaaatattttttattccaataatgtcattatttatttcatattttattatattttctttattttctttcctaatttttattttgcaatttttcagaaggtgatgtttattttagtagtagtattgttgaaggatctagatgttaccggtttaatttattgagaattagtatagaagtttctggagagactataagctgcaagaaagcttgagctctgtggcatcttttcttgctccatttgtgttttttttttcacaaaagagtctatcatttatcttggaagctagatgcgccaagtgaaccaatcagctggctggatctccaaccagctttagaagtatagctccgttacaggttataagacgttttgactttggttaaagtcaaactatttcaagtttaactaaatttataggcaaatataataatatttataatactaaattagtttcatcaaatcaataattaaatatattttcataataaatttgtcttgggttgaaaatgttactaattttctctataaacttagtcaaagttaaaacagcttggttttgaccttgaaacgtcttatagtagtttttttttatggaaccgaattctggaaggagtaggttgtaaacagccgccgtttgccatatacatatccaaatcgcaagtctcccgccatcgcattgcccgccgaaatagcctccctgcacatcacgcattcacgttcgcacgcagagccaggtaaaacggtcactacccgccacgccggcggccggccgccgcgccaactttgcaccggtttgatgtaatgatgtgtgcagtggtggaggcgccgccgccgccgccgccggacgagacggagggccagcaggcagggggcgacgattcgtcgggcggcggcgaccggcggagaggcgccgccggcgccggccggcgcgtgatcgccgcggtggctttgggcggagcagcctccgtcgccgcgctgcttcacgttttctgatgatctcgcacggcaacaggccgatcaattattattattattatttttcagcttctttagactgtcagtgcctcccagtaatttagcggtagaagatatgcaatgtggcaatgcaaatgaacggttatcgatggttaatttctttcgacgtaaacatgcttatcgatggttaatttcttcatgtaatcaggtttagatgagaccttgaggttgaatatgtcgttcggcttgtgatgcgaacatcccagattcaaaaacatcaagcaaaagagctatagtttcagccaagaagtccaaatgggaagcatcatcagactcgctatatttccctgatttttcaggtaccacaactcgcagctcaggttttctagctctgatcaataagaaccagatacaacatacaaggcacggtcggaagcaaaagctagttttcttcatgctggagaagtgactcaactaaaagcttccagagttcatggattggatgccaaatgtttacatcggctgcagattaatttccatggagagccacgattgttctactcaccttaacattctacggctcttggacgtcagatacatataatacacagcaattttttaccttgtaatgaatcgatttttgatctcattgtggatggcctaatggctcgacagcggttctgaagagaagaacgtagaccttgtcgacggagaagtacaagaagcctcccacagagtgggtgacataggaaccaaagcctgtaccaacaatgcagtgccaagcaggaccatatgttgcgtcgaattcctgcaagaaaatgaaaaaccacattaacaatggctaagacatttcatcctagttggctcagtgaaaaataatgtaaaacgtagtgttcaaaaggaaaaataataatacagtagggaagttgctacaaactttaacctaaggtgcaaccgtgcaagtgcaaccgatattctgagcattagcattctgtagtaaccaaccatccatatgagaaccacttgtacatagccagtttaggagcactgagaatcagagcttacagacatgcactctgaacttttttgtgtgaaccttgaacaagctgaacaacagaattcgatggaaggtgctgggaaatatgattggcaattaggactaaaaaaatgtgccctaattttcatctgcctttcagggatatctaaatttcatatagttttttttttcatgtgatacataaatgcctgatgaaaaaattatttcaagtagcaggtgcctttgggcatgagtatttatttaacataggaggtttgctataaaagtatcattcctacaaaaggtgtaagactgcagaaaatcttgttgggtcaagcggtcttctgacttcagatagggctgcaattttgtaagtaactcttcttcttaatacaatgatgcgcaaatcatttgtgtattctcagaaaaaagactgcagaatatgacgaagtaaacacagaaatattcttttgcaccacatccacaggtaagagttaagatgttgataagttagcacgttgaggttattaagaaggataggcagacctctaagtcgaactgtcaaagtagtcataagtaaaagcaaaatactgttacttcttctagacaaagtattttttttattcaggcttctacacaaggaatgcactttaccatccattattacattgttttagccatatgttgacgaccaatgctaacaaatagcactcattcacaaaattgaaaccttgaatgaaaaccatctaactacaaagcaaaatattgtgtacctagatggcatgcatccattttttaagcaaccaatttgcgtacctctttagaggatgcatttagttaatctaccattgagcacacagaagtctagattgctctcagattcttgtaatcaacaaatttctagaagatctgttccacattttaatgctcaggtaatgagctactccggctaaaatataaaatcagacaaagcaaaaggatcagatggtgtgaacaacaacatatatgaatgggaaattctgttaggggaatggcgaagaatgaatcttacaacacaggggtaaaacaaaagccagcttctgagcttcacgggtcacagctaacaaatgctggatgtcacatgtgttaggctaagctgtcacaattgcatttctggtatatgattctaaagtagcttttcccctatccaatgttgggaccaaatgataacacatctctaacagaaacagaaaattttcaaccatagtcactttcttcaagatatcccttccagttatttataatagagatgctggcattgcacctgtctatctatttttgctaaactagcctcaaagacatcgttttccttttcccattttcctgtttttaaggttcccatcactagccacctccttgcttgagttgtgaggctatatatttcttgagaaaattcccaatatacccctgaaaatttactcaatcccttcaatacccctgaatttgacatcatcccttatatacccctgagttttcattttgatctcctctatacccatctccgttagttgatcattagttgaccgttaaatattttaaaataactatattacccatcctatacaatggtacctacctaataaattttcatatgaaaaaattaacttatacaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataaatcttttttattttaatgaaataattttttatttttaaaaattcataacaaatatttagtaattttccttattggttttcacaactcaaataatttacacataaaacatttctagcttttaacaatataccaaggacaacaaagtaatttctacaataactaacggtcaaactaatggtcaactacggaatgggtatgtaagggatccaaataaaaactcaggggcatataagagatcaaacaaatctcagggacgtagaagggattgggtgaaattacatgggcacgtagggaattggcccatatttcttgcccaaatttctcaatcccccaaccatattctttactactccctccgtttcgaaatgtttgacaccgttgactttttagcacatgtttggtcgtttgtcttattcaaaaacttttgtgaaatatgtaaaattatatgtctacataaaaatatatttaacaatgaatcaaatgatatgaaaagaattaataattacttaaattttttgaataagacgaacggtcaaacatgtgctagaaagtctaacatgtgctagaaagtcaacggcgtcaaacattttgaaacggagggagtacaaatttaccaccccaatactgcactgtgccactgtctacgtgtactcgaatagcttgaacaaactgtagccaatggcgagacggatggttttaccttcttgagggcgagggcgaggcgcttgctgtcgagccgcggcatggcggcgacggcgtcgaaggcgaggcggaccgcgcgccgctgcatcgccagcggcatgtcggccgcgcgcacccggaccgacaccttcctctcctccttccccttctccatctccttctccttccccttccccttcccagcttggccgccaccgccaccccctcccttgacctccctcttctccaccacggcggccaccgccgccggcttcttggcggcctcctcgactcgctccggctgcggctccatctccagctgcagcttcgtctcgggctccgggggaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcggggacgcgcgcggggcgtcgtgctcacctgaggcggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccctggccttttcccgatggtgattggtgacccggcgaatgtggtgagcgagaccggtttgaaactttgaactcctaacgaacgtggtgattcgttgaggccttgaggggattgtcgcagaaatagctacattttgtaactgagagtactccctctatttttcaatagataatattgttgacttttaaatatatatttaattatttatcttatttaaaaattatgtgtaaatatataagatataaatcgtacttaaagtattttaagtgataaaacaactcacaacaaaataaattataattacataattttttaaataaaatgaatggtctaacatagaaaaaaagtcaatagtatcatctattagtatgtcattgtgaactgtggagttgtttcgagctggcatttttactttatgttcagtgctactgtgcgagcaacacgaatggatacagatcaggtatagttgtacttgtatggattcttatcggaattttagctcttaaatttaacttgaagaactagttcgaagtggagttgtgaagtagttgaatcgcgctctatatctttcattttgtgggaacactccagcagtccaactcgagcattatttaggacttgtttagtagagctccaactcttaaatttagctccaagagttgagtctggagtggagttgtggagcttcctaaacccatctccacctttctagttcattttgtgagagcactccacccagcttcgctcccattttaggtggagctggaactggttcattttgtgagagcactccacccagctccgctcttattttagatgaagctagaactgctggaactggttcattttgtgagagcactccacccagctccgctcttattttaggtggagctagaactgtttggctggactctagctcaggaaaggtggacttggagctagagctgtgacaaacagattctcagactctagctccagaaaactgtttgtttcgactctctggatgagatgagactctgctcctttgtctccggaattctcaatttcaaggcttgtttggacatccgagtgtcatcattgcaacagcgctcatattttctaaacaagcacagaaggttaccaaagagatactctctctgtcccaaaatagctctaggattgaatttagtttggaacagacgagtacaccataaaacaagttttcgatgccagtatgctccatcagtccatcatcgaacttccatccctcaagagttcccagaataaacattagcaatttaagatcacataaaagccaaatggcttcaaaatgtagactaaactacgatgggtaaagaaaactgggctcttctgacattttgcctaatcttgtgcataaactacataacattgcttaatctcgtacattaattacataaaagaaaatcaacagcaagcaaatcataaaccatacttcttcccccaattaacattaagtacataccagaatcatggctgtgttctccccccccccccctccaacccattttcccaacccacctctctcattttccgcgcacgattttcaaactgctaaatagtgtgatttatgcaaaagctttctatatgaatgctgttttagaaaatcatattaatccatttttcaaaaaaaaagttaatacttaattaatcatgcaataaaatgagcttcattttgcatgccaggagaaggggttcccaacccctcctaccgaacacagccatagccacatccaactccgtgtttttgagtttcagaaacaggctttactatttgttgtgcaatgtgatctaaagcaaaattcgtcacagaaggcaaagcccaataactaactgtaataaacgttctcaaatataaatgctctcaaatcaacaacagtgacagtcttactactgatttagactggaagtttggaagctaacattccggaaaagtttcagatcagtaaactcggctagtaacaatcttactgagtactgaactactgaccatgctaatgccactaagcagcacactacaggatttgaattcaatgccatgctaccataattctattcatcgcatggtcctcaacgatcggagtagtaatatactccctccgtttcgttttatttgacaccgttgactttttaacacatgtttgaccgttcgtcttattcaaaaacttttgtaaaat

SEQ ID NO: 74886 - DNA, 13432 bp, Oryza sativa
gggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattacggtgtaaattggctaaaaaatggaaattgcccttcgatatggtgtttagagatggatgacgatcgagtaaatattgaatgaaatagcgggaaaatagaattgcacgaggcaaattctgtgaacaattgaattacctacataattcctaatgaacgggattgctatatattattcgactgaaatatgggatagccgtgggtggcggaggaccggcagtgggcggtggacttcggcgggcggcgaggcagcagcggcgccgccggagccgcggagatggaggagggcggtgggccggcgtcggtggcgggggcaaagcaagagtgaggttaggaggtggtgggcagtggttgcagatccggcggcggggagccaccggagatgggggaaaacggcggcgcgggggcacctcgccgtcgccgccatgaggagaaagagaggggggaaggggagggggaaagggaagggtgagggggctcgccgggggggcctcgccgacgccgttgactctttccggccagccggcgaggcaggcagcggcgcggtggggtggtggtgacggtggaatcgcgcaacggcgcgaggacgggagtggtggcggcgttctgaacggggaggagaggagttagggttaggggggtctgcacgaatctttaagcgtatccagtggtccaaaattcgaatgataggaggtgggattttctatcacaagatatatagacaacctctttaatgaaagtgaaggtttatcctagaaccatgttttttttttgcagggaagaaccatgcaaattgttattcaacaatatgtaatatgtgatgttcaaatatcattttgttactattagttacacatcactctagcattgcttttaccccattaatccatatagtaaactctgcgctggtaaagttttgaagtcatatgctcccatcgaaacatacaacaactaaacttagcttacacatcatcatccaacatagataatacacacagcctcatcactaggagtatcaccacatcaggcggaacagccacattagctctacatcttgctatctattgcaattgtggtatgagatatattgcaattgtggtatgagtaagtgatttgatatcttccttatttagtagtactatgtcactagatagagcaactaatgaatagctgaatagcaaaatagtgttttatatcttcacaactgttactaatccaagttctagaaggaatttagtattattttttttcatgaagcaagtaatgacttgttgccaaacaaatgctctcaatgggattatctcgtttctttaagtttaccgttttacttgatagaataagaaatacaactatggggtgtttagatcccaccccaaaattttataccctgtcacatcgaatgtttgaacacatgtataaagtattaaatataggctaaaaaataattaattgcacagattgtgactaatttgcgagacgaatcttttaagcctaattgttccatgatttgacaatgtggtgctacagtaaatatgtgctaatgacggattaattagacttaataaattcgtcccgcggtttactgacggattctgtaattagttttttttattagtgtccgaaaacccatgcgacaccatatataatacctgatgtgacacgctaaaactttaaacccttggatctaaacaccccatatgattgtcttaaatcaattgacattagcccaatcaaacctcataattagagcaaggacaaagggaagaaaatgtgttcatttgtttgtatgattccacatctagcatacctaatcaaaagaacattattctattctttttatgcacaccgtgaccgcgaataaggtaacttcaaaggtacaatgagaaatctaaaaaaaggaaatttttattgaagatgacgaggtaataccgtaatacacacttttgcatccattaagtaagaagagcttgggctaaaaacaattattgcaaggtcgaagctcgcctcattcatcttgatacttataagggaatggacaacaaagtctaacactttcgagagtacgtgttttggaagatagagaaaagaaaatacaacaaggttggtccatttaccccaatactaatgggattttatttggttgacatgcctaaccaaagcatcaatccatgttcatgtgtgcctacatctatttggttcattcttattgatcgggcttagctaatactagcagtaaaaaaaatttagatatgatgtgaccatcaagtataggcatacaaccaagcatgagaaatataaagcattgccaaagaggatgaatggaggatgtacaggatattcaagtccaacgagttttagaatccagttcggcctccagagacatcactgacttcaaacggacctatcgccttcatgccaactacgatttgcgtgatcttggaatggaaatattatctcgtcatctttcaaatgcatccagtctcatatccaaattcatctcgagtcaacgagaatcatcaaaacaaaacagtgctattgctgaaacggaacttgggcctttggtcttgtaatagactagggccatctcagaagtgtctccctccacctccccgaattagtacttaaccctagctctagtttcccctatgaatgtctatttacaccgtctagaacaattgggttttatttagttgaattatgccaagtgctattcaccttgtctctagttcttactcgattagagcatccctaggagatacgctactacatcctccgttcgcgatttggcgtataggagtgcaaaaaccgtctccaggagatgcgccatccaatccggcaaaagtggcggatgcgccaaaaagggagagagaaaacccaaaaatagcgtgtctctctcctcgcgccaaatcacaacgatcgagctcccgcccccatccggaattccacgacgtcccctcccccgcaacctccactccatcgtcgtcatcgccggccagcgaaggggagtgcgccatgcccgtttttgatttttttttttgcaatggagggtggagagaaaggggtgtagccgtggagtgagggtggagggggataagcataccagatcagggaggagagcgccggcagcgcccaccgccatcgccctgcccgctgctgccgcctgccgccgttgcccctcgcccaggcgccgctggatttagcggtggaggattggagtagatgcggaggcccggccgccaccgccgcccgccgccgcgacacctccgcccgcgcctgcgacacggtcacctgcgcccggtcgctcatccgcccggcaaccccaccgcccgcggccgtgaccccgccgctcgcgcctcgcccgcccgcgcatgtgaccccaccaccgcccctcaccagctcgctcacgagaagaatagcagtagagagagtagtagagaaggttagttgaaagatgttataaaaaataggaggatgcgatatggatgatgtaatatagatgatctgttggagtgggaagggatatgaacgaggaatcttttttggatgggcatccatatgggcatatagaggatgatatttggatgatctgctagggatgctcttagtcgacgactatagattggcaccccccctaaatagttggtgtgttgatttacctggtcgatcagatataccacttcaatcgcaactatttctttgtgcttaatcacctattcataatatttagattgcatcttatcttgttcttgcagtgttctctcgtttgcattgcaaggatcctcaaccgcgtgcaactatttctttgtgcttaatcacctattcacaatatttagattgcatcttatcgtgttcttgcaatgttctctcgtttgcattgcagagatcctcaaccacgtgccacggttgatacgacatcgtttatggtgtagcgattgcatggcgatctagacttgttctgattggtagccatgtcgtacacgtcacactcgataaaagcgagagttatcccctaccagaagatcaggccacgagagagagcacgtcatcaagatacgtcagtatcataattgataagtagaatgagaggccatgcttacttgggagagatacatatgtcaactaatgcaacccattttttcacatatttggagtacaatttaacatctttttccctctttgaaatctctaccatctggtttattcacctaacgttgaaatgaacgaggaaaattctgcttgtgaggcaagccttagaaaaagcatgcccttgaaaagaccatgcttgatctctacacaacatgagacctaagaaaaagactttgcaacttaaaagggtgtgttcaggaggagttgggaacttctcatcaccacacgaaaacatgatagctcattaacacatggttaattaagtgtactagctaaaagaacttgaaaaatggattaatatgatttttaaaaacaactttcatatagaatttttttttaaacgcataccgtttagcagttcagaaagtgtatgcatagaaaaatgatatagtagaagttgggaaagagtagtgccgaactaagtgcaaatcatgttttgaataataatacgattatcatcttaagtaaaaacgattttgctagagatcaatcaaaagacctttttcttagccatcacaggtgggaaatcaatcccacgacctcttggttgatgccacgcggttgtaaccagatgagcaagctatcaatcctatcgtgtttaatatactccctccgtttcacaatgtaaatcattctagcatttttcatattcatatttatctagattcattaacattaatatgaatgtgggaaatactaaaatgacttacattgtgaaacagaggaagtacaaccgatgtacgatgccattataatataattaaactgtaattatattcgtgtgatttttacattgaaaaaaatattttgaacgatatctagtagccccaagtaaaaaatatatttagacccgaaacttaccattcaagccaaggccgtgtttagttcccctaaattcccaactttccatcacatcacatcacatcacatcgcatcgaaaacttttctatgcacataaactatcaactttttctccaaactaccaactttctcccaacttcccaacttttccaccatctaaacacagcccaaaaataaaagagttaatttcacaaaactataggtactttgtacaatatatcacaaaactacatatttaagagtttgtttcacaaaactacagatttattgtctccgtttatcacaaaactataggtacctgtacaatatatcacaaaactacagatttaaaaacttgtttcacaaaactatagatttagtgtatccgtttatcacagaactacacatttagtgtcttcatttattacaaagctacatatttagtgtcttcatttattacaaaactactccctccatctacttttgatagtcatatttccaaatctgaaaaatctatttttgataggcatatttcaacccaacgacctatcctcttaatgactttctcggatttaatgcatgactctccattattccacacaagattggctacatgggcatcgagaaatgtaaatattaataaatctcttgtttacgaggaataactagtagcatgtttaaatggatgataagtagaattacttatccttgtctgtgtgtcaagatgaaatatgactatcaacagtagatagagggagtacatatttagtgtcttcgttatcacaaaactacaatttttgcattaaaacctgtagttttgtgataacgaagacactgaacctatagttctgtgacaaatgaagaaattaaatttgtagtcttgtgaaacaagttttaaatctatagttttgtgatatattgtgtaaagtacctgtagttttatgaaataagtttataaatctgtagttttgtgatatatggtacaaagtatttgtattttttgaaatttactcaaaataaaacctgagtaagaagatcagcccggcccggaccagcccagccggtccacaaacatgcaataccacatttcccttttcttaatttttctaacacgaaaaaaggccccgaatgggtgggaggggcccgttcgtcttctccagtaacgcaggagggaggagctcgtggcggcggcgccgccaccgcaccggccggcggtggggacgcacggcgagggacccggtcaatttttcccaaaacaaaaagcgttcaaatcctcaccacctcccatctctctctctcttgacctcacgaatcccctttgccgcgagcaacccgcgacctccctccctccgcggccacacgaggtacgcgcgctttcccccttaccatctcgagataatccccgaatcgattgatttcgacgccgatttgcggcgatttccacaggcaggtttgctcgcgtccctctctgctctcgattgattcgttgggggttcggggggttgagtgctcgatcgttttggttgcgtgagtcgcggtcgaatttagggtagtattgcttggcgattcgtttgcgcggactggatgggggctttgattggatggggaggtgggaaaatcgctatgcatgcttgttgattggaattggattttccatgtgtgggcgttgcttgtttacattgggattgatttgcagagttggacttcatctgattgcgttggaagcaagcgaatgtgtcgtgagattgaataatgtgatatacattttcagatgttaggtgccatgtgttaaaaacaccctcgggtcgtaggtttgatctccatttatgatttgagtgagccggggagccacagcttaagatgccatatgtgtcatatgttgtttggggagagaacggaattggattgataggttttacatacaacaccgcattgctgaatttataaaatgcacagtagcgaaggaagcaaaacaatgtatcatacatacccccctggtgtcattttccatgacatgctgcctaagtttttccttgtcgttttgcatcaccgggatagttgttcccatcttgtgcatagttagccacctgaaaatcacaaattatcagtttgcgcctggcaagtaagccaaccaccaacaaaatttcctatctagaaatctgacagcgatattcttcctgaacctgaagggctaggaataatatgtctgcagtactgcaataatcataaactcaggttaaactagttgtgtttcgggcatattgcacctgggattattccaatatattgccaaaattttaaaatgacatgtttcggttatttttccttgtttttggaggaaataggtggaggatacctttagatcagcagaatccccctttgggagctaaaaactgaggagtctatgtgaaaagaaagattactgggaaaatcgtaaaaacttagacatgttagtatgttcagcgtccttcttcatagaaccataccatctgtttcatcttaagcttcaatggtcatgtaaaaggtcctttgaatgactgcaagcaccttccataggaagcattctgatgttggtttcagatcatgttcatatgatggaggttaaaagcaatccatactttatcaatccagtagaacaataaagtagtttttaatttttggaatattcagaattggcagtccatatatgttgagaattttctcaatatggaacgaagattccaatttcctaatccagtgctggtgctctacagttgacttcaaatcccactgaattatttgtgagcaataagtcagtgctagttccttgctaagccctttctagtgttgaaattttagtgtttaattctgtgaacttctagggagggaggatgatgtttttaagaaataaaaaatggagaaaaatactcttgatttcaccacttcctttttcaatcttgcatatctcctgcagtaagcataatctcctgcacatatgctgcttttccaggattctaccttttcttccgcagctgtctatctaccgccatggagcactgaagccccaagcatccaaatcacattgaaatccttccatttagatcaccgtaagtgataactgttgaaacttatgctcaccaagtcaaccacgcacataatagctgccctgtaaagcaatgttttgtttgttaaatcccattggaagtccatgctctctgcaacaatatcctggtagacatgttgcctcctgttgatccagttgagcgcagaaaacacaatcaacattcccatcacatcctgctcggctttttcttggttgcaaggactaaccgctgaaggatctgatcattaattggaactggaagaccccatcatttctatacttcttcagggatgtattcatatcattatatcaaatttaaaaacctatatggtaaatctacatattctgcaggctgtattcataggaattacaacaagctgtgcaatatatccggaaaacattccttgttttcttagtggtccgctgatatggccatacatacctcataggaaattaggtggataaatttagaacattcaattattttagtctcaaagatggaaatagatttgcaaaatgcagcgtgttgcactacctcttagtgttaacatagcattctgaaaataagaagattattgagtattgacactgctattagcatttgttgataatattatatgaatttctttctttctttttatcagtgtagatatttgcatcatctggactcaagactccattccattttgcagtggccttttgctttcaactcaatctcaagagtgtaattaacttggaaataaagacaggtgacttattggtaagcattatgtcctgcttttgcacttttcttgtttaattattaccatttgtttctccagttattttgtgcatttgactgttttagtggcttccatagtccctcatatttgtgttgcttgcgttctagtgtcccttacgttttatagtttggcattgtggaattataactctcgagcaccatttcaatgatatgccgctaaagtacttgtatgtgcagttctagactgtaaccagataatcctgctttaaaaaactaagttaaattgccataaaaaacaatgttctgattttaggttggttctaattttctattgagctacaatttggtattgtggggcttgttttgtttgataccaacttattgccctaccaaaattttggtaacttcaatagtagcaagtgcatgtttggtttgctaccaaattttacccgcatcagttcaaattcaatactacccaatttggtagtgccaaaacttgccaaggttttggcattaccaagattttgatagggcaaaattgattccaaaccaaacaagcccgtggtttatgagccctacaattaatacttaatgtaggaggatacctaacatgcaatctatttatacagttctactattttattggagaagaaccatgtaactatgtagtggtgaaggcagggagccaattgctatttgatagtgcaactacattacagaactcctcaaattaaactacttgaacatatactacataaattgatgttactaggctgttcagatttacctttggggatttctggttgagagttgtgtcataggaaaaactgtgggaagaggagctcatggaatgataaaggggatttaagtgtggtaggaagaagggaagaaaatggcatgagcgtaaatgaggggttttggatagggacatagttcggctgcaccatcatcgaatactatcactctttggtgcacataatactggcatatgctagtctgcaatggatatgcattttatggtaggaaggtgcgtgaatgtgagtggctgacactaaaatcttgggagggtgacagaaaaatattcacatatgactcgtagaaataagcaatgagaaaagaccttctagcagatatcacagcttgcatctttatgaaaactttaatctgctatttgagttgtgttatgccatacttctccagtagcacgaagatggtgttgagatatatttgacttgatattgctcagtggtcagcaccaatagaaacaaatattgcatactcctgatcctttccccaatcattatgccctttttgagtgcattaccagtcagacttaagtgcttgcatgatccataaaatctggttatattcatgtgtaggggccaatggactcccacttggccattcactttgtctattaaaagtcattataaatgatatgatgaattgcattgggtgcattgaaggctatagtatagtgcttgatgtgtgtcatctctctctaccaacagagaaaaacagagctaatgttcctttttaggcttatgtactctttgtttgctgccatgaaagccaaagtttgccaagggaaattttgttatcaccgcccaaatttggtctttgttttgatgccacatatcaggaaggttccgtacaaatggttttggttactctgtttagttcactcttgagttttgactccaaactaccaagatcaggacagcctttcatgcgcaattttagctttgaaaccaaatatacccttgatgcctcgagaagattggtctccctgatcaattggaactctttatgctattctcacccttttttctggcctcccatcacaatggctcattttgctcaaggtctgttgaatgcaacaacttaaaatcataatggaccatccacagatttttttttttcgtgtccatcaagaaatgaacagaagagtccgagtgataaccacaccaaaagacaggattgatctaaaccctaccaagcgctagctgagtaggatccagtacaataaagcaaccggagtttcataaacattaaagtgtgtttagcgtgtcaaaacgctaaacgtactttattgttgaaactgtcagtgctttgctggcctttgattctatgttacttctcgagaagacatgggctgttcatttcgtaccatgaggccccaaacctagaagcctagatgcatcgaacatgcagacttccattgttagatcgcatcagtattcacaccagagtcacgtgaaaaccagccttgtccgattaaattgattttagcactgttcgaggcccataaatcattttgtcattccttctgcactgcttatcttcttccttgtagattgctagttagttgccccaaaatccatgtagacatcactgcatcagatgctggtttcggtcgctttcatcagaaacaaaaaaaatgatcctttgctctttgaagtgttaaaaaatgcaataacattccagtctttacttaaacagatattcagggaggtaaagtagcccaaaacatgggataaaaagtgagctgaaacttctctgcaatccgagctgtatccattatcttatttggtagtggtaccgtggattgggggcttggaacaccacatgagatgttcttcttccttaggggagaagactgtgtcctcaagactgaaaagctttgtcaaccttttgggagcatgtgatggatgtcctctaaacacccagcttaaccatggcctacaaatacaatatttgatttcttattgtcatctgtcccagaaacatgcttgcaccggcatgcttcgtgttgcttctgtgtgaataccaaatttttgtcaaaaaaaaaaaagaagcaaagctttaaagcaatctatattccttattgctagtagctttgagcaaattgagctggacatcatcatcactcatagctcccccttaaacaatgttttgtttgcatcctatgcactcctagtagtgtacacgttgctttacttcatggttgttactcaccatctttctggaaaagcaaagcttcctttgtgtgcctgttactacttgttaacacaagttacactgtcaagttgcagatacatttttttttttactttgcatcatcttttgactgtcactgtgcccccttagctagatatctggacactgttggccattgatgctacatatcagattcaggtcagtatcagtataggtaggtggtatgccatcgacgagtagggttcttacgtccaaagggtgtgttaggaggtgtgctaccatcagccacatggataaattcctggaagaagccggaatgcatcaccatcagagtaccgagtgccaccaatgccatgataggatgaacccaagacgtgtagtactagttgcaccgtagcagcagcacatagcaaggccgtgtggttggcgatcgattgccgtgtgggtgtgcgcgtgtgtgcgccctgataatgcaccgactcttgcagaagaacaggagagttgcttggctgattccggttggaggatagtagtgatgattttccattaggatttaggaatcgtgcgccgactagtggactagtaatgcttcacggagaggagaagcagaagcagaagcagcagcatgggtggtgccggtgatgtaagtacgatacgctaagcatcctatcgcaagttcgaagcacctttgcaccgcgttttgtgaggccccacactaaaagaaatcatgtcatgtgccccccgtgtttgctttaatttgatgggcccttaggtccttttttttattaagatacatatttttatcttaattttaattcgagtactcctagctgctagacagtatatttcgtaaaaaactttctatatataagttactttaaaatatcaactaaatcaaaatttcaagtataaaataattaaaacataattaattgtatgctaatatatttttttcgtgtccacaccccatctttatatgctattttctcaaacggggccttaataagaaacttagaaacttgctcttcctatttctgctaaaatttgtactgtttgttcctttgagaaatccattactaattcatttctgtagaacatccagacaagaggttactgaaatgtagcataacgaatctt

SEQ ID NO: 74887 - DNA, 1394 bp, Oryza sativa
ttcctgcagcccgattatcaataaatatcaaaggaagtatgagagataggaagaaaagtattatgaagatgatggtggttttgatcctcattgggactgtgaattttttagattttgttggaatgaagggatgagattgccgtcaagagaagattgccgaggatgcagtgattctaataaaggtttcacggggagctcgagccgatcagaggaagctgcctgttcatcagagattgggtccgattcattaggattgttttcaggatgaaaatgagggcaggaattcacaatgttgtccttctggtattttcgccaagaatcaaaagagaagggtctagaggatgaggaacaaggagcgttttcaggaagtacagcaagagatcaatcatcggttgaaaaaggttggggcaaagcaagagtggcgtgttaagagtaaggtactaacggccgatgaagttgaagctgacaaggcaaagagactagctaaagggaaggctgttgcatcttcatcaataaacatggtttttgtgctacctgcagaatatgaagctaatcaggtcgatgtagatgttatggaagaaacttttactaagttggcgttgtcacctgaacaagctatttttgagaaaccagaggggacagagaatcggcatctcgagccattgtatgttaaggggtttgttaaaggtaggctgatgtccaaaatgatggttgatggtggggctgctgtaaatttaatgccttatgctcatcaaaactaatatggttcttaaagatttcggtggcaatccttcagaaaacaaaggagtgttgaatgtggtgttgacaatcggcagcaaaattgttcctaccacgttttttgtcatcgatgggaagggttcttatagtgtgttgcttggaaggaattggattcatgcgaattgttgtattccttcaaccatgcaccagagtttgattcaatggcaaggtaacaagatagaggttgtaccagccgactggtcagttaacgttgctagtgccgatttaactgtttgggagatggatggaattgattgccagtccggaaaaatttgggaaggaggttatctaaaagtgtccaattgtgatatacatccaattgaagacggagagcctcaattgttgctttgagggagggcgtcgtggagggttcaaatttctacaccaaggatactgtagatgatctcgatggcaaattaggacagggttttatgtcggccgatgatttagaagaagttgatataggtccaggagatagatcaaggccgactttcatcagcaagaatttatcatctgaatttagaaccaagttaataaagcttttgaaagaatacagagattgctttgcttgggaatattttgagatgccaggactt

SEQ ID NO: 74888 - DNA, 3660 bp, Oryza sativa
ttctttgttggtgagatcaatcagttagcgggggaatatgagtgcaagaatgatacattgataatctacaatgagaagttccgagaattgatgaatagttttcgggtggtgactttgaagcatgtctctcgggagcagaacattgaggctaatgatttggttcaaggggcataaggatacaaatagatgatgaaggatattgaggtcgaagttgctacgattatagccgatgattggacgtatgatgtgtttcagtatttaaaagatccttctcaatcggcttcaagaaaattacgatataaagctttgaaatatgccttgttggatgatgaattgtattatcggacgattgatggtgtgttgcttaaatgtttgagtgccgatcagggaaaggttgtaatgggagaagtacatgaaggcatctgtggtactcatcaatcggctcacaagatgaagtggttgcttcggcgagttggatatttttggccgacgatgttgaagatttcttccgacattataaaggttgtcaagattgccagaaattctgagcaatacaaagagcactagcgtcggctaagaatcctataatcaatccatggccgttcagaggttagggaattgatatgatcggccagatcaatccacctttaagcaaatgacataagtttatattggtgggaaccgattatttcacaaaatgggtggaggcagtcccattgaagaaggttgactctgggatgcgattcaatttgttaaagagcatattatataccgatttggtgttcctcagactatcacaaccgattagggatctatctttgtttccattgagtttgtccaatttgcagaaagcatggggattaagttgttaaattcttcaccatattatgcacaggctaatggataggctgaagcatctaacaaaagtttaattaaattgatcaaaaggaagatttctgatttccctccgcaatggcatacgaagttagctgaggcattgtggtcctatcggatggcttgtcatggatcaatccaagtcccaccttacaaacttgtttacgggcatgaagcagttttaccatgggaaagtgtcatcggctcgagaagaatagatttacaagatgaattaacagccgatgattattataatcttatggtagatgaaacagaagacttggttcaatccagattacgtgctttggaaaaagtgacaagggataaggaaagaatcgctcatcattataataagggagagttggtttggaaattgattttgccaataggaactcgtgataataaattcggcaattggtcgccgaattgggaaggaccttttcgaatctataaatttgtttctaagggagcttatatgttgcaagggctcaatggagaagtttttggaagagctctagatggaaagtacttgaaaaaatattatccaagtgtttggatcaattcatgatcggttcggttataccgatgcatgttagccgatgtgttgacatcgccttcagatggccgatataagttatatcgcccttcgaatttttattgttaccataatcggttgtgttatgcggatgtatgatggccgatataagttatatcgcccttagaatttttattgttatcataatcggttatgttgtaccgatgcatgttagccgatgtgttgacatcgcctttagatggccgatataagttatatcacccttagatttttatttttatcataatcggttgtgttatgccgatttatgatggccgatataagtcatatcgtctttagtcaagttataattttatcaatgtttactcagcattgcaaaattaagggggcatacatatatatgaaaatatgcgaattccaaaacaaaatatgtattcagttcaagttcagattacaatcactatgcacagataacttttaaccagatacaagcttgttaatagccgatatagctcgttgcccaatttgttctatgtcctctatggcctgagcgtcggttgcatcggtgtcatggttatggataccacatacctaatagaagttgactaaactcggcaggacccaccacataccacgtcttatacgagaacaaacctcgtggggagagaggacacacccaccacagacgcacaatacacaagccaatatataccaagacaagccgccggatatcaacatcacagattagtctagacataccccatccggctcttacggaggtcggcaagagggatctagcaccatttctgatctcgccgagtacggattcgaggaggaagactaccctgtcgtcgactacgagttggttatctagccaccaagtcgatgagagctagataggttatcaaaaatattgtatttgtgtgattcatatgaataaagagcaataccggcttcgaccaacaggatgttgggctattacctatcagataaggggctcgaacctatataaaaatccttgtctctatctcttttacctcaatctcgcatataccctggtaccgacgatccccataccatccaaataccgtagtcgtgatctcaaacgtcgacagtagcgtgccaggtagggggattttggtgtttcaagatttcgacgagatgggtttaagagacggactctccaacaacaagctactcgatgacttcgaaccagggagatacaacctggccagagtacgtcccccaatgagatcggaatcatcatcgtcaacaaatttgatctatcgagatcaatcaaggtgtcgcaagccttggactcacatgccgacgccgacaagaagctgcggcgcgcactggtgggcggcggagctagcaaggtcattgtggcgctcgtccttgcccttttcaggtcgccgggcagcgtgttctatccacagcaaggcactcttctacgcctattacgtgatcctgctcgccgttgccgtgttcggcgtggcggaggtggctgtcggctgctgggtctctgcttccccgagcgaccggcggcgaggcgtcgggaaggtggtcgtttgggcctctgtcatggcaatcgttgtcgtcgccggacttggatgtttcgccgtgcttaagtaatcaatcgtgcagcaagtaatcaatcgtgtagctgagttgggtgcctgcttgttcttgtcagtttaagctgcagtcgtttgcttaggaccaaacaccttcgggcgtcgccgccgccgtgctcgtgtgctcggtgccgccgctgtgctcgtgtgctcgtgcgccgggtggccgctgcgcttcgtcgtcattggcgatgggtccctagcggtgcgccgccgcttccccggcgtgcgttgctactcacccgcggagggaggaagaagaagaagggagaaagaaaagaaagagaggaggagagatggagagctgacatatgggcctaagggtatttttgacatttcacgcgatttctctctcctcctcaaccggaaatcattattttaatcggcacggtgtctattggcaaattaccacgtttatggagtgttttcccccaaaagtgagtttggacagtgtcccacggctaaaaccacacaataatagtgtcctgtagcaaaatttgcctttgctatttggagcgcatgcgccagaaacggaactggcacgcagcaactggcgcttcccatgggtttttt

SEQ ID NO: 74889 - DNA, 15846 bp, Oryza sativa
cctcccccctccccctcccttgtttatataaacccgaccgcaccctggcgccagccatgtcatcatcatccacccccaccggagcagcagccgacgatctcgccgccgccaacgccaacgccaaggagtgcgtgttctgcgagatgacgcggcagcaccacccgcaatgcgcgcggcggctcccgaagcggatcatcctggtgcgccacggcgagagccaggggaacctcgacatgtccgcctacaccaccacgcccgactaccgcatcccgctcaccccgctcggcgtcgaccaggcccgcgccgccgggaagggcatcctcgacgtcgtctcctccgccgccaactggaaggtctacttctacgtctccccctacgagcgcacccgcgccacgctccgcgagatcggcgccgccttcccccgccaccgcgtcatcggcgcccgcgaggagtgccgcgtccgcgagcaggacttcggcaacttccaggtcgaggagcgcatgcgcgccgtcaaggagacccgcgaccgcttcggccgcttcttcttccgcttccccgagggcgagtccgccgccgacgtcttcgaccgcgtcgccagtatgtccccatctcatttcaattcaattccattctcccattcttcttgcaattcaaaacgatttctgatgaaattcaatccaattcaattcttgttcaggtttcttggagtcgctgtggagggacatagacatggggaggctggagcaggacgcgagctgcgagaccaacctggtgatcgtctcccatggcctcacctcgcgggtcttcctcatgaagtggttcaagtggacggtggaccagttcgagcgcctcaacaacttcgacaactgcgagttcagggtcatgcagctcggccccgccggcgagtacagcctcctcatccaccacaccaaggaggagctccagcgctggggcctctccccggagatgatcgccgaccagcagtggcgcgcctccgccaaccgccgcagctgggccgacgagtgctcctccttcctcgccaccttcttcgaccactggaacgaagacgacaatgacgacgacgacgatggcaaggaggaaaatggcaagaccaacaagttgctcgagtaataatcttgctgcttgcctctacttgctctttctttagaaattccgtttaaaattctttggaatttgattcgattggtactactagtgtatttctccattggggcgatgcaatgtactcccctttgctgattcttttctgtttgatctgtagcctgttcatacatagttgctagatactacattgataaatactatatatgatttggggaaatgaagcaaacgatttgactatcaaaaggaatcattgcctatattctgataaacacataggataaatctcgagggtttgttctgaatctcattcctattacttgactgtcattaaaggggatctttgcctctcttctgtaactaaacacagccccttttgtttcacctaactttgtttaactactaataatagataggtcacattaattcgagcttttgttgacagtgatatatgagattatggatttctctgtgaaaaacactttacttttggggcaaatgcagcatgttgttagcagatcacctgggaaggccagatacgcctccatgctttcgttcaatttggttcttgttttccctgattattttactcctagatatggccatggcctctttactattttttgtcggggtgaccgaaggaggtcatccaatgtaattaagatggaggaaacctctttactattacaatgtgctttgtttagctaataaagataggtaatattttacatcttcggtttacaatttgtttttacaaggttatgtatttttgtcaaaaaaagggggggaacttagcatttcgtgtggttgcattcttcctttttgtgacgggagaaaaatggtagtatctgttattcatgtatagctagacacacactccagttttcacatgcatatgtcatcagaaacaggtgcaaatgcaaagattccttccttgctactagttggcatgttcatccttgactacacactatacatctagatgttgcaatttcgtgcagtgcactacaagtaggagtacttcttttctccctttttcttgttattttatcttttattttattttctaaaaaaatcagaagtactagaattgtggaaccacaaacagagcactgtccttcctggctggtccagcaaacttgcccatctgacaatctgagtactaggatccatgctccaaaatctctataggattgtccattccataggaatttgaaaggattggataggattcaatcctttgtttcaaagtgctttataggaaattttcctataggattgaaatcctccaaaattcctatgaatttcctttgaatcaaagttgattttagatatttccaatgtagttttattttcatcattagtttttaagtagctaagtttacgcgtaaaaaagttattttttaatcgttaataagtcattttgacttgtaatcaactcatgtccaactgatgggtccttcatgtcctgcaaagtgtgctgcagtatgaacttcagatgttcttctccttgtataagttcccatgaactgcatatgagcatatcagcagtctgaatattttttgagcaattggggcgagatccccaaatgctgggtgaggtgtagtcttgaccatcttttttttttcttctaaagatggatcaattcccatcagggcttggatttcattaataagcatgaaacttgctggtgatattttgttacatgatggcaattcaacagggcagtgacctacatgttgtacattggaatataagaacaacttgtcctgacatgtgtagattgcgcatctaatttcgctaatgtttgatcctttcagctgccatgaacatgcttcatcactcattcactccgatgtttaatattccctccagtattttatttcccatttttctaattctctgaagtcaaaggggtgccattttgattactactcactctgatcctatttactactctctccacgggaaagtattttctacacctagatattatgacaactaggtatatgcatatagtttaaatagctatataaaaattcataaaattgataagatactttatgataatataagatactatacaaacatacaggtttaaattcgatctatacataaaaaacaaaaacaacaaaattatttgcaatgtagaaggtatttcataatgtaaggcatggtcaaacttagtacggtctctaaaactaatctttgacttataatttctcgtatactataaagtttgtagcaacaaaattataaccatatgaaaatatattgaaataccaatttaatgttattattttcagcaaataaaatttaatttataatatactaatcattagtctttttttaaagttaaaccttaaaatgtgtacgtgttttacattatggaatggggcctaagtatttcgatataggggttgtaatttctttaaggatgattttttatttgcccatgtaaaatactctcttcatgtggatgtgtcacatccacccaaaatcctttatattatgggacgggagaagtgtacgtgaatcgttgttttcatgtaatgagtcaattagggatcgggtcaactttctagggtaaataaaatataatatttttttgtcccttcacatacagttgaatataatttaggccgagtttagttctgtcgaaactagatttcggcaataataaaaggaggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtaacccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccgacgaactagggttcacaactccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgtcatccgacgtaacggaggagaatcttaaggagatggtggcgcacggcgttctccctgccaaggagatcatcaggtggcgaccagcgcacggtgaggctttcccgtctccggatactcatgagattgtggtcttctcgcatttcttctacggcggctttgctcttccgacctcaaaatttttccgcgggatcttgaacttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgcttagttgactaactatggaagcatcttgttcaggaatatgcattgatgaagtcagatctaccagtcactcagcaccggtctcctcgccaacacaccgctcagggaggtggagggccaacgatcagaccagatccgcaacctcagacctccaaattgactggtcaaacaggtcctcgcaagagaaagctagtacttgatgatgatgaaggcgacgatgataaatctggggataagggctcgcctaataaacccccaaaacgtaccatgcccaggaaaaaactagctggccgtgcaatgccaaagatcagaacatcttccaggtattagatctctcggtatgatttccgcttcggcatgttttccgatgaaaataatgctaaatactgaaagaacactctgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtatatccgtctaatgtcttggaaacgcatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcacccagatctgttccattgatttatgctgtcataattgcatcctcaaccatctggatttcaaacagcgcaagccgccaggatggaacagatggcgaagcaaattgaagccctggagagagacaagacaggactggctgcgcaaagggactcagccttgaaggaagtcgaaggtaacgccggctaacaatctgagcttctctccttataatgcaacagatgctcatcataaatgtgttttgcagatcgcaagatcaaatctcaagctcagttcgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtatccgagaattgaagtcgacaccattgatggatttgcagacgggacaagtgaagaagctgcccttgatctcatcagcagtgcgcaaaatgcggctgacaaaattgtgagtgatgttgtagagcaatttcgcaacaacgacctccagccgagtaatgaagactctgatgatgaaaggactgattctgactgagtttgagtgtaatacatggaggctcaatttgtacaatactggtgtatttatgctgtgcttgatgattcttgcgaagtttttgatttcttaaaagtttttgctaaactttcttgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaatatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcataaggtttaagccggtcaaaaactcgagctttaatcctttgaagtatcatgccgttggccctctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtcgcgagcattatctgctgtgattgtgacaaccggtttagcttcaatccacttggagaatttatcaatggccataaagagatgcgtgtaaccgccaactgcctttttaaacgggccgaccatgtcaagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtattgagggagttcttgagaagtcaaaaatcgtatgaggggctctcgccagtcggcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctgtcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagtacataacttagtctttctccggtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattagaataccatataacagcttctgaacctgagggtacctcgttttggagtcagccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggatttaacttcatcctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcccgcgttctttaatccaaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcggagtcgttgtttaataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtttcggcttcggtttccccactttttgaaatcttggcagcgggcacttctccttcgctcaccgtggttgcagccagtcggatttcctctcgggcagacgccatctcgcgggtttgggccatgtcgcaactttccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatgtggttgagctccttgcggtggtcttgaaatccagccggggtgtcgccgtcgtccttcttccttgacgtgctttgtttctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttgcgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgccaaagccactggtaaataattcgccatggccttattgtctcctcctgctgcgcggattgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgcatgatcgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaagatgttgatgacatgatcagattggttgtgctcgttttccttgaggggggtgtcgaggagggtgatcgcggcaaccgcattctgctgaggggtacggaaaaccggtatcccttcaacatcctgctggccgatgagatcacgcgctcggcgcccagcttccaaggttcgctgccgtcggtcttcagcctccttcgcgttccgctcgtgcacctgctgctcccgccgtagccgctcttgctcttgtgcttggcgctcctgctccagtcggcggcgctcgatctcgcaacgtgtttcggcttcccgggcttggcgctgctcctccgtttcattgtcggccataaagacgccgaagaaaagaggagtgcagttgtcttctaggcttccgtcgaagtcgtcaagatccgcgtcgtcgtagtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcccaggcctacgggatggagacggcgtggcggtggagacggctgccgaatcgtcagggagctgcatcaagatcgatgggtaaggctcatcatcttgatctggcgttgttggagtagatgcgatctcggccgagtggtttgaagccgactcgatcgagatggtcttgaagtaactttctgccgcgtttgggaatccaaacgggactggaagtcgattatctcccgactggtctgattccgagtcaaggagagaaatcttgccgaagttgttggtgacgaagtcgaggctgccgaaccgaaacgtctgcccgggtggaaagacgaagtcgtcgatgccggtgacggaacccatcgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacaagttccaatctttttcttcaaactttcaactttttaatcacatcaaaacttttctatacacacaaacttctaacttttccgttacatcgttccaatttcaactaaacttccaattttagcgtgaactaaacacacccttagagaagtgtaaaagtgcaatgctttgttcgtaacaaatctacccctgccaccgccatgtataaaaaaaaaggagaaaaagatcatgcatatgatgcattgaacctacagaaagctagcaatctactccctccatctgaaaaaaagacaacctcctagtacaatgtctacatttgttctactaggaagggtcacatcccattttaagttatctttttttttggacggatggagtagacgcctcatgtgatggatctttgatcgacagaaacctgacattttcatatctgaaactgtagtcgacattctagcagagaccaaatctcctctccttaaaggcataatccttatgcatgatcactgcaccccaagtgatgctaccacagcacgcgcgcctccactgcacactccaccactccccaaattcacccccaatccatgcattttgcacatttgcattcttcctactcgatcgatcgcccatagtgcccttgccaccacgccttaacactgcattatttccaaattttatcttaattttatcacgcgcgccaccatcctcgaaagcaattaaaaaaacagagataaattttacagtcttgagaggtatgaaaatttt

SEQ ID NO: 74890 - DNA, 39164 bp, Oryza sativa
acacacgcgcccgtgaaaccgcgagagtcggctctgataccattttgtaacgtcccgccttcccccaggccaagcccgcttacgtctgatagctttcataggtcatagactaccctcacagaccaacacatgtcttttctgcacactttgtcctcactcgtgtgcacccgggaagaatttccgggtcggtcacccatcccaaattgctccacgccaagcacgcttaaccctggagctggagttctttggagattggcttccggaaaagaagttgcaacttgttgatatgagtattctattaatcctattaagccctagaccgggatgttacatgaatgtatataatcctactattaatatatatttcgatctaagtgatttatactgtctcggcaaggcgaccgatctatctcaatcatttgatttaagtatatatcgatataaggattatatatcattaatatctacagccgatcgagtagatttagttctggtttgcttattgatatttgtcgatcgatgtacacatgacaccggcttgaaataaatgatgtgtcatcggcacttagccgatcggctatcatttataggattaattgcggtttctttgttctatttcttgttgatttcaagatcaaatcaactagcacgctcatacatccgaaggcgagctttggacctgcactggagttaagcagatctcccaggcctcgtgttttctgtcaacagaacccaatacaagattaattaaaattcaaagtaaaaaataaaataatattcaaaattagaaaaattaaaagagagttcaagtaggaatacaattttgaaacaactgagattgaaaaaaaaagaacacaatacgatattaattaaaatttgaaaaaaataaattctgaaattagagcaagaaaaataagatttcaattaggaatacaatttataaataactaaattttttgataaaaataaagattattaaaataaaataccatctaaaatatatgacgagatatattaagtaacatgactataaaggagtagagtggtggcggttgatatgacatataaaaattgttaataaaacaccaaatagagtctaatgacgattaaaaggagagacgtcagggaggccgtgaagcaaacgaataagacggttgccgggacttctagaaagtaaaaaaaaataatttttagaatcacaatgacaataaagagtaggtgacagacgggctgtagatcagggacacagtgacatcgtttggtggcacttctaaaaattattaaaaataaaactacaagttcaatttttaaaggttcggaacttctgaaaagtaaaaaaaccaatgataatcatgttcgattttaaaatcaaaatgaaataaagaagggaggcagcgggcgagccgtagaggattacaatggcaaagccgctaacggtttggcgggacttttaaaaagtaaaaatgaacttaaaacgataattacgttcgatttttaaattctcaatgacaataaagagataagacagtagacgtgtcgtagaggagtataatagcaacgtttgacgggacatctagaaattataaaaatgaaacccaacgtgacaataaactctaaaaactataaaatccaatttttaaaggttccaataagaatgaatagaaatagtggtagatcgagcaatcaaataaagaagaagctgagacataaggggtagcaactagtgtgacttttaaaaactatattattagaaacacgatgatgataaggtttggtctttcaaattcttaagacaatgagatagatatttaataaattttaagtaaaatcatacttaaaaaaatatatgattttgtttgggtgctagccgcgcaattgtgcgggccacccagctagttatattattaagacagctcgaaaagaaggcaccacgttcgctgtaggggctaaaaattcccacattaatcggagaaaaagaaaacaaagaaaaggagagtctaagtagaagtataatctaaaaatagctgaaattcggaaataaaaataagcaatattgaaagaagtttccatataagaacccaatacgagattaaccaaaatttgaaataaaaataaaatacaatctaaaattagaaaaggaaatgagagtccaagtaggaatacaatttaaaaatagctgaaattcagaattaaaaaaagcaatattgaaagaagattccatataagaacccaatacgagattaatcaaaattcgaaataaaagtaaaaaaaatacaaaattagaaaaggaaaggagagtccaagtagaaatacaatttaaaaatagctgaaattcgaagtcaaaaataaggaatattaaaagaagagtccatataagaacccaatacgaaattaattaaaatttagaataaaaataaatccaaagttagcaaaagaaaataaaagaagagttcaagtaggaatacaatttaaaattagctgaaattcggaattaaaaataagcaatattgaaagaagaatccatataagaacccaatatgagattaattaaaattttaaataaaaaataaaataatatccaaaattagaaaaattaaaagagagttcaagtaggaatacaatgttgaaacaactgaaattgaaaattaaaaataaaaacattaaaagaacacaacacggtattaactaatttttttaaaaaaaataaattctgaaattagaaaaagaaaaataagatttcaattaggaatacaatttataaataactaaaatttgtgataaaaataaagactattgaaagaaaagaccatctaaaacacatgacgagataaattaagtaacaagcctataaaggagtagagtggtggcggttgatagttgatacgacatataaaaattgttaataaaatatcaaatagaatcctaatgacgattaaattgagagacgtcaagcagaccgtgaagcaaacaaataaggcggttgccgggacttctagaaagtaaaaaaaaaccattgatagtaatattcgatttttaaaatctcaatggcaataaaaatgagaagcggtgcgcggggtgcatataagtaactcaattttttgataaaaataaagattattgaaagaaaagaccatctaaaacacatgacgagataagttaagtaacaggcctgtaaaggagtagagtggtggcggttgatacgacatataaaaattgttaataaaacacaattgccgcaaaggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaatgacaataaagaagggaggcagcgggcgagccgtagaggagtacaatggcaaagccgctgacggtttggtgggacttctagaaagtaaaaatgaaccaaaacgataattatgttcgatttttaaaatctcaatgacaataaagagatgagatagttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaacaatcccagctacctaaccgattgcccaacaagaaaatagcaatggttagccggggcactttcgtttttgccgtcctagtggcgctaccgatactgtcactccccgtctctggctacgagcagaactacactgccggcagacggagcaccatgtcgctgggcagaggctacggctggtcctccggcggcgcgacgtggtacggcggcccgcaaggcgacggcagcgaaggtaattaagtcgttgtcaagtggtagtatgaactgcatgcatgtgcgtatttgacctcaagtactcacgttgccatgttggttaattaatccaaatgcaggcggcgcgtgcggttaccagagcgccgtcgggcagcgcccgttctcgtcgatgatcgccgccggcgggccctccctcttcaagaatggcaaaggctgcggctcatgctaccaagtcagtagtgtatttgtatgttttaccagtcaaatgcatgggacgtggagcattcctaactaaattagatgtacagattaagtgcaccggcaaccgggcgtgctccggccgcccagtgaccgtcgtgatcaccgactcctgccctggaggggtatgcctgaacgaggcggcgcacttcgacatgagcggcaccgccttcggcgccatggccaaccgtggcatgggcgaccgcctccgctccgccggagtcctcaagatccagtataagaggtgccccgccattgaatttgcaaaattatttctggagttctggtccactctgcaatgtacaagtgcagatttttactgaatttttacttttgcctgcagggtgccgtgcaggtttgccatgaacgtggccttcaaggtggacgcgggctccaacccgtactacctcgccatcctggtccagtacgcgaacggcgacggcgacctcgccgcggtgcacatcatggaggcccgcggcggcggcgggtggaaggcgatgcagcagtcgtggggcgccacctggcgcctcaactccaacaccgggaagccgctgagcccgccgttctcgatccggctcacctcgggctccggcaaggtgctcgtcgccaacaacgtcatcccctccgggtggcaggccgggttgacctaccgatccaccgtgaactacgccgcctaatgcggcggcgtcgtgcgcgactacgtacgcgcgtgtttgttaacgtcgccgcgatagatccatcgcgaggcagaagctcgcctcgtcgaagtgagttcggtgtgtgcgcgtccgggaatcgtgcgcagccgcggtaaaagaggagttcgatctgttagtgttaagtgttcgtgatgtgtgttctccctccgtggccgtttgcagagctgcttctagtgacgtctcttgcttggttataacttaaccgaattctgcgttgcgatttgcacttgtataattgcgttgacatggttggagacatcccgggcctgccccaaccggcaaccgtagctcggttttgacgagcccggccgtgtgacggcctctattcttgctctgttttagctaccggcataatcgtatgcagtaagcgatttcttattttccaacgtccatatatatacatgatacgtcttctgttctctgccgaatcagcttacgtcaatctatacgccgtgatctgactttgccgagatggcaaccgccgaaccggatactacatatacctctcgttggccacaaataagggcaacgacaccagtagttgcgatccaagtcggggaaggcccacgcgctagtcattctaagaataagtccattttccatccctcaagtttacaccgagtctacatgacacccataatctccaataccagaaattatttctgaccccctcaaaccttcaaaaccgtgaaaaattggttccatgaaaatatagaccatatttcccattgtttttgttgacgtggcatacggtggggcctacttgtcagtgtgtcgtcagtgccgttgtttgacaaatcaacagcaaagaccagtttccggcgagcacgaggctgcaggagctggcactggtggacaactggccctccggcgagctgccggggttgttcggctgcctctctccctccttcctcctctcttccccttgttctcggcctctcctcccaaaccaggtgaggctagctgagcgacgcagcgacggagatggcgaggtgagcggctcggagatgagggacggacaaatggtgaggtgagcggcgcggcaacagagatgatgatgaatggcggaagaggcgtgatgtggtggtggcagccgctgctgtagccacggcagcgagaaaagtggggtggaggtcgaggcggatcagggacgatttcttcgagggccttcgaccgcccgccgccgtctccactcgccgaaggagagtgcacatcatccacatctccccctctcccaagtctgcacactaagaccacttgagacgatggttgtgcccgtcgagggctggcggctggaatagctcgctggggaggaggttgtccgacaggttgagaaggtggcgggtcatgagctacatgcggtgagacagagagggggaggttgtcagctcagcttccatgtgaggggactggaggcgggaaaggggcgacgtggccgacgagccccactgagcttgagcttgctcggcattggtgcaagggaggtggaggtgggagagggaaggggagactaccggtgagcccctccgcgggggctcctcaatcgactgcagcaggtgctcctctctctttccctcatctcccagtgacaccaacgacaccctgacaagtgggacctccatatgccatgtcaacaaaaaagggggaaaatgatctataccgtcatgggaccaactttgcacggttttgaagactaggatcaagatatctggtattgagggttagggatatcatacaaactcggtgcaaagttgagggatgacaaatggacttgttcctctattctaatacgaagccttctccattccgaaacagcgctattacttgagcccagaagacccaagttgagaaaaagcccaacacatcagcaccccgtccctccgccccttctgtctccaatggcagccgcgccgccgttgtggccccagtcgtccaatccctccacggctccacctctgtgccttccgtgctccggcccagctcaatcgtacatcattgcagctccacgcttgagatggcatccccatgtgtcgacgtttgatagtcacgactagggtatttggatggtatggggatcgttggtatcagggtatgtgcgagattaagataaaagagatggagacatgaatttttatacaggttcgggcctcttatctgacaggtaataaccctacatcctgttagccgaaaccagtgttgctctttatttatctggatcacacaaatacaatatttgggataacctatatagctgccatcgtcttggcttatgtgtatgttatgtcttgtggctttgtggcgtgtccccttttctcctaggggggcttgtatttatacccataagtgcccccttgtccaagtaagattaaggagataaatatggatacaatccgagtagtccttcccgttttcatatagaactctatttattcttccttatccggaactctttttatatacgaggtttgtttccgtataagacatgatatgtggtgggtcctgccgagtttagtcaactactattagatatgtggtatccataaccatgacaccatgacaccatggatgttacatatcttcgttgaaccatagcttttgttattatgcttagtcctttatatgatgtgatcgttcatgaactttttgaggaatgtaaaagagtaaatatgcattaccggtatacggacttaagttagtgtattaacttataatacgtttgttttgggtctgatacgtctagacaagttgtttgttttggtgaataaacctttttattgtgtaccagacaatttcattcaccaaacatgcacttgcttgaaactagcttatcccttcattccaaaatataagcatttttagagttggacacggttattaagaaagttggtagaattaaatgggggagtgctctgactggagaataagtggagatatgtgagaaaattgaatagtggaggttgtgattggttgaaaggagaatgttaatgaagaaattattatattttaggacaaattctaaagactaaaagttgttatatttttggacgaaggaagtacttgataaatacgtattctatttgcaaaaatagtgtaaatcacttatatactgaaaacctgaaaattatcgttggattaaaataaaatggacataagattcgtccacgtgcgcgtgaacaaatcttaggcgtccatttttaatctaacggtagttttgaggtttcaattatatatgtggtttctgctacgtattatgacaacccccccccccccccccccaggctgtcactctgctctctaacattactctgtcccgttcagatgatctttgtcctggtcaccgtaagcaagtgaagagcagaatgtaaaacatgcttcaatgaaaaaaataataaatctcgcaaaactatatattggtatacattaaccaaactatcgaaaaaaatgtaattttaagacgttgaattacaaaactttagatttatcactaaagttatcccaaaccaaaagtatcaaaaaatacagatttagcaacaaaattatcctaaaactacaagtttagcatcatattaatcacaaaactataacatttatagttcaactataaaatatataattttatgttaactttaatattaaatctatagctttttatgtactttaaatatgtggttttgtgatatggtgccttaaatttataattttggatagtttagttaaaacacctatagtttcatgaaatttatttttaaaaattctctagtaaacacatgcctcaatttgtttaccatccgctcgcatgagcactgtcgcaagccatggccgattgattcgatgtcccagagtggaatctcttggcaaagatcatgctgtacattatcacgcctgacaataataaacaaaagctacttgtccagtgggagagaaataccaatatccaatcaagatcaggagttcaaaaaaaaaatctaagatcaggggcatgataactttgatcattattatcagaaagcaaagcaaagttctgctttattcctgcaagctttatgtgcgtgcatataccaaccagacatctctttccaaaaaatgatcctcacaaatgaaataaattaacctttggcaactttaattattttcgatgaagcagcttattgcaacctaacctcatcattctgcaagtagtactgatgatgaagaaaaactatcagcagatccatttttatatcctctctggatcttcatgtcaacacctcgatgccgctgtcctatgagtacccaagaacagtattcccactgatcatccaacctactaaaatagtgcaaatctgtcggcagaaagggccactcctctccagcaactccaagaaccggttgttacaacgccgcggccattgtcgtctcctgcatccatcggtcgcttcgacgtcttaacagaagttcccattaccatcataaactagcttatcaaccggcaaggcaagactaaaaagatcagaggcatctgttcttcacttgcccacaagccacgcgtctcgccgtgacacaagacgccgtacctgaacagcaggtagcacgtacgcgggaaaagtctcgcatagttaaatgtgtacgggttcgccgggcaccgacgcgataattcgccactcgcgcttgtttttccctcataaatccagcctcgtcgatcacggatgccgcccccaaccgcagtagtgcagtaccagccatcaatcagatctgcccctggatgcatttgtcgtccgcttgatcataaataagctcgggtgatcgggtcaggggcctcaatggaaggtgcctgaaggcttcatctccgtgtctcgatttgttttagctccagtttgcgtgtacgtgctgagtttttttatgccgatatcttttgtttctttgctccttcctcgtgtcgccttcagctgttcagttccgccattgttaatagcttctttttgcccccacgcttgcctccctctggtgtataaagtgtctgcatttgcaagagttctctgtgtacttgtgtagcataggttttgtgaagaaccaagcttttgccattgaattcttcaggagatggcgtccactgagttagcgtcggatgtgtacgcgctcccgtgcggcgacgacggcacgacggcgctgtcgacgccggtggtcgtgtcggtcctcgcgtcgctgctggagcggcacatcgcccggaacgagagggaccaggcggcggcggcggacggcgaggccgcgaggagggcgcgcgccttcgacagcggcacggtgctggacatgagccttcacgcgttcctggagcggttctcccggtacgcgaacgtctcgccgcaggtgtacgtcgtggcgtacgcgtacctggaccggcttcgccgcggcgacggcgtgcgcgtcgtgtcggccaacgcccagcggctgctcaccacagccatcctcgtcgcctccaagttcgtcgaggaccggaactacaagaactcgtacttcgccgcggtgggcgggctgaccgccgcggaactgagctcgctggagctggacttcctcttcctgatgcagttcaggctcaacgtgagcgtcagcgtgttccagagctactgccggcacctggagagggaggtgagctacggcggcgggtaccaggtggagaggtgcctcaagaaggccctcgtctgctccggcgaggcgcaggcgcagcagaggcaagcggcgtcggcggcagcccagtagacgtcagctccggagccgccattcgcgcgtgatctgccagttgcccgccacaggcggccggcacagcagccgcacgatttgatcgccggcagctgccactcgagtgcccagaaagatcaaggatgtaaatagttatggtttgctcgtgtacttaggataggagtaagaattgtgcaatgcaattgttcctctctacctcgattggtaaaagaactgatgcggggacaagtaaaattgattttctttcatgttgtcacgaccgatcaactttgctttccggcaaatcaagtctttaaaacgctaacggaatcgatagcgacaaggtagcgagattacatcaaatcaactccagtagggaccaaatatgactaccaattaacactttaccttaactcatggtccatgccaatgggcgaacatagcacgcaaaattttctctgttgcgatatgcgaatgcgttgtcggtgcacattaaaaacttttcggataataagagttatttttaatgaattactcgacgcagcacagcttgcaagctgcagcaactcggccgcccccacggcagcgtacgtacgcggcggcccatacggtacgggaaagggttctgtgcaggtgcaggatctgatttctggcaacgcggatgcccctggtccatggaccatggctgagtgaggagaggactgaggtccttgtcagcattccatggcagcatcttgtgacggaaataatttacccacagactagagcgatgacaaagctttgcccgttcttggagggcaccagtgaccagacactatatctgacgagatgaaattgcccagatgcaggaaactacgtggagtacatgaggaacatttcaggcgagtagctctgggcagctgacggggagtcggtgtgggggaataggatgagcgtgcgacggcgacggcaaagaatagaatcgaggcagcgggacgaatggaatggccgatcagctgcgctgtctcggcccacattcggaggcacgtcggctgtgaatctgtgattggaataagttggtcccttaattttcaaaattcgtcccttgaccataaaatcaggtacaatgcatcatccaacttacaaaaccagtacaaacgagatccctcagtgatactatccccggcttcgactgacgtgacgcctacatggttcatttgactactacgtctcacgtgacgttggcatgatgcttacgtgacaatttaatatgggtaataaaaaaaagcatgagcccacatgttagttacaccacaaaacaattaaaaatgatggggcccatgtgggccccaaatgtcatccgcgctcctccggtccacccttttgccctctcccctctctctcctctctctattcttactcatcctcactcctcccttcttccatctcccctctcttcatcatctcttccaaggtggcggacgggggtgggggtgggggtgggcagcgaggagaatggcggagcaggcaagcgaggcaggtggcggacggagctaaccgatggtgggcggcgacctcaccggtgccttccctcttcgaccgtgcctccaaggccaccacgctcctggtgctcgtggtgctcttccgcattatgacccccaagtgcgtagactagaagtggattccgccggttttcttcttcatttgttgtctctctgttacttccaaagaccaaacaaaacatgggtaggaaagagaagaggagagaggggaaaatttgggagccctagatttcgacaggttggctatagtgagggggagtggatgtattggcgcgcggatctggtgggtgcaagaggttgggtggggcggtgagatctatgtggcagggaggagacgagaggaggaggaggggagaagggtgagaggagaggggaggcggttgagttgtcgttgtccgcggactccgtggtggtgatcgtggtaattgtggcggtggtggggcatgtgctcatggcatggtggaagttgaggtgcgacgcggttttggagggaaggaggtgtggcggctcacgcggctggcctaggagccacaggaggagtcggagttggtggaaatgaagttggcgcatgtgtactagtcagagctgttcccgagcacagtgcacgccgcggaaatatggatgaggctttgtgggcgttgccaacggtggtcatcttcagctcctctgcgccacccactaccgctatgcccttctccttgcagtgtaggggaaggagagaggggatagggagaagagggaggagtgacgataacacgtggggtcacatgggcctcaactttttttttattatcttgtgtgtagctgacatgtgggtcccacgtcttttaatttttacagaatcaaattgccacataagcgccacgtcaatgttacgtgggataaagaccttgtcaaaggagccacgtatgtgtcacgtcagttaaaactgaggacaataccaccgagggatctcgtttgtattggttttatatgttggggatgcgttctactcagttttgcgctcaagggactaattttggactcggcgactgagggactcaaagtgaacttattcctctgtaattcatgttgcgcgttcgtgtgaatacagtcccggcccaactaattgcggcagatgggaatcccgttccggcccatgtagttgggcacgtgtgtggggatccagttacagcccaactcgtgttgacggacctggcggtgcgttacttgcccggtcgattgatcagcaggttgacgcaggatggcgaaaggagccgaaaattccccgggaaggccttattttagaatcgccaaacaaggggagggtggtaatcgtaagaatttggatcgctgccacttattgcaatccaacatacggcgctctctggaaacttccgaaacaagagtgtacaatctcatctaaaaaaatgtgcgatctagagtatagcagccgtcgcatattcagacggatttgctattcagatgtgcatacgcgaatgatacttacatgattatcatttttaaaattacgaccaaaatttgctactccctcctttccatattataagtcatttgattaatattatcaaaatacattcaatgttaaatttaacaaaattaattttagattctgcaatccgaaggagccccaaggtacactagtgcacgtgcgctgttgttaaaaaactaacaactccaatcctacatatatgtcaaatggcatccgttggacgaacatgattcgtgggctggtcccttgactttcagattcagagatatgtagcttattatcaccggcacgtgtcactcctaggcgttgtcaaacgtcactagctaaagcggccgatgcaccgcgaaacacgcctatgagaactatatatgtctatggacgtgcagtagtgacgaagtttttaaatttggatggctgttttggaccttcaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttggtacttagtcgattatcacatatatatatgtctcgcaccgaaagttgatttgatttttcgtcgagacatgttgacattgtgattttccatacaacgattgcatcttcttgagcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgtgactttttcttttcttttagacttgtaggtttttttttcttctcaagatagtgagtatgttttacaaagaggtaacatatgaatttgggaagaggcagtagacttgtaggatttttttttcttctgaagagaagcaagtagtgagtattttttcacaagaggtaatgtattaatctgtcaagctgcgtgaccagaaatttttttaaaaaatagttgcttctcttgttttttcacaagaggtaatgcattaatctgttaagttgtatgaccagaaaatttaggtaatgtattaatctgttaagttgtatgaccagaaaatttttaaagaaatagttgcttctcttgttttttcacacaagataatgtattaatctgttaagttgtatgaccagaaaattttaaagttatagttgtttctcttgtttcttctcgagagaagcaagtattgagtatttttcacaaaagaggtaatatatgaatttaatctgttaagttgtatgaccagaaaattttaaagaaataggtgcttctcttgtttcttctcaagagaagcaagtattgagtatttttttcacaaaagaggtaaatactagaaaattggtgcgccgttagcacaccatccatatagcaaaccatattaatactacatatactgtttattgttatttgtaaaagcgtaaaattttaaagagatattttagcagtttttaattttatgcctacaagtctgagtaaacattatatttgtaaatatttaaattacagaggaaaaaatgatgtcaaatatatgttggttgatggtcgatttaattattattaataagataaggctaaaaggtgaagccttatatgaaaattgtttgggactatactaattgagaaaatcccttatatacccctgaaattttacctaatctcttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgctcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcataataactagaggtttcttataatagcactaacagttggaattgtttttttaactggttatgaaaaaaaagggaaatgattttttctttttcttcttcccatatttttattttctttcagcctaagtataacattctaaattctctttatttattttacttttacattattaaatcctcgatggttaaaaatcttatcatttgtatctctaccgcgctctctgttttttccaaatatttgcttatcttctcagtagtcgaaaatagtcatgactcatgactacgagaggaccacatagttcacacactatttgaagagccacatgtgaatggagagggacacgcctccatatcttctattgcgagtagtacaccatttagatgtcacaattcgtagcctcatatgtataattcggaaaactatagctataccacctctcttagggcgttcgtagtgcaagaccctcctcaaagtatcacgtaggatgagttagcatatctcaaatttgtttatcctataatgcaaagtaactctagagatattcttgatttttcatgccgggccctcatatttcttactttagttcttatgtttttcaaatttatagaatagtccaacattacactaaataccctaaaaattagaaacaaatatacaaatctcacctccctatcctttcccaattccctgcttccatatcctagaaaattggcgcaccatcggcacaccaacttatagctggatatatttactcatttagaaaaattattgttgttgttgtctagagtttcaaatgcagtagatttacaagaacctatttaatgaattttgaaaagactgaggaacgattaacttatagtaataaccatatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatattttttgacaagtctctctaagagaaatttcttctgctaacataccagtgtcacctactcctctctgtagtctcatatacgatactccctccatcttaaaaataatacaagctaatcataggtacaatcgaacatagttagagcaatattatcaacaaatagagtaatatggttaattagtgtatgcatggctaattaattcttctctaccacatttagatagccgtacttctctgctgtatattataattcaacttgaaaaaagttttgctaatgaaagattaacttgtttaagcgtctataagtacctttggacaaatactttggaagatgtgtcttttgaattagtataatttacagaatttgttaacctataggaaaattacgaaatttatgtaaggcataattttttaggctaatgactctaattgtcagcttaatatccaaagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatattttaatttttctagagacttcggaagggttacatatccaacttctatcttaatttttctagagacttcggaagggttacatatccaacttcttcacaagggttaggcaaggtgatttattgactcctgacttttcctgagagttaagtggacagaagaatgcagtttaattatgtatacgggaggacacgtggcataatttcagagtagccctggaaaattttgtagagtgccacgtgggccaatggcagcctggatgctgcaccctgaaatcgttatttaagatatgaatttttgaagctgtatgcctgcatgaccagaaaatagaaaatcaaaaatttccgttgccgggactcgaacccgggtctctcgggtgagagccgagtatcctaaccagctagactacaacgaatttatccgtcgatgtgtaaaaaggtctttcacatcacctagttttactttccctcacgtcaaactaccgaatatatttaccgttcttatatcagtagctatatttatgacgccatatttttcaccaaaaaatagtcgatatgtatttacatcgtaagttcttaaattacatatgtaattttagtgtatttataatgtaagtctcaaaattacatatgtaagtcccaaaattacatatgtaattttagtgtatttacaatgtaagtttcaaaattgtatatgtaagtcataaaatagtatgtaattatagtgtaattagtatgtaatcgtctatcatcacgcgatatatgtgtgaaaataatcttctctctcatggaagcacatgcagtgggaagcctgtgcggctgtgtgaccaataggcatgtataccgactgtaatcaacgaaaatttatggcgacataaatgtagcaaatccgtctcaaaaagaccaagtaaacatgtaggaatatcataaaccctctttaacgaaactttccgaaccaacccggcattaaaggggacaacaaagctatggctgtgttttcacaccaaaactaaaagtttggttgaaattggaatgatgtgacggaaaaattggaattttgtgtgtgtaggaaagttttgatgtgatgaaaaagttggaattttgaaaaaaaaattacaactaaacacggcctatatgtttgatcctttttcgttttctacacgatgcactacaggtctacagcaaatgcatcagcattcggtagcttcttcttcgcttcgttcatcggtttacgtgtcgaacagccagctagctgctcacaattaagcttgatggcgcacgcggctctcgtcagctggcgagcgccggcgcatgcgatgcgaggctgccgagcgagacgacgacggcggaaacgacgggggcttcgcttcgttcggcgcttgactcggatcgctccactccccaattcgagcgcgaggcaggcagccaccgggacgcgacgctgacttcttccgtaatcctttctgacccaatcccgttcgtcctcgcctgacgcgctcccgtccatccagccttgctgaatccaaggagttgtgcgagtggacattactgcacgctagccctctcgtagccctcgcggcttccgttctttaccccgctccgctccgctgcacgcacgaacgcacgctcgttttgaaagcgcgagaggacaagacggccatgcgcgccggagagcaacgtgtggttttcatcgccatcgcatcgcgcgtcttgttcctggactggagtaccatctaaacagttccgttgcacggaaagctttggtcctctggatcctcgacgcgactgcaagtgaagttcacagggtaggacaatgaccggagtactggaccgaatcgcggatttgtactcgttccttcgattttcgttttctccatgaaagaaaaaaagacatcgtggcacacaccattgtggaatagtaacataggaagacactaaccctttgcttccactgattgccaagccactgcattttacaggagaatacaaatctgcttcacctgcaggcccaaggaaaggaaaaggagaacactgcatgttttgtaagtattcagagctaatcacttcgatatcatatcatgaattcgggatgatgattccaatgaatactcccaaaggttggagatagggatcaagagcagaacaaggacagcaccaagatgacagaaaagaaaaaagaaggtgacagatagggggaaaaacttcacactccagtagagtatacgagaggaggagcgaagcaagaaaccaacacacgcctatgatctcatcgcctgccacgctgcctagtgttcagaacggaattgaagccagccagccgatcccccttgacttgtaccgtatctgtacgctgtactagtacagtactgacagtaccagctacaaagtgaaatggaaatttggaaattacctaccgaagtccaaacacgcacacacacagaaacacacagaaacacacaaacacaatgaacaccatgcatcggcagcacagtagcatgctactaacatgacagccgtagcaagcataacaaatgcttgatcaacaatgatgctggatacttggtcgctacttgatggtagtactaaatatgatcctgagtggctagctcgctagctggtaggtgtttattcggggtgaatggccatcatgtacataaatcgggggcgcacctaatgcgtacccatcataaccagagagatccctaaagcggttagttggaaaggctagctctcgcagatgctttgcttgcttgcctgctaagtgctaagctctcaacgagcatgcagcagctggtgcatatgcatgcctggtggttaaaattggcaggaagataatgtgaaggggaggccaggagtaattccagggagattaagaacaagatgaggctggatttggatgggcataattctgagagatccgctgatgagatgcatgcatgctggccgggcactcggtcaggctttgtgggtaagcaactaacgtgctgctaataagggattaatcgttgcctaaaccgtatcgagatcttttgttcccaccatacccagatcttaatttaatgagaaaggtataaaaacagtggtgcattgtaagtgactcttgtgatttagaccccggctgattaatctgccacttattactatcactgattccccaagccacactccaccctgtgttcgctttgttctcactggtctacccatcttcccaaccttcttgtcacctactctttgttcccatctcattctgagccctctattcagacatatctcacccaacttactgaacgcctgagctgcaccaaggtgtggcctttggatgatcaggatataaaaatggtggtttaacaaggcaaagctatattaaggagatccatcaaaagggcaatttgacagccatgaagtgtagtggcatcttccaaggcgggtaattttcagagctattgcattgagtacagcagcatcccacagtacattccctcgcatagaaagccatatggcacgtatgcaaaagccatttctgtatggtagcaaataaagatttttaattaggactaatctgatcaccaaaatagccaccatctcagcaatacaaccgctactgctaaaaactacgcactggaccacatgatggtacatggcaaaacattagactcatttcatcgaaaagaacaataggctcattcctttcatccgtactaacaattaactacaagcatcagtccgaaatcttccatacggttgggcttggttctacacgagcagtaaaagaaatgctgcaaatacaaccagtcaagaatacaatgagtcacccagaaaaaaaggggggaaataaaaggaaaacaataaacgagaggaagctggcagttccgctctattctaactccccacggaagcagcgctttcatctctctccgtttcctctgaaagctcgtatttttagctctcctaagctctgtgcctcatcaagctctatccaagctctcgccatggccaagaacacatgcaagctctgctaccgccgcttcggcaacccccgcgccctcgccggccacatgcgctcccactcagtcgccgcctcgaggtcgcagatctcctcgacgtcctccgcgtccacatccgtcgcggtcggcgacgacgacggcggcggtgatgccaagaggcccatccagggatacgtgctgcgggagaagcccaagcggagggtccgcctcgccgagtccgacttctcggatcgcgagagcgagacggagtactactcctcgccgcctcacggcaagcgcgcgaacaccggatcgggcgatgtcgagcaggtgagctcggtgtccgacgccacgtcggaggaggacgtagcgctgtccctcatgatgctctcccgcgacacctggccagccacgccgccgccgccgccgccctaccgtctccgcggcgcaggctacgacgacgggagcgacggtggcgacgcacctccggctccggccgcagcggccgcgcagaagcggacgcggttccagtgccccgcatgcaagaaggtgttccgatcgtaccaggccctcggcggccatcgcgctagccacatgcgcggcggcaggggcggctgctgcgcgcctccgcctaaccctcctccttctcccgctacgcctctccagccattgccggagtgcgacggcggcgaggaggagggcgcgaagccgcatccgcacgagtgcccctactgcttccgcgtgttcgcgtccggccaagctctgggcggccacaagcggtcccagctgtgctcagccgcggcggcggccgcatcgggcgacgatattccagccatgattaaaagcaacggcttcattgatctgaacctcccggcgccgttcgacgacgtggagctctccgccgtttcagatcctttcctctcctcgaagccaggttcttgaaagcaagcagagcatgagagagcgagcatactggctgttcagtgctctctctcctttcggttgattccaaagaagatggttagagctatggattcgagagaaagagctgcttaaccaggcagccgaaaaggtaaagaaaatatcataaaaaggagacatctttgctttggtagttttttttttctcagttgttttgttcattcagctacaaaaattgcttgatgctgtcctccattctgttctgtctttttgtttgtttcaagctacccgaacagtgtacattggggcaactagcagagcttagcatcttgcttacttcttgatcataatctagcatgaaaatattccaccgaaaaacagagagagccacaggagaaaaattatagctgaactgttgctttctgttgcagtctccagctgttcttgttccaattgtccatggtacgggatttggccaaacaataggcgagatagtaagcagtgtagtagaaaagaaaagcaacaaaatggcagtaccaatgcaggatcagcctagtagtccctagtgtgttcatggttgcatccacatgcagggtgcagcaacagcggcattctgctcctgctttctctcctccctgcttccactgcccaccaccacgaccacctgcctgcccggtttggctgctgcatatgccgccgtgacggcgtccccccttcccttctcacgctaggagcaaagcagaaaagaaagcctcgtactttgcctagtccattttgtccgtctcttgcttggctgctgctccgttcattcctctcactgtgcgatgggccccacttgtccggcgcaaacatatgcgctggatcctaacaaatcgtctgtctaatgcaacagaattgctgttcctaaactaagcatgcagcactgagaaaaaaaaatgtagaacttttagttgtttaaaaatgcttgggagaattagttggatctcgatggacagtttgtgtggtttcggcagcaaaactggagctcgattttgcaggagctgctctcctcgtttggtgggcaggtagttataagcatggcccacgtctcgcgtccacgtggcaccgttcttttctcctcgctgggcccacctggattgcatcggcgtgtcagtggccactgactttgcgcggtgtgggcgttactgacccagggtgggattagcacgacaattaacgcagttaatcaggggttaattctcggttaatgagtctggccatcgtacttctctcccctgtggaagctgtgtgggcacgcatcccgaggcggatctcccggcgtaatcggttggtccacaccgagcagcaggacgggacaaggtattgatacgttggcccgaccttgtgctgtccccccgtgtccgtgtggccgtagcgcggggcgcgcctggacgaaggcagtggggtttgctcatttgctgtctcacgtggcgacacgtgatggatcatggttggacggctgcgatcaggtggcgcttacccttgcgctttttttagacgaggcaggtgatctccctccctccttctcgcgctctctgcttgtacttttcttgccgctgttaagccgcacctaaattatcttagcaaaaaagtggaattcgtacaagaagcattcgttcacctcttttctttttacggggagagtggcagctcaggaaagaatcgctgaaaagtaccacaagtgtttttagcgctctcttttctttttttccccttcacttttgctgcgcgatggggtcactagcacgcaagactttcgtgagtcgaagagaacccttccaggtaagctaagccacggcatgcagtccttctgcaccatggttcacgccatagccgtcccatccccggctagaatttcctcgcctttggagtttggaccggtctcccactggcactcaaaaggcgaccggctaatccacccaaaactcgcggcactactgaatggtgtagtagcaatagcaacctttgctctacgatcttatccttctctcagttgttctcaccaatggtaaaccggttaagttgcacgggtcaaagcgactcgacggtaaattcgggcgatggtaaccgctgtggctatgactgttccgcgcaccgcgcgcgcgaagggggcaagtagcctgtacgattgactacggagtcgctgttgattgggtggtctagcttacgcaccggcgccactggtggctgtctggtgaatcccacgcccctgaacagagcgcgcgccgcgggcagtttaacgaccatccgtttcgcacttgcgtgcacagtgcgcggcgtcgttcgtgtgcgctctggaggaggaggttttccgtaagaagaggctcagaataacgctagtcgtacgggctcgatggctccatgggttcaccaatggcttaattagaggctggatttacgcataatgcatgcatggtgcaactgaggcgtggaagaagacaatgttctttttacctttaccacacgcttatacccggtagagagagacctgatgcaagttttggtttggtttttcggcaagctagaacgtacaagatcgaacataatatctagatcaatagatcgggttgtacacatccccgtgagttgaatgtaatcgtttactttctccagtatccctgtcccaaaaaggccgaggtgtgtaataaataccaacagctagctcgcgatcgaggccctgctgccgctgccgacgatcgatcgggcatgtgtattatggagcagtgtggtactactatactactccatgcgcacggaggtgtgtgcgcatcaatgagagctaagtccctctcctccatggagctagctagcacagagtggtcgctgctaaccgtcatacacacgaacgcacagatggatggatggatatatgcatcctgaattcttgaagtttttggttggtgcagctagggcctgcagactgttgaggagctactgttagtaggactggaagatctagcgtactccaagtggcacgtaggattcttgcttgcttctgcagccaagccggccctctctccaatcttcgtctctagatctcagtatctcacgagcaagtgatcaactagagcgaacttggattccctcacattcaatatcataaaaatcctagagggaaaagaatagcctagtgctgtctctgctacgtggaaaagaaaacatactgtcaaggatgcacgaaaggagtaaaaggcacctttgtgggggctaattctgaaacttggcttgtaagacattatgtgtatgccctatttttgtgctatcaaatctgctacaatgaatgcttgttcttgcccgttatcattttttagtcagatacatatgctttaactgcgttttaactgtaagcagtaaggatagttcactggaagtctggaaatgaacatctgaagccgagtttttactgtccttgagcaactgcagtaccaaatcgtgactgttgattcgagatcatccaacggtccaaaaggcgtcggtacctcatggtaccgcacctcccattgacgcggtaccgtggtatggagggtagttttgtactttcgcgttgtataccgattcacggcttcacgcacgcggcatctgtttcttcgctgtttcgcgagagaggaggaagcgctgggctgaagcgagagaaagaaccctagatggcggcgggaggaggggcatgtagcgaatcctggatcagcgactcgatggcggctagatcagggatgggtggaggtcatcagcggcaggcccaaatcggccaaccgtcgggagctcgaagatggttgtggcggcgattcatcgacgacggttagggctgtcaaaaaagctcggagctcgcgagcagctcgagctcggctcgtcgcaagctcagctcgagttcgactcggcaaggattcgagccgagctcgagcttgtctcgaagctcgcgagctctaccgagccgagctcgagctattcggcagaagcttgaaattttcactcccgctacctatcccaatttctcccgcactccaattccaaaatcctaccaccaacagcagtccatcacctaaccatttatttcccttatatccccatcccgtatccaaaccctagctcatttgctctcttcctcgaaacatttctcttctagatctacaatcctaggctgctctagtgctccactgaccactgctgtggatctagccaagcaccgtccatccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaattgtgtagtgtttagttgcttgatggatgttattgatttacattgaattttatggactaggtggagacatagagtagtacttatcttgctgtcctcctcttctgaagaaagactgaaggttgcagaacaccgtgtgtttgccatttgccaaggtaaattgatggcaatgcttttcttgttgtacttgtttgattccttaccttgtgcagaatatatattgatagcagttggtatttttattttttgtagatgtctgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggcactacaacacattggcggaggcatttagagcagtgtgattatcacaagcttcaacaaaaatccataaaacaacagaatatcaatttccctagccttgatgaaggtgatgttgatcttgatgctccttgtgtttctgtccctggttattatgatcctacaaagatacgtgagcttatttgcaaaatgatcattgtccatgagttgccattttaccttgtggagtatacatggtttaatgttttgctaaagaggctaaacccttcttacaaaaaggtctctagaaataccattagaagtgattgtatgaggctttatgaatctgaaaaagaaaaactgaagaggactttcaaagatgttagaaagataagcctcacatgtgatctttggacctctaaccaaacaatttgctacatgagccttgttgcccactacatagatgctgattggtcaatgcattgtcgtgttattaactttcttgagttggagcctccacatactggtgtagttattgctaatgccatttctgattgtcttgcttcatggagaattgaggacaagatagctagcatcacatttgacaatgcctcaagtaatgatagtgctgctaacctgttgcttgccaagtttacaaaacgtggttcactttggttttatggaaaattccttcatatccgatgttgtgctcacattctgaacttaattgtccaagatggtctggctgtgattaagcatataattgacaaagttagggacactatcaagtacatcaagaaatcaaacaatcgagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtgtcacgccccgagctagtcctgactggaattagcccgtgacgctccaaattaacctgttaatcgataccagtcccaggaaaacagtgctggtatcatagagagacagaatatcacagcaacagaggtctctttattatagagtagaagtacagtcatgttgggctgcggacagatcccgagctcacaactgcattacaaaagggaaacggaagccagggcttggaccaaacatcataggcgcgacttgggaactaggtcgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacgcccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaaccaagtttacccaagttgtttttcagattttaagtttgaaggcgaccgtcgatactcgcacagagtgcacgaatatcgaggcgcaactgggtggttacaaggggacatggtataacaattaacaaaggaaggatcaaatgcacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacccttgctctatataaataaccccccagttgctgaagaagatgaagcggatcctgctgatgaagagttcttccaggagtaagccggcttcgatgagttttagggtttcggcctaattcccaagtcgcgcctgtgatgtttggtccaagccctggcttccgtttcccttttgtaatgcagttgtgagctcgggatctgtccgcagcccaacatgactgtacctctactctataataaagagacctctgttgctgtgatattctgtctccctgtgataccagcactgttttcctgggactggtatcgattaacaggttaatttggagcgtcacgggctaattccagtcgggactagctcggggcgtgacatgaagtccaaagacccaattcttaaagaaatggcaaatgcaatgcttgaaaaatttgagaagtactggggcccagaatgcaatactttgtttgcagttgctttggttctagacccaaggtttaagatgggtatgattaactacacattccctgctttgtatgaagaaactgtacttcctaagaaacttgcaaatgtggaatccacattgaaatctttgcatgcatcatatgaaagtgaactccagagcacatcaaaggaaaatgatgccaccactcaatctactagtacatctctgggcactactagtagtcatttctttgctgctagccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcaagtgattagtgattatcacagctctttactcccatcaacagcacaagctttggtgtgtacatctagttggattagaggaggccaccacaaaagcacatatttagtaagttcttatattttcatgtttctaaccaattaatagagatacacaatctaataatctgtgtttacttgtttgttgcatactaggaggatgatactaattctattatccttgtcccaactcaagcttcaactgcaaattcggttgtgggcagcaattagactcgtttgtcaggtatatgtttgaggttatataaattatctattgctaccatatcaattcctcatcactgatgaaacattacctataatctttgcacatggtttcagatttaactttacgaaacattaatgcaggcatatagtatagcatcaacaattagtttgaagaaagtgcttggaggtttcacattggcgtactgccattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaattctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaaccgagcctaccttcaagctcgaaggtaatgctgggcccgagctcgagcctgtaccgagcttgagcttaggtaggtaagctcgctcgagctcggctcgttgacagccctagcgacggtgagctcggaggtttctatgctacatcggcgagctcgaagatggttgcattggccgttcgtcgggagctcggcgatggttgtggcggcgtttcgtcgggatctcggtgaccaaaagcgggagggagataggcagtcttcagtcttcactcgttccctccagcccaggcgtcgccgtccagtgctgcggctgcgcgcgtccgtgcgcggcgtctcagggtctagctcgccgttgaccatgcagcccccgaacggtggcgagcgggggcacggcaatccgggtcgccgccgtggatcttcaaggtatgtgtgcctgctcccgtccttcttcaaggtccaagtgtactgcttcgaggtccttttattcaatcagtgcttttcgagttttatgatttattcatgacaataccagcatggacaacgttccgaggggaaaaccagtcattttgatttctgacagtgaagatggtaaaccaaattctttttcctacttattcatgtcctttcttctttgtttcgaactaaaatggtgcttacaaaccaaaaacacgggaaatattattgtagatgatgatgaagttgctaagatatatcaaagcgtgcgcaagtgctccattgaaagaggtgattattttcatataaataattaataagtccaaatgtacagaatgttaggtactgctagtcagatgatgtgcttgtcaaacttccaatttcaggtcaatatggacctcgcaccttccctggatttgataggtagtactggtatgggactgaacatgcagtacaaaattgctcacattgctgtaagcaatttgcctaccattccactctatgtgtatgagatccagatgactaatttgacaaaagggaaaatggtatggttcacaaatctgactgccctgtatttgcatttgtttatacataaatgtcctgagtctaaatgtcttgtttatattttttaggccttcagtttgccatttagcaagcagtacataaacaaccacctttcaacaccaattgatgatttacttgtgactctggttggatcagctgaatcctttgagatgagactgaagaaatccaaagataagcgggctacctttacaactagatggaacaagttggttcaagccaatttattcgagcttggtgatgtttgtgtgtttctgttcactgaagttgatgatgacctatgtattactcttgaggttctcaactagtgtaatggatgaagaactttgatgtgccccctcataatgtagtagtatgccccctcctagtgtagtatctgcaccttatgtaatggatactatgcagcagcttttgttcaactttaatggaggccatgcagcagcttatgttctaagttaagacaatgttattctgatgtaatatatttatcatctatttccctaaaattacctagttgtttgcatcacttcaaatctgatatggcaagtgtacagtttttatgctactggagttgttgattgttgttggaatcactgctacaaaattaaaatggctgcccgttctgttctgaaaactaaaaacatgctacggaagcttcatcttgattgttgctggaatactatacttaattgggctgaaaacacacagaacagaagcagctggcatgaatacaaatgagtttaagaaactttagttggctggaatacaaatgtaaggtgcacacacaagagcgtcggacgatgcaggaacaacagagaccacaacagcaggaagcgacgcccgagtattccggctggatgcgacggtggatgcggcagggtggaggcggcgattttgatgcgcctggcgtcgtcgtggatgagtcgatgcgcctgcggatggctggatgagacaacgagttcttgcgacggcgggatggatgcgccggggtggaggctgccgctgtatgcgacgacgggatgcgccgctattgacgacgggatgcgggttggacgtctgccgcggcgtcctcgacggcggcagacgcgtgttcgacgcgcggccgcggtggcgtcgagggtacgtcggccgcgggggaatacctgcgatgagacggcggctgcggcggacaagatgagacgccggcaacagatattggcgcttggcggccgccgcagactattggctgggatgggcggtgattaacgctaccctaatttgtttagccccatcatacccttcctaaatcaacggtcagattacattggtacctcatggtaccttcttaaggatgggaaagatgctctctgaagccaaatctcaacagcaagagcaagctgcttgtagctctactccatcgagcatgctttatggagatttttagtggccggagctgataacatattattgcactcagggaaataacatcgatagtgtgactagacaagtaggcatccaacgaatcaggttggtaaaagacagaagaaaagtagacggcataaatgtttcttatcttccttcaagttggtaactggtaaaggttaagctagtaaccaaggacttagcctcgacctagtacatagatgcagccattacagatgaagtcatggaggggatatttggatgtcatggagctagttggagaaagaataaataagtagacagcatgttttctgaaaaccaattaagggtttctcttttgatgggtagccaagaaggctagcctttcttcaagcatggacggccaaatttaaaacttacagttaattaatgtgacatctcaggcttttaagcatatggtaaagctcctgtaactgtaccgttggttttacacttgtaggaaatgttgaactagttgctatcttacagttttatcaacaacctgcaagtcaaaattaaacactggttatattccagcagagcgaaactataagttagccaatgtcggtgttctgtgtgctgcttgttgtttacgaggatattaccaacatttgggaatatatcaagcatattttgctcactttgcccataaaagctcaactgatgccatgccgaaaggagatagcttgttctacatcattgccacaatgtcacagaacaggaaagcacagcagaggcacgaagcatcaatgagaagagttcaaaaaaaaaaaaaagggagaagaaaagacagagaatcagtttgtttttgcttgtccggtagccatcagtccctacttccagccactaacaacagaagagaggatcgtccttttcagcagccagcacccacgaattgactaggtgatcgacgatcaactgagctgcccatgtagggatggcaattttaccatgagtctgggtatccatggatacccgacctgacgggcatgggcgtgtgtgtgactttttacccataggcacgtccgtccaagatccgaagatgttatgggcaataggtgggtttcaatttttacccgtgagtaacccatgctcaacccgatacatatgtattaactacttttgactcatttcttaattcttataccatttctctcggttcatttgtgatgctaactgatactaagttgtgatgtaattcaaattattgttgataaacggtgatttggtaaattattgattttatttctctttcttaaattacatatctttcaagttattattcatgtgagatctattgggtacctgccggacatacccgcgcccgctgggcatgggtacgggcacggaattttacccgctaactctagtgggtagggtttgggcggacaatgtcgggcatcgggtc

SEQ ID NO: 74891 - DNA, 11538 bp, Oryza sativa
cccaaataatgatatcccgtaatctagacaccacgtctaactaccagatactactctaatatcatcatcatgacatagagtaattgcataagcaaacattatacccgcaccaaagcatctctcagataagctagctgtatattcagtataacatgaacataatgtaaagtaggcattcatatactcagaaagtactcctatttaagaaaattattccccaaacgtttgacaaattttgttttcatccttcccaaggggcttcaggaggtctcattgttctttggaacaaccatcttttctctgcaaacctggtttctagtcatccttatgagattactatgcacttttgctccacgttgacaacagatgaaaattggcttctcacaaatatatatatggaccctgctcaggagatttaagaacagaatttgttgactggctatatagtattacttttcaaccagatgaaaaatggattttcatgggagattttaattttatcagatcaacccaaaacaggaacttgccaggtggggatatgaatgatattatggtttttaatgaattgatcagtaacattgaccttcaggaattgcctcttaagggcagaacatatacttggagtaatatgcaatcacaaccacttctgcaacaactagactggttcttcacttccccctcttggacagttctctacccaaatacaatggtcactgctctgagtaaatgcatttctgaccatacaccatacccctctgagaccacagttccaaagacagacattttcagatttgaaaatttctgggtagagctcccaggattcatcgaagtagtgaaacttttctgggatatccctgtcagagcagacagtcaagggaaaatcataaatggaaagtttaaaaatctcagaagaggactcaagatttggagcaagaggctctcaaatttgaatacactgattggtaattcacatgaagcaattgactttttagataacattgaggagcagagacctctctttatccatgaatggaacttcagaaacattgtcaaaaatcacattttgaaacttcttcattacagaaatattttctggaagaaaaggtgcacaatgaggtgggtcaagtttggtgatgaaaacacaaaattcttccatgcttcagcaacccaaagatatagacagaacaaaatctcccatttaactctaaatgatggcaccattattacttcacatcaggaaaaggcccatgcctttctaaacttttacaaaggaagaatgggaacctctgaaggaattcaaatggcgatcaatctgactgagctgattactcctcttgctggcctagaaaacctatcaaacatgccatccaggcaagagcttgaatctattatgaaggcaatgcccattgataaagccccaggtccagatggtttcaatggtatgttcatgaagaagtgctggaatatcattgctgaagatttttacaaattggcaagagagttctttggtttacagtcctcgatccaaaatttaaacaactccttcatctgtctaatcccaaagaaatcttctccagaaactgcaaatgactacaggccaatctctgttcaaaatatgagtatcaaattcttatctaaaatcttggcagaaagactgcaggctgttattcttgatcttcttcatgaaaatcagtatggcttcattaaacagagaacaattcaagattgcctggcatggacttttgaatttctccaccagtgtcatcaaagtaaaaagcaaattgtgattctcaagatagattttgaaaaagcttttgactcagtggagcattcttccattttagcagtgttgaaagcaaagggtttcaatgaaacttggctcaaatggatatcagacctgttaacaacctcatcctctgctgtacttctcaatggaattccaggaaagaatttcaagtgccaaaagggtgtaaaacaaggagatccaatttcacctctcctctttgtcttaactgctgatcttctgcaatcaatgataaacaaggctcatgatacgggtattctttccaaacctattccccgaccggacaccaaattcccaattatccaatatgcagatgataccctgataatcatgaaggcttgtcaaaaagaaatttttagtcttaaaggcattcttcagtcttttgcttcttccacaggcctaagaataaactttcataagtcttgtatgattcctatcaatgttcctgaggaaaagactgaaatccttgctgggactgtggagattatgggtaccccatacccacacggcatggttatccgactagttataggggataacttatatatatgtaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgacacaatatgatcgtcagatctatactatacccggcggattcaaatccccaaacaggagtagggtattacctctcattgagagggcctgaacctgtctaaatccttgtctccacatccatccacttttaggtctcgtgcgctacccccttttattattgccgaattcatgtttcgacagggacctttggatgtaacattggatctttgccattcacctacctgggtctgcctgttggaactacaaggcccaaaatcatagactttgtccctttaattgacagagtagaaagaaggttgcctgctattaccatgtttctaaaccaaggtcaaagactcactatggtaaactcagtcttatcctccctccccacctattacatgtgtaccctcaaaatcccaaagaaggtgatagagcacattgatagagcaagaagacactgtctatggagaaaatcaaatgaagttgatgctaggtctctttctctagaagcatgggataaagtttgcaagcccaagcacaggggtggccttgggataattaatttggaatttcaaaactgtgctcttcttatgaaacacttggataaattctacaacaaaaggggactcccatgggttagactgctatggaatgcatattacaaaaacaaccctcacccacgacatgccatgcaagaaaaaggatccttttggtggagggatgtttttcgtcttattccaatcttcagagggcttagtgcaattcaaattaacacaggagattcaaccctcgtgtggaaggatccttggacagacatcatacctcagtttgccttcccgacgattttctcttttgctgccaatgaagacgtatccattcagaagttcatgcaaaatgatctagaccagaatttcttccttcctctctctgctcaagctctacaatagcttagtgaaatctcaaaccttctgaataatattcacctctctaatcaaagtgatagctggacatacatttggggaccatctttcaagcccaagaaggtttatgatatgttctttgctcatctatcaccttaccctgcaatcacatcaatatggaaaagtaaatgcacgatgaaagtaaaagctttcctttggctgctatttatggatagacttaacacaagagatatgcttcaaagaagacaatttcacattcagaatggaccatcatgtaggatgtgcaactctggagttctggaggatatgcctcacctgttctttttctattcttttgttcaatcttgctggaatttactaggcatcaattgggatgagaacctagagttctgtgatatgattcaatcggcatatatcaacttccatcaacctgttttttagaagttgtgggcactgcttgctggcagatctggacaaaaaggaattctttaattttcaacaacatccagctttcaatccacttgtggaggattggtttcaaagaggatttcactcttcttatgcatagagtgaaggaggaagacaaacaaaaataccaatcatggatagactcaattttctagatcccttgtaaagttttttttctttttttctctcttttgtaaatatctttatatatatatatatatatataatctattatcacagtaggagcctctcctactgtttctcgtcaaaaaaaataccataaatgtatatagaagagtattctaataaaagtacaaaacttacaaaatagaagagaaaagttactgatgctaatgagttgcagagggttgtgctgtggcgtggtgtggcgtggtgtggactgatgctactgtgctgcttcttgcttgctgcacctttttttctcccgatctgagattgggtttgcgtcacccaccgtctcgtcgacatatgtacgtctccgacatcggcatcgactctcttcaacttcatcattctgcctcacgcatcttcggtttgatcacccattcaagcgcccggctacaatgacttctaccgccaatcgtcttcaactatgcgtctacaccatcaagcttcgggttgccgctgcgtcgccccctcgggccacagtgccgctgcctgtggtccacacctcctcaagtttttgcaatgctgagaggcaccctcctcagcatggctacatcaccggtggacttctcgccactgcatcgacatggagctacagctgtgttgtcctcggaccgtagctttgctgctttcgtcgtctttatcgccgtttgcacatcgacaacctcgtcatccgcactagtcatcgtcagccacttgggttcttcttcatctacttcaagcattgccgctctaggccggtgctccagctacctctacatggctgttaccgacgacgccgtccaggccgttggtcccgctactgcgcctttttcttcgtcgaacatgtctcattgccagcgtcgtcatatcttcctcgactacacttcgctcttctccggcaactgcgtgctgcttcggcaattctctatctatgcaattctttcgccgcgactgtcttggaggccttctctactagtctcctccgacattggcgtatgattcatggcggtctccaaccttgcccgcacggtattggcaacaccgttgcgtgcgttcgttccaagttgtccccgggtttggcaaacccgacatgacgtctcatccttcacggttcgactacatcggctcttcaacgttatcttcctcaacgactgtcgcgattgtgtcaccgtctttgtctctagcgcgtcctcgcacaccttggtccacgacgccctcccatgcgtccacaaccactctacggcgccccatgctcgccttgtggcctggctacctcgacatcagcttcccgacttcggctacatcgaccacggctactctacacacggcttcatcaaccacggctccctcgcaccctttgctttagcaacatcgactacggcacgaaaggctatcatcgtgttgagtactcttgttggttttttctctagtccaagtgtccgcgctgctcacgtttggactgcgggggatgttagagtatatggtagttagagttttattaggataggattgatttgtgtggagtctttccatatctgtaatccttccttatctacttcccatgtactcctatatatatcggtcctctgagactcaatacaacgtgtccaatattcacattatctcctctccctatactatccaacatgatcgctgatctctgccttctccagtggttactgccttactggttggcgattcggaactcagcgtccacgaccaccagaccacgactcgatgtctagtgtgctcagtcgcaggctcggtaggacggacacactgtcgatgacaatcgacgaggagatagagacaagatcagcagtcgatgatcgctgtcgaggcatgggcggccgggcagtgggcgtcggggcgacggcgcctcggtggttcagcgctccactcgttcgccattcatggtctgccaatctcgtggcctcgcgggtggagtcaaggggtcaggccatcaagctgtcgggtgaggcgatcgttgtgcagcggcggtgcggcgtagggctcctcgatcggctcctcgcggcggtgcgcgtagcggcatgttggcaaggcgtggcgctagggctgactagactggctgcgaatggcgtgattgcgggcggttgaagcgaaaaatgaggagttgatcgcgacgtgaggagaggtgcacatgtccgcgcgacgcttcggtttccactttccatgccgcgatcaccatttgtttttttctgatatatggtagggtcggttgccattttttcggtggttcaatgaccacgtggaccaccctataaatccgcctaattgacacccaccgccggcacgctctggcttgcagctggcctatcgacgacgtcattatctgctgactgaggttaggatctttgctcgaatactggtattacgaaactaatatttagggattgaattgtatgcattgaaataggctcaaaggagcatataaagtgtacaagcagacaaaaaaaaaattaaaatacccttgctaacaatcagcgtgaggaagctgttcatgatgagctccttccactagtacacaaacgatttttccgtgacaaaatgcatttttccataccgaggtcccgcccgtctacccaggtgtctacaaaaatccatattttcacgtgcgggcggcctaatcgcacgagataatccatcttcccgtgtgttgacggtcattaccatattcatgttagaacaataatattccactagtattaggtttgctaaccttttgcatagaataaccataaagtggaggagaaccgacatcaaatcagatgataaataaatcggatggtgtcgagaatcagacttatgcatgaatgggccaagaactcagaaatgacatgacgaattaggccaaaattcacaagtctgcggagaagagcatgagatgaggccaccagccgaaatttgggctggttgggccggccctaggttcggccaaaccatcctcagcgttgtttgatccaggtctttgcctggacggtgtagatcagcccccaatgacggttggagggtatttccaaccattccaaccatcacaaccatcattgggaggcaataaaaggagctctcatcctcacttcattcacacacttcaagcaaaactctctcatattctctcaagtttagtttagtgttcttaagctagtggagtatgaatagaatagaaatcggagtccggaagcattcagaagagttcaggtatagctctagtagctcttatttcctcttttgcaagcttcgtactttatttagaatactcttctttatacatttctgttattgaaatactttccgagtatatgaatgccaactttactttatgttcatgttatactgattatactgctatcttatctgggagatgcataggtacatatataatgtttgcttatgcaattactctatgtcatgacgatgatattagagtagtatttggtagtttaggtgtggtgtctagattatgggatatcattatttaaggttatatgctgcggatgagaggtgggccgctgatggtgtcagctcagtacgtgtatatagtcctaagttaatttcctggggagtgtactcctccgtatttatccccgattgtatggttatgacaggatgttgtaaggaactcggcagtcaggggtgacttctcgaagtaccaggagggcatcagatagagggtattagctagttaatcatataactagaatgtatgtatactatgtataccagaagtatagcaatagattctctttctttttttctttccacttagcttagatattttagtatgagaatgagtagctccatgcttgtgtgtcactctaccctttgatttatcttaaccctgcttagactatgattattacaagtaacatataaattgttagtacggttctctctactatgatctttccacggtattaaataaatacaatacccttggaatactctcgggtgaaatgctacaatggtatatccgtgcgcttgcggatgaactctataaccataatataccgggagtatttctgcgccattgttgggaattatatttctagtaatgtcattaagaaataccaacatcgtacggtcgggttgagtggaccgcacaggataatcgattatcacgtgcagtcaaattatactgcccacacgcaaaaaaaaaaagaaaaacccaaaaaaataaaataaaaaaatcccaaaccctaaccctaaccctagaatcgcccaccgacgtctctcgtggtcgccatcgtcctcatcgtcgcgctgctgccgctcccagccaccaccgctgctcccgagcccgctgctcctaaccccgtctccgccgtgaccggttgtcgttgccgctctcgggtgccttctcctcctcgtcatcgacgcggcgcggatctggctggtcgcccgccgcaccgcctctcggtcgctagccgccgcgctgcctacgacaacagctgctgcgctgcctcccgcccatcgcctcctcggcggcagcggcggcaagccgggcgcctcccgcgccccgtgcgctcggtggggaggcgaggagaggaaagggagagagagaggactgattgagggagaataaaatggaaaaggaagagaaagggtgaaaggtttgaagtgaatgagagggaaaagatgcagaggtattttcacgtgcggtccacttaagacacccgcacgcgaaaatcaatttttgcgtgcgggcctcttaagggtccgcatgtgaaaataggcttatttttacatgcggaccgtttaggggcccgcctacgaaagtcgatttttgcgtgcgggtctcttaagggtccgcacacgaaaatgggagaccgattttcacagacgcacgcgaaaacggtctgtctggaaaaataggagctcctcgactaggaaagtcttttgtgtactagtgttccaatccctatggttgcggagctgatttgcaggtggacgctcatgccggagttgagggctatgatcttcatcacttaatcacgttgccatggatggtgtcatacaaccggctcacgctgaggttctcctggagagatttgctccagtccaacaaaaagtacctcgagataccgatacctcacggtaccaaatcattttcgattgttggatctaacaaagctcatcctgtccagctagatctaacgattgaaaatgttttggtactgtgaggtaccagtacctccatgtatttttttttttgaccagagcaaacctctctcctagaacaccacagcgaggaagaggaagtggggtggggcctcccagcgagagagctattaaagggcgttcgcggcatgggcgatctatcgtgactgcttgtcgtgccccttgtaaatcaatacatggattcaactgtttgtaccttaaggatgatagaaatgctcctcccataaagctccgtaccaatggatatgaacaaatcaactaccaatgttctttcacctactaattttgtttttcttccttgagaacgacatgttctttcgtacgtcattgtttgtatgcacacacatcgcttgctttcatctaagcttggtgctaacgaaagttatttgtaggtgcaccttccaatggggatctctcaacacactccgatagtagcaaccactcgtacaaacaaagcaactaaaccacctgacccctgaccaaaagagatcgacacccacagcgatcgatcgatcgatattattacatatccctcaactactcactggccgtagccctttgttgcagctcggtgcatgtgtttgcacaatgagctacctcctctcctacatctccaagatgctgtgcatcaagattccgtcggaggcgaggcaagccagcgaggacggcggcagcggtggcctgacggagtgctccgtctgtctctccaggatccgtgtcggcgaggcgacgaggcgtctgccctgccggcatgcgttccaccgggactgcgtcgaccggtggctcctctcatgcaggcggacgtgcccgctttgccgggtttacgtcgtcgtcgacggtaacaagccaggggtggcagcgaagcacaccggcgagccgccgctcgctgaagacatggtgatctggttctctgccatgctcgtccctggattctgacatgtatatctctgatgtctaagcgcaatgctttttatttgtttgtttcctgcctggaaaccggtttgttttttttttcttatattatgcaaattaacatgacgatttcacgcttgtagcgtttgtatgtacgcttacgctcacatcgtcagcattttttttcttttgcaagttttctattgggcgttgattacctattcaagagaactgaaaaaaaaataagtaggtatatataataaaaacggtttctttagatttcctttaacagtttttttcttttaatctgtcgaattttattttataccgtgcgatatacacacagatgatactagtctggtttatcagttcagcatttctttctggtttgcttggttgaaccatcatcactgttgagttgtctgtccatgtggagataaaacaaggggaaagtgagacaagggaaggaagctcgaagatgctagagaaggtcgtacaaatctgaacaggaggtgtttcttgccacgtcgtgagtcctcacccaacacgctgccatccactcaccgtcactaccagactttagcagctacctgtaggcatgaaacccacagaggaaaataggttttaccgtcagaaatttttaacctgtgaatggactgatatgaatcgccgacagaaaaatgaccacagagaaattccattttcctgtaggtttcatattataaatcgtttgatttttttattattataagacatttgactttttttatcaaactcctttaaatttgatcaagtttatagaaaaatatactaacatttttaatactaaacaaacatattatcaaaatatattcaatacaaaatttaatgaaactaatttggtaatgtaaatgttgttatttttttctaaaaatttgatcaaacctaaagaactttgactaagaaataagtccaataactaataatataaaacaaatagagtagttgtcaacgttctttgcatctatatttgttctttagttcaggtgttgttccctctgttcccaaccacaaccgctagtctagtgagatgttagagcatctccaacagcatctctaaattcgattctccaaatacccatacagctaactctccatctgatttgggtaatcaatctaggtgttgactccaacaggctctctatttacatctccaaaatgacaaaaggacccacatgtcagcctctattgctttcttcttcctcttctttctcttcctctttctcttctcccttctcatcgacccatccccgtgcgaggtggacggcgacagcggcagcggatcctcc

SEQ ID NO: 74892 - DNA, 7261 bp, Oryza sativa
ttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcagttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactatccctcgggtggagcgtataagtcatactcctaggtctttagtaagcttcctagaagattcacccaaaatcttcatagactgcgaccaacagtcaagctcacaaaggtgagttctttcaagaatgctttgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactatttactttgacaattaccgtttgattgtcacagttcataaggatagctggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaaaccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattaacttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcttcattgactgcaaagcctgcagatatcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcgctacagatagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctgatggtgtgattgaactgggaattatttcagagggttggttcgaaccactatgtgtatccttcattgggaaaaagctctcaaagaaggtagcatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaatttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtagaagttctagtggtgccaagtttctctccttggcagccttgtgaggcttgcgaggttgcttcgattgcacacaactatggcacttagaacttttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattccggtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccgactgcttggtcgaaacttttcgcagatgtctacgaaggcacgaaacacgcgagcgaagaggaagacgagccgttgtgaacgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcgtatgttgcacgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagtttgcaggtgacttgaggtcagccttggtcaatggtgaggaccgagactatgttcagggaggaatagaggtctagtgcggtcgggataccatgtgagaaggtgactagagtcaggattcttggaggtcaacttcggtcaacggtgaggatcgggactaaactcggggaggagttgaggtccagacggtcaaggatgccgggtgacgaagttggatacgagatggcgcatggtggatggacaccgtgtgggagagatcttcgcaaatcgcaacgggcttcacgaggtgtgcgtgcaagcgtcggtgttcgcgaaggaaattgagtgataatatttggaggtatatggtgctacagtacacgaggtactgtagcatgcaggttatatgtatgcatgtatggtgctgtacatgtgcagtttgctgattggttggctttgaggtttgcatgtatgcgttggctgtttggaaggcagcaggcagcatgcagcggctcggctcagccaggaagggagcgagaccaagcaggaaacggcaggcgtgcgcgcgagttggagtctgactcggttggacctggttcggcaggtgcggctgagagtttggatattgtaattgatttagaaattgagcatagagtcctagtgggactagaagttattctcctactttgagtaggaggtttttggtataaatagagagggagcgtgagactttcctgtatcgcttttcagagcgtggagttgatagtttagttagggtttcgagtttagtcaagatttttgtaaggagtgctgttgttgcactatgtaaacatagagagaagcaataaagttgtcatgtactttgagagttcttcgatttgtgtttttttgtttcaggcggcagggaggcgatctaaccggcagcgtgcaagcggtccgactggcggcgacaggactacgtcgagatttccatcgatttgagggtaacttttatttccgctaaaagtttttgggtttttggttttccctaccattcaccccctctggtaggcttggttacttgtgttcgatcctacatcgtcaatttcagagctaaatatagcatttgtgataaaaaatccgagtaaaaaaaactcataaggatttatcaactgcggaataaatactgactgacaagtttaaccaacctaagtaataacttgagcctgtatcagataaattaaacatacaaatgtttttagaaggaacaatagtcttaaaaaaccaatcgtccttatcaaaccctagcagccttgtgaccatatagaaaaagccagcaaaacaacatgacgtttttaactgtcaggcacctttttatacgtatcgtagtagttacaaagaatttactaactgcagaaaaagaatttaaatggtattgggctttacattttgtaggcaattt

SEQ ID NO: 74893 - DNA, 4491 bp, Oryza sativa
cccaatgcgcacaacccccttatctatattgagctgaaaccactcccgcaaatgttcatcggattttatctcaacaaaaccatcatccaaagaacgccacaaactcacatattgtttagatccccacgtgtagtgttcagcaatgaaattaacaacttgcagcagatcatacttatgcatgtcaatattttgggttggcaaggttttaccctggaggtattgctttggacctccatccggcaaactgaaaaaagactcaactctaacaactaattgcaaatcgctgtgagtaggcctacaaatcacaacacaagtggcacatttaggtaaatcgtcctaaatagcaaagttatatagagagacgaaaaagcaaccgtactgaatgcagccctaagattaaaatgcatactagctggtagttcaagtatatctaagtatatgtaagtatctaactctaagtttcatctaggtttagctagctctaagttttcatgtccattttcataagatagcatgacaagaatcaaattacctgttgaactcttccatcaaaattagctccattgatatgatttcctccattgccaacaacttccccttttctgccttatcttgccctcggctgtgagaggccgcctccacgtggaagagaactggccgccggctgtgaacctcctgcgagcgggcgccggcgcacgccctcggccgcggcctcgcgcacccgcggcagcggcggcggccaccgcctcctcgcacggccgccgccgcctcctcgcgcggccaccaccgacgccgcctccccgccgcgcgagctccctcccgcgcgtgccggccgccgcctcaccgccacaagagctccctcgccgccgcctcccttgccgccacctccccgccgccgcctcgcgcgcctctcgcgcgcgcctcggccgccacctccgcgccgcgcgggctccctcgccgccgcctcaccgccgcatgcgctcgccgccgccgtcgtcgcgctagcttgctagggttttgagttgactcgacccagggagtcccgacgcacgggaagagaagaaccctatccattcactttccctcaggggtagaagtgtcattacataattcctaaaaccttttttttaatttctttttgtatttctttaacacataatgtgggacccaccaaacggctgtcacaaatgggagtagacggctgcttcaaattcaaaaagtgggggtaaaaatgcaaaccctaaaaaataggggcaaaacaacaattggctttcaaagtgggggcatggatgcaattgccccttattattattaatatagccaatttatcttttgcacatacttaagcattaattgccaaaattttaaaaatattggtttcatggattctgggacagcgtatacttaactctgtatggagtagctgttaaatttttaaaaaaatcacaccaagtaattaattaatatctatgtcatggatatgtggctgcagcacattaatttcttgtgaaatagatattttccttagaaatattttagataaattgccatactaaatttattcgaacaagtatatgctgatgtatcaattgagagaaattttacagtctttaatagatattttaggtacttgagaaagtcattataaattatgctactatacctccgaatactaaagacgatggtaaacttacccattaattaaaccatttaatgtgatagataaaaacaaaattacccttaaatgttactctccgtcccagtgcctataacctatgaccggattgatacataatacaaatacacatactataaaaattaattcggacagaaggaccatatagattcatatatagtctaaagatatgtctaattcggtgttagattgctatattttgggatagagagagtatagtacatttttccgtgccacccggtgtggcaacatatttcgcacatcgccacagtattttccaaatctttttagatatgggttttccttaatatcattataatgttaaaattccgaaaatcatgttcttcctaacgaacaattctacattggatgagaaggaaacaagatatatactgtacattccaatataggagtatatggtggttctctatggcacgacgccatgattggtggatagctgcgttgccagcaaatgtcattttttgcgtgtacccctgcgaacagtgctgtccttgcacacagtggcacttgctgtccttccatagttccattcattctaagaaaaactcactgtcctttcaattcgctctatacttcaattcatgcgtggatttatttacatcattcgtaaatatagatgcatccttaagaggcacagtcgcatgacacctgcacatatgtagctgtgttatgtagtggtgtgtgtgccctcttgtgcatctcttttgtaattgtaattgaaaaaaaacgtgcaatgtaaatactccttccgtttcaaaatatttgataccgttgactttttagcacatgtttgaccgtttgtctaattcaaaaacttttgtgaaatatgtaaaattatatgcctatataaaaatatatttaacaatgaatcaaatgataggaaaagaattaataattacttaaattttttgaataagacgaacggtcaaacatgtttaaaaaagtcaacggcgtcaaacattttaaaacgttaaaacggaggtagtaagtgataatggcttcatttctagttagcattgctgtaagcgcggtgcaatggatttggtcattaacgcaatactccgtctgtttaagaaactccaaatcttaaggatgaatctggacaagttcattgctagatttttttttatttttaacagagggagtaggtcacaaacagtttttgccaaattggtccaattagggtcatgaacagtttccgctcgagataggttaatttagtttgtttcttgtgccatttatacttgtattttatagcaagccaaaagcaaaattacaaacttcaaatatttcaagttatagctaataaaaaattagttttttaaatggatcctggtatagatgaatagcatctgatgtcgtgggcaaatgtggtgcaaccacataaaacagatcgatttgttcatgtgcaaatatgtgtggtgcacctacaaattaaaacatatggatatttgatttatcacttcaatcagctctttacgatggcatttaacattatacctcccctagctactaactgaaaaaagggaaccttgcattgctcacacaggtacagtgttgccaaagggcaatataccacagtttgtgctcaaatgtgtatatctgtagcatgaatgttctgtgttcatatgggtccacgtggtcaaggaacaggagagaatattgtttcaattaatatatctgaaactacaaatttgttgtaccacctacctaggggtgacaacactgcacatttggctatttagggccacgcatatatgcatgaaaaattgacacacgacgttacttgagaacctattcatgcaggtctatgagaaaaccccaccaaaaaaaacagatgtgcaaaataatgctggattttcatatgctataaattaagtactactttaatcaaacaccacattgacacacaatgacacaaattaaatactcttacgaattcaagtcatatatactctaatacgcacgtgcagcttgttactcaaataaagaaacagggcaatacggatcagtatatccaaccaggctgcatgtaggccaagaacctgacaattcgttttccttggagaaagcaaagaacgtttggaacgtgtgatgtacatgcagatcgaggaaaatagctaatcctgctctttccctttccagcacaaaaaaagattccttcgtagttcgcactgcatttatactcaaacctgcaaggctcccaaacagtttgaaccaaggcgagggaaaaaaaaaacatctccatagccaagagaaaacatactgtacatgtcaagagattccctcttcatattcttacaatcctatttactcaaattaaatcttcatatttcacttcgtaaattccaacggctaatttggtcagcacaaattcagcatctcaatcaacacaatttcaatgcatgaaggcgatcaagctcaccactctcctgccatacaagatggaccgccaccgcttggaatttccgcagtgacggcaacacgaggaagaggcaacactagcggatgtatgaaggagtctgccaagctcggctatttccggcgagcttgagagtataatcgagatagaggccggtggaaagacgaaaggcggcgtactcttgggcttagtgtggaggcaacggtggcggcctcgcggagaggtgacaacaccttggcttggcatggcagagttccacttctcaacagggatgcatgacactcctaggtaagaaggcggcggtgctggtgggtgtgggtggaggcacatggacttctctcaacaataaagt

SEQ ID NO: 74894 - DNA, 10493 bp, Oryza sativa
cgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatggtacgtatagcaccaaaccaacgccgccgccgccgccggcgtgcttgttccggcgcagcagcgcatcatcatcgatcgatctaagtctaataagataatcaattaaccctaactaaataaaatgataagaacagtatatatggttatgatcagtgaaacactcgtcgatctgagggaaaatccggtcgagatcgagggagtggggagacaaattgaactgcaggctagctaatttaatcgtgtcgatcgatttctagcttttgttgatctttatatatacgaacgcatgcactttcccctttgtttttttttcccttcgatctgcttggagctcatatgctatagatcttggggcatatgtatctgtcagctttcgagagcggctatgtccatcgatccctcttttttttctctttctttttgtagtatcagctgccatgcatatatcagatttcgttttcgcgtgcttttagtgcttcacttatctgttcgccatatctgatttcttctcatcctttgccgacgtcgtctgagcagtctgacctccaagatctggcgaaataaacctcaatcgttgctatttcttgccttgaatctgcataaacatgacaatagatccttctattttttttcttcaagacaagatcttgctgtttcttcccttgctatttttcattcaaagattcttcttttttttctaaaagaactatatatatatgaatcgagtttcatcttcatcgatctgtctctctccttttgttttctgtaaacacacacacgagcgtacgtatatatactctcatctctacttttatcaaaaagaaacacacatgttctagcttcagatcccaaaataatcaaacaggaaaatatatataatatgcaattagttcagatcccgaggtagatttcttgattatttccattttccaaagtgaggcgcgcgacaactcgacgcggttcctctttgcacacacacacagtataactgtacgcaaggggtaagaacaaaggagcaatcccttctgggttgctgcttgcttctcccatttttagctatttcagaatttcactttctgagactcatctctctctctctaccagctgcattatttcacttcccttttttcccatttctgcctattacacggatggcctctttgtggactcgtccaaattgaggcacggtagctggtgtcaaaatgaacctgcaggcccagcccggttatgtatatgtatagctatatagcttttcttgcaagaggtatatacactttgtagttttagccagtggtccagctagccatggatggatatattatacacacgtatatatagtacatgtatgtacgagtgttaattaaactcgtttagttaatttccaaagtccttttttattactacagctagcctgatctgtgttttagtgtgttactgttccattagttactgttctattgaagagagcgcgtacacgttgttgttttatttctctttttccgatccggtgttccttttttttttcttttggtcatcttcctcgagtcccgagcagtagaaatactactactgccctgcaaagcacacacatcaagtgatgtgtttttcttcagagcttcagacgtgtcatatcaagcaggtcagcacgcattacatgcaatataatactcctatatggacacgcagaactcactttgatcatgtgtgaccaagctggatgagccgttaatttgttgttgggacagggtattgaatcattaattgcggtttttcctctttttcctgtcttgttctactcagagaattgaacggtgaactgtataggcagagctagtcctgcatgcatcggttttctgaaattattaactatacacacacatgcacaattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgggaaatgctattggaactactagttttcgggacattataagaaaatgtatgcatatatatatatatatatggacttatgatatgggccagatacctatatatatagaagatatatgtgtgctactacctccattcaacaatacaagcatttgagccagttctggtcaaggatataaacatcctgcactattagcttgtacttgtcaaattaatgatctctaattcaaactttcttgctactttacccccaatcacccttcccaaccatcttaatctttgctaaacattctagaaatgcttattgttggatggaggaagtagctattaactactcctatagtttttttaactacctcatattaattttgtaatcctaataaatgcactatatatgcccacttttaccgtgtttccaaactggcatcaagctaaaatgaatgttaatttagtttccccataattttatgagaatcgcaaaattgtacctattttaaacaaatcaaagtcactgaacaaatgaacggaggttaattattatattcacctgatataggcagactaggttgggctaagagggacattaatttgggcatctaggttttgaaatgggagatatggagagtgaaccaaaaaaaaactgttagtgaattagtacatgatatatactagtattattagtgggaacctagagaaatgcaaagaatgttgcgcaaatcatcattttgtgtaaattaaaatgggatatacactatggggaactatagctgagtgtcaatccccaccttttgtttgtaattaaacatgtgtttatgctacaaattactccctccgtactcataaaggaagtcgtttaggacaatgtttaagtcaaaccttgggaatataaattatgaataactctcaagttgttgagtttgaaaatgtaaaaaatatatgaatagatttgtcttgaaaaatactttcataaaagtatacatatatcacttttcaataaatattttatagaaacaagaagtcaaaattgtgttttggagaccgtgtcactgtccaaaacgacttctttacgagtacggagggagtatgttctacatattggctaatattgttgaacccttcggatcaatcttagacacagtagccattttacccactgatgcagcaacccaattaggtatctactaattagcatcatagtgcaaatttgtacttttcaagtggaaaatagaaattatttgtcctcctttactttaatttcttgataatatgatatatgtaacataatttctctttgctcccaagcatataaaaaacttcaatttgatatgtccaaaaaatgtcatatatatagcatgtaatcctctgtggcaaacacgtttttttggctcaaattaagaagaggaaaaaatggtatatatgtataaacctaacaaaaatgccccaacaagaatagctttattttgtgaacaaggtcatatagaccagggaacaaaaaccctgtactgtgcttctattttgctatgcattttggataagtgattctacagaaatatgactatataggagatattctcaaatctgatcttttctattaattagcccatacgatatgaagacatatcttcctctgttctgattctatttgttgtgctaagatagtctacaggatttgctaggttgccacctgccgtcaacaaaattcagctcatcagattttgttatagttgctagcacagttatattatacgtatatctcttttgagaatatattattacagtccattgatttttcttgtagagtggaaaatattattgtgttttctaaccgtaggagttcatgtggtgttatttattttggataatgtggtgtatttttatgagaaatcaggatcgcgtcaacatgaaagtttcatctaatacattattaagtgcatcgtagcaacaattcatatattaactcaaaggtagctttgaaattaagatgcatgtcattaatgcataatagagaaatcaggttaccaaattatattaagcccatatattaactcaaaggtcatagctttgacaaatgctccttacagatttctccttgaaccaatttgtaaaatatcctctcctttttttttgcgcgaacgctaaatatcctttgtttaacaacctcgtcaatttgtccatttcatatgtgtgaacatccttgtacattcttttttgtgccgtttgaaataaaactttgaataaatatgcacaacttaaatgcttaaatgtcaattggatttggatgaaacaaaaccaaagttttagaatttacgatctatcattatgaatttatgtatgatatatcacactctttctgaataaacttcagaataatataaattgcttaattatggtatacatgagcatatatagcttgcgcaaatcaaaactgtacagtaggtgtgtgttcaattcagaatagtattctatttcgaatttaaattaataataccttctgtagtaatttctatattagaaaatttatacatacaaggagcactgttaattagctagctagctttatgggttccactaatcaatttatatataataatgtgctaaactatacagcgtccatgcatttttattcttcatgcctaattaatttgattcaccattaattaattctacgtacaatgttcgaatgtgtgactatatatgctgcatctgcagttctgcacctcattcagtactaaattcaagttcaggttcattaattaattcacttattccttcatttttcacttccagcatgtacaaaaccttggagaggtaccgcagctgcaactacaactcacaggatgcagcagctccagaaaacgaagtaagcatcctcttagtttcttaattaacaatctttgacaaatcaattacttcttactagcagaacatatattatgatttatgagtcagttattcgcttatagtattctctactcactaaaaaggattatgttacccttttttttcttatgagatgaagggtcgtgttatctttgttaattttttgggacattgatgttatccttaatgtcgaatgcatatatagggttttctctagcttcatgttttgctctgatatgtgcagtgatgctcatgcaagtgaaaatgagctgggctcttaccgtgcgtaggttaacaggccggcccattaatagctaacagtttagatgggccgcaatgctagatgccgcgggggacgaaggccttacattcaatgggccgtagggcgagatacggcccacgtcggaggttgtgggccgtagggcgcattgtgactttgggccgaatatgcttacttaaattgggcttagaattgtgagaggtttctgttcggatccgaagagattgatgccatgttgtctatgttaacattcctcatgcataagtaggtttagctgatagtctaaaacaggagtgaatttagtagacttggtttgcaattagaatgctacatggtttcctgaatactttgttgtgcctacagtttgttaaccatcttttttttccccttcggccaatatggtctgatatcttgtagcttcaggagtcatgagctaatccgtgtgtctgcaattttgttgtttaaaccagattaattaccaagaatacctgaagctgaaaacaagagttgaatttcttcaaaccacacagaggtagtcttcagagatgaatgtggccaatcatttcagcttcttatctactacagagttgctatgttcttcctgagggacagagtttctatgacttactagcaagcacttcacaccatgcagaaatattcttggtgaggatttgggcccactaagcatgaaggagctggagcagcttgagaaccagatagaagtatccctcaaacaaatcaggtcaagaaaggtaaaaatgtttgttcgccatgttacctatgcaagcaaatggcactttttgatatgctcttcttaaacactgaacctagattagattaataatgagcttattataattttttactgcaactatcatgtaattcggtacttattacccctcaactgtatggatttgtttatgtgcatggcttttaacacaggctcaatatttctgcagaaccaagcactgcttgatcagctgtttgatctgaagagcaaggtactgaataaattctggttcttttcttttttcctctgcacctaaattaaatctgtgcacatatgacaaacactaaaattgattctgcaggagcaacagctgcaagatctcaacaaagacttgaggaaaaaggtaacacagccatcgatcaccctgaaagtcattgcgtgcatcagtattcggacaacatacatctttttccttgctaaagtcccaaccatgatcttttcatggctgctaaaatgtttcacgaaagttacagtatttgcacggaataaacctttttccccggtacggcttaaaagttaatcagcttctcataccgctgaagcgtttgtttgttcgtgcagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtattcttcttttcttccagttacagttaatttcttgcctgaaaaaattcccaaaatgcagaggtcatgttctttttaaactattcactaaattattaaacagagtatttgctcaagttcgaacaatacactttcttaaaagatggtttgctatgtattacttagaccacttatctcgatttacttgtatattttattttttttcaaatatttaatttataactatataatcgagtatatcgataatcctgacaataattcgcccaataatctagatcaaattgggcctaattttgtctttgttattcagtaatttaaaatttatgtatatatactccatcgttttcatagctttaatttaatttttccttggtgaaggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccaaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctcaaaaacttgtggagattatgttagggagtagtgcaagaaatgttttaagacggcagctgttatctcatgagatattgataatgatgttgtctctgctgctgtcgcgatcgccaaattatgctgtttttttagattataccgaaatatgctgatggatacgtggttttgatctgtggccgttgcgaagtaagcgcgatttatttctgcaggcgttcgaatcacgttttactgttggcggtagttactgcacggtgactgttcgacgaaatgccaaaacaacccgcaggctgcagccagtcgacatgtgcggcggccgtcgcccgatcgcgcggctagctagtagctgtcggcaccgccggttggttacccgcaccaccgggccctcgccgtcgccgtcggccgtccttgcgctgcacggacgcgtcacgcgcactgccgcctgcctgcctttgcgctgtcgggcgggcgcgcgggcagaaagcgaccgcgcgcgcggaggggggcgccctcttccacacgcagcgatgcggaggcggcactggcacggaactcccaccgagccgacgggcccgcccgcccggcggccggccgcgccgcgccagcagctggacgaacatgcgtgcacagcgcgcgcgcaggcgaggcgcggcgcgacgtggtgcttcggctcgcgtcctcgcgtacgtacgccgccacggccaccaccgccatcagtgtcgcgttatgcacttactcatactgaacactggacagagcacgatatgcagcggtgtttgtaccgcccggcccaagggacggcagactcgccggcagaaaatcaaattaaaattgcaatgttgcaagtatatgcagaagatcatgcatgatctactgaagcaatggattgcctgcagttagcctgatttctacctgaaaatcctactccctccatccgttctaaaataagttcattttttatccatctcacacgtatcaatacaaaatcaaaaagattaaattaattttatttatcaatcacaatgtacttgttttctatatattttaccctactctcaatacatttatcttctactttaaattttgatgtaaggattacttaaaaataaatttattgtcggataaacgaaaagaacttcaaaacaaacttatttttcctattttgtaacggaaggagtacttaatttcaattcgatcgccactgaaaatcttactgcacagaccaacagtgcatgcacactgaactgaattttgacgacgctacctgaaaattacttctctaccgtctcgatctctcaggttctctgcgcatccttctggagttctggtaacggactgattattcaagtaatcaactgaataatactgccattaaattaacagcgcaatatgatctcgtggaaccaaattaaagcgaaaaaaggccatgcaaattgacactccaacatacatcatggaacgaattcgcaccaagaaaacatatggtactgtaatatagtactatctgtcttaatcaggctaacttttgtgactttaatttctagacaaaaacgtatgggatagagacggagatacaaaggaaagagactacaccatcgaatggtacatcagaatatctaagctgatgtatatctgtgtccaatacggatcactctataaactgggtcaaaagatggtcctcacactctaaccagtagccagaaat

SEQ ID NO: 74895 - DNA, 11448 bp, Oryza sativa
cggagctagattgatttttagtcttcaattcacaaatttcaatataattattatttactaaagaaattaattccgtcatcaatttattcatctctaactctactattataaaaattgaagttgtttttcgctgatactttggtacatcgtttgcatttgagcaggtttttaagttcgttcacttttgacaaaaatataaggtttttaagaaatcattttaaaatactacatgctaacctacgatgagaatgagacttctaattgcttaagaattcttgccagacaataagaaaacaacgtacaggatatggccatcatcccaataagagttccaaatagatatcattactatcaaataaaaatcccatttactttttagacaaaaaaaatctaataacaatatgattaaaatagcattcacctgttgcaatgcacgggtattttttctagtcaatattaaaatttaatggagttttcactggcaagcctgggcaactgcctaggctagccgggcggtggctccgccactacatgcagttaattcagagaaagcatatatcctactaatagttgtttttagatgtataagggcttacgtgtttggttacctgcttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcagatctagcttggatccgatcgacttgggttttcttcatcgactggatttggccggccgcaaccgtcatcgctttcgcctccacctcttcgccgacggccacccccaactagatctgccatcctcgtccttctttgctagatgccacgcccctagccatctccaccatcatcgctggctacacctacaaatccgacgatggagaacccccaaccagcggattggttctatgatggtggtgagcaattgggcagtgagtgggtctggctcagcggcggcgagcccacgaagttgccccttgtttttcctcccccaccccctccccctagcccttttcctcttccttaatttttcttttcaccaatcaagtagtcatgtacatatgtgatgatggttttgctgttcatggatatatggatatgaattcaatttttattttaaaaaaacaatgaatttatttgacttagctgcatttatatctgaaatgtgtgtattttataataatttagagtatcttgcacttggtaatatttctatttatgggtagtagggataatcttaccatccacatagaaagatgagtatactcaaggttcatttatccaaccaaacgaataccatgcatacaagttttcacatatcgatccaaccaatgaaacaacacctcatataaaaccaggttaaactaatacatgcaaccaaacaaccactattacaccttgctaaccacaccaaggtcagcctgaatgatgcacatatgtaaggcaagctgagagtatttgagcaaccggccccggccctatgaaacgcaagatagaaaaaacacaagaaaaggaaaaaaaatgcagaaattgtgtagttgcatgtttctttaatcgtacaaaaaaagcgcaggaaagatgaaaaggagctcttcgctagcattgtaggaactaacaaaggaaagcaaagtttccaagagatttgacctcttgcttatttttcccctataaaattgaaccatagcagtgcaatcctttatgaaaaatttcctatccttcctatgaatcaaagggctctataggaaaatttttccttaattaggaaattgaatcctccaaattacttatggcaaacattcatttcaaagtggtatggtgctatcttcagtaaaatatctcctttatctgaaaaataaatttacagataattgtatttcacatatatagagatagatctgcactgactactgattgcgtgtttatatatgtgaaaacctgcaaacatgcgtattttacatatgataattaattatatcagttgtcaactatagtatgaaacttgaacacatgacatatactttgcacacgatttataagatgacaaatatatatatatatatatatagcatacgtacgtatatcgtacggtagcagcagctgggtcttatagggggtacatactccatgcaacaacaaattaacaagatcaaacataattaactaataaacacaaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatataacatcaataatatagcacataattaaagaacaattccacggtgagatcatatcacacaagaactatctaaaatcataatcgttttgtggtggccatgcatcaaataaatcaaatcatatagagaaactgccttaattatactctcattttgtgtgtatgtatatatgatcggtgtctctgttgctatggcaagttaattatcgtcaatatgatcatcacctgatgaggaatgggagcagctactactctgggctcggggttgctgttggaggtggaaaccgtcgatgagcagcgggggtcgcacttcgcccactgcataaatgcagagctgatcatcagacacttgcatctccatcggtgcaagtaattaatattattgtactagtaattgatgtgtaagcaaggtgcgagagatctagagaccgatggatcggttgattatagctaataactgtcacaattatcacatgcaaattgggggccgggagatattggggatgagtagagcttacgttcttggcagccatgctgaaggcctccctgtgagggatatctggcttggcagctttgatacgctgtatttcctccctgcatcatcatatattaattataattaattgatccgctaaaatatccatgtgcagatttatttctgagaagagagtgtagtacgtacgtaggtacatgcaatgcatatatgcatatggttgtgtcgattagatataaactggcattgtctacatatatatcccagtttagttgtcccatgcatattttattccctttggttaattacttcatcgatgatatatcgaagtacgggtctgtaaaaagattaattgatactctctccatctcaaaatataataattttcagctcttagaatttatcctaaaatataacaacttctccaccaacattctctttccaatcaatcacaaacttccaccattcacttttcccacctatctccactactcatccaatcacaaccctccaccactaacttctacctactttcttaataaccgtgttcaactctaaaacttcttatattctaggacggagggagtactaaatgtgatttatattacagtagcattagcatatgtacaataattagctcgcacacattggataataatgcatgtgtggtgttttgctaatatatcatatgttctaccttttgatactacttatttgtgttcaagctagtatattgtcccattttaattttccacgaatctgtgaaatttcccctgcatccaactttcaccataaaaatatatagattggtcctaggcttattcagttttagtgaaataattggtttactaactcaattagtatttaattaaagaaatggtcaatctagtagcaatgcagtatcaaattaacttaaatttatagcacccactattttatggaagggtcggttaatttaattaaaactatcccatggatgggcatctaagagcatgctgaaacttccataagttgtacacgttaagatggcacatataaattaatgtcttttattcaaaatgatctagtttttttaataaactgttatactacaagggcgcacaaattaacagccccatcttttacagttacgttagtaatttctaacaacaaaacaatgaacacttaaaaggcaagatggcttgcattatcaggaatttaacatcaacaagtgtgtgttacttatagcaggtaggttggtaggtgaaactacttttaaattaagtgtgtttaatttagttaaaaaatttcagaaaaggatactccctctgggctgataatacttgtcgttttggacaagggtgaggtcaaactttaaaatctttgattatgaatcattttcaaaatatttgtttttcaaatatggtgaccacatgtatagattagtctttaaaagtactttaataagatcatatatttgttaatatttttttacatattatgatagaaaataatggtcaaagttgtttttttgaagaccgtgcccttatccaaaacgacaagtattatcaacccgtactactagaaaaattatttgttgccacgaaaaaaatcgtggcatcaatactaaaattgtggcaatagatacatattgccacaattttaaaatcgttgctagccgtggtaataaatagtgtagtaataggttattgcaataatttttatttagtggtaataaatttagatgttgccacggaatggatgtggcaaaaaatcatattgcaacacttgatatcgttgtaataaaaattattgccaccactccatatgtggcattagttctacgtaccaaattaaaagtacaaatattaatctatcatcctatctattaatttctttatacagtgtcttggctaggattcgaacccatgtatattgttccatttgagcctacctaactaagatttgaatatctaaaagatttcatatgaacaagttatcaactataaaattatagatctcgtcgagagctataatttccatataaaatttgtctcaatccgtatccatatgaaaaaaattaagttaaattatgagacgacaatttttttattgcaacgaatttgctgattgtggcaacaaaaagtagtgaaaagtaccattattatgtaaattgccacaaaaattaaaattgtggcgatagaacatattttttttgcaacagtaagattttttgtggcgatatctcattttctattgcaacaaaagtactaaataaaacaacaattgtagatcattgcaataaaatatatttttttaccacagaaaaattatcattgcaatagtacaatatattgctacaaattattttttgttgtaataatttggtggcaatagctcaattatcttgtaatgccggagggagtagcatttatacttagtgtttatatcgaagaaattaaacataattgtatccaattgtttataaaatatatgtaacacgtacgtattgatgtaataatttgtcgtaaatattgaaaaataatctttgactagttatttataaaaaataatgatgattacgttctataacacaaacaaaaggtagttcaaatatcaggaataatgtatgaaaatattaggattgttggtgtgaacaggaaacaccaaaactctttttttttactttcattttgttgaaacaaattaaccatcataactgctttagatattgtaaataaatatctagcataggctgcaggcatcagatataagatgcacacaggcattaatagttatatatgggtaactatgatataagtgttttttttcttgtgtttataaaattatttgggaatcaagatgaacgtactgcccagctcattgaattaaataaagatgtattttgtcaaaaaaaataaagatgtgtattggtcatgtgttttcaaaggaaaatgtgtttactaatttattaattattactatcatggcctggaatctgttccaaaacctgagcaattaacagggaaaggaataaattaaacaaaaataaatgtacttttgttaaaaataagtgttaattaaataataaactaagttaaatgtgtatatcaacatatacatatatgtagagagagatagagatatgataaaatcaatgcaaattggcaataactaggaccacattataattatatgcagagatctcagctaaataaaacagctggacatggaagcctggaaacagagagacccttcactatatatcaacaagaacaaaatatattaaagaaaagaacatatatagtggcaactaaaaaaaatgtaaaatggggtatttattttagatatacaattcattcaccatatccatgtataaacccccaagctatcacaaggtttaaatcagaccatagatcgatgccctaaaaaaagtcagaccatagatgcactttatttctttttttttttgaaaatatccacaaaatgacaaacaagctagatatccataatatgcacaatggtctagctaggtaaattactggagtagagtgtttttgtttgattaacagaaacaaattaattaatattcttcaattcacaaaattacactagctatagtagcctttatttagtgtactgagatttacaatataaaaatgtcctgaccttggatgataaattattttatgtatattcttccttcttttagaaggggataaatccccttcaataaaatcgaaactttctcccaaaacaggtgcagatctcatagagtttatagtacaggacaaataaaaaaaatattgaaccactactagctccctcaaaaaaaaactcagaacaaatagaaaaaatatatataagatcacatgagtgcaaaccatattagggatcacaagcatatatataagataaatgcatggacaaataggtaaatagtttctcacctcatgaagcggttgtaagcagatgggaggcggtgtttcttctctggggctacaatggaagacataaaaacatttgtcagaggaaacacaagatatgctagctagctgtttgttcatatttatatattccatgtgaacacaagacacagagagctagtgaaggactcgtcagaagaagacagttaacaattagcaagaaactaaggagagactgaatgactgatataaatgagcagtaagcaagcaagaaatttaattagaaagatattgatatctactctagctggtatatatgcacgtgtatgatatagcaagtgaagtgtgcatatagttgctttgctacttacgcttcacaacgaagggtgctcttgggctaccctcatttgatgtcggcgagaccagcggcagcggctggttcctcctgcagtcagtgcaaggtccctaacaccaagaaatatccaacacaagaagcaaccaaggttaattactagcttccagctctagcacatttcaagatctctcaaacgcttgccatgcatggatcagtgtagtagtagtagtagtagtagtagtagtagtagtagtagttggatgatgataaaatcatcatttcctaactattttctcagatctctctctctctctctctctctctctctctctctctctctctctctctccctctctctctctctctctctctctctctccctctctctctctctctctccctgcttgggtagaagtagctatactagtcaactcggaaaacaggcaatgaatgcatctttccacaccaaaataaaaaaaaagaagtaaataaataaaaatgcaggtttaatttggagaggcatgaatgccacagtagagcagctgctagcagcatatgctgcctgagaaaaaaaaaagatgaactggccggccgcttttgcagcatgaggctttcccaggccacagatgggcaagagagaaatcttttgcaatccagctttgtttaatcttgccttgcaaacagtattctgagtggctccataaagccgagacaggacacagagagctagagagagaagggaaaagaggagagagaaaccgaacaaaagaacaccccaaagctctgctaaaccatatttcatgagaaaaaaaagtcccactctccatgtgcaattaataatttctttaattatatgtcttccctttcttgtataaggagaaagatttatcgccagcctttctcctcgcaagaagctacccatatgcagaaaagagaaagtagctagaaacagcaacacgagaactgaagaagatcaagacgacgaagaagaagaagaagaaagaggaggaaaaatatcaagaactgcaaggagattcagagaaagagagagagaaaagaatgaaacgctagcttaattagctagaggagaggactgacctgaaacgggcccaaggggtgatcagttggggagagcggctgcaccatcggcggccgcgggctgaggaaggagaggttgttgcagtggccacatttcacggtcacggtgtccatcagcctcttgcatgggactccaacctgcagctacccaaaagacgaaaaattaattaatcacatcatgcaattaagccaatactttcttcgttaatttcatctctttgttgcatggcactgtccttaaggagaaaaagtagaggagaacagcatatctgtgtggaaggaatctagatggagcaagcaaataaagtgggatatgcaaaacagagagggaaaaagaaaaggaagaagagaagattcagtagtacttgttttttaatggaagaacagaagatgcaggtactactaaattggattcttgtccagtttaaaaatgcagcctgcagctggtaacaatgaaagaaggggatataatggaagcgaaagatggaacatgacactgcgagagaaccagctgagtagaacattctaccacaaagcatcatatcaagagctatggccaatgaattttatctaagaaagaaaaagagagctagccaataaaacaccatgcaggaagacagcaagggcacatcaatcacgtgtcatgaacaatccccagtggaagtttccactagcttagcagctagctcctcaggacacagagagagcaagcaagaagctggatttggtcccagctatctagctagctctctctcactgtgtcctgtgtgagagtaagcatatgccatgatgcacattaagcaagccaaaggattggaccaaaccaaagtgagagccctctctgcaatctgcagcagcaggagatcacgagacagaaccaacactttgttctttgctctcttgtccaattcaaaagataaccaaagaacgaaggccatggtgcagctgcagctagcagcagcatatatcgatcgttctctgcatgcgaagctaagccgctgctccggtttctcgaggagtttaccgcgagcacggtgttgcagtaggtgcagcgcacgtagcacaggtgctcggacggcgacacgagatccattgcggcggcgacgacggcggcgacggcgacaagcaagctagccctagcactgaggcggaggaggaggaggaggaggagcaagtgtgagcggtggtgcgggggaatcaagggcaataagaggagaagaggccggaggaagaagacgggaaggaggagagagagagaggggggggggggggagagttgggcacagcgggaggaaggatggggtagggtttctattgttgcaataatggcgagggggtcccacgcacacatggaccccgtacgcacgagaccaaccacagtgatcgggagagcgagcaccagaaaagtttttatttttccttttctttctttctttctttcgaggcaaatgttgcaagcaaagctaagatagatagcgagatgagatccatggttggatggatggatatatcaacatacaccgctctatcttgtcgaaacgaaaaagagaaacatcttttttaaaatggtaattttaccatcattaaaaagatacctagagaaccatatttactaacgtttagtatctcgatattttctcaagaacggtaaaatttctctttttgaaaaaatatagagatggtgtgtaagaagcacgggatattctcttataacgtgtagaaagactttttcatgtacgtatatatgtgtaactcagcatagtgatctgacaggtctcttctatctctctctctctctctccatatgtgtacatgtacactacacatcgtaatatcatatgcatctcgaggctatgggaacagtatatgtttgctcctatagctagctatagcatatgcttacagtaactagctagagtggtgtccatccgatccggtggcgaagccacagtagtactacatcccatccagttgtgccttgtactgtgccctcaaattgtgaatggtccaattgctccctctctctctgactcggaagatagtaccggtactgcttgacatatacccctagctagccaggttcctaattaaatatctaggtgttagttctcagagcacctaaaataatctctgcagtttatagatttttgaaatgttttttgaaaattgaaatatctaggagtttcttttttctatggaggatcggaaatgaaactttggagcttgtgtggtgtgaaatctttagagaatatcttccttaactggcatttgagttgttgaggaatgtagtaggtttctcagttttattttgtaattactccctccatttcatattataagtcgtttgacttttttcttagtcaaaatttttcaagtttgattaaatttatagaaaaatatagtagtattttcaacataaaacaaacatattattaaaatatatttaatgttcgatttaatgaaactaatttgatattttatatgttgctaattttttctataaaattggtcaaatttgataaagtttgacaagaaaaaaagagtaaaacgactacaatataaaatggagggagtagttgacagcaccttgtgtatacatattttctcttcttaatataacaccagttgggctggctcgatttcaataataataattttcttatagataattctttaaatataaatatatgaaaaataagtatatgatttttcaaataaaaatcgcattagtaaaattaataataaaaatatttctattgattatgcgtgactagtgtacttccaatcttttttaggagtgttttagaagaagtaaattcagataaattatagtagttaagagtatttggaaaagctgatcgtggacatttactacataaactaattgatacgcatacccatacatggtaactaattaacagaattatcgtctgtgttaagtaattaccctgttggaaactgcaaggaagtcgatggcggatcgatcgagacatttcactagatcgatcattggttgctgccagcttgtttggtcttgactagatcgagcatgatcagcg

SEQ ID NO: 74896 - DNA, 8970 bp, Oryza sativa
ttgtaggtccagataacatactttgatgatacggccgatcgacactagctatatgtgttcattatgcactcgtgactaatcgattatgttagtaggtgagtttttcacatgagagttgcaggtacgtttaggcatgctcctagcttcagtgaaaaagtacacgtaccgctaattaatgaaagcttatgatgggctgccttttactgatgtttcttcggtgaaagaaattgaaaaatataacggaaaaagcaacagttggggatcatttggtttaactgttcatgacaaaaacaagacgagcagggaagattttctatctgagcagcagctagctagcgggaaaaaggcgacgggctcgcatgcatatgcggtcgtacgctcccaaaatataattctgtgattggtaattatttctccctgagcaggtcgccagcatgtcgcagttcattttctctattacacatgtggagacaaaacagtgcacaccatgaatgatatatggagtatatagcggtacatgcatgcgtatatatattcccaccctgatgttgttgattaaattcagtgaaaatgtactgtctaattaattactaccagcagtaattttattctcgagctgaacaattaattactctcccatccaaaaatatactactacctattttagcatctaaattttatccccaaaacatatcaacttcttcacttactccctcgttacaaccttcttttatttaacttttgatctttttatgaacacgcaaaagaattgcacgtcaatatatattaaaagaaagcagagtttcagttacacaacgcaacctgcaaccattgccgggggacaagggaaaattaaaaagaaagaaaaaaaggcaatcgcaactaattataaccattcttatttaactcttgtcttaatctagcttcatgaaaaattctagaaatatttatattttggaacgcgagagagtacgtgtagagctttacaagaattaaactcatgatttgccaatgatgtgtcccactatggatgatagagctagtagctagcaaggctgcattattattgtgcaccatgggtgagtcaaagcgaaagtcaacaggggaatatatatagtatatagtaatgttgatccccttgatagggccgggcatgcacaatagagcagagagaaagagagagagagagagagagagagagagagagagagagagataactagcatatatatgcggcggcagctagctgatcttgctgttatatgagttgtgacaacacaaaactgcatgcactaagctcggacacacttgggggtatatatcatgcatggtgtatctctgccgacatatgatatggaagcaaagtttgattcctgcgaccgatcgatcgatatggccaattggccatatgatatggaaaagtagtttgttatctctcgctcgatcgtcggtcggtcggtcgatcgatcgatcgatcgatcgagagtagtagtttctgtacatgtgccgccggcattgtgttcgcatgcatatgatagagagatcgataagcctaaggagagcatgcatgtagccgccgcttgcacacacggatctgtttgcatgagagcaacactagtggctctcgctagcgatgggttgtgttacacgcagcatagcatgcagctggggccatccacggatgcaagcatgcatgccaacatattgatcacaattagatctctgtagtagctgatctctccctcatcatcaaaggctctctcgctgctcgagccgcatgcatgcagctagcgacatttccaacctagatctatctcaggctcaccagcgagagctcgatcgattgagagagatctcaatatctcatcagccatgtgtgcactttggccagcagtttgatcgaaatcaagagagagagacagtcacacacagacatcacagaggattgattacgagtactgactgatcatcaccactgagatcagaacgcacacgggagcacacacgaatctgatcgatcggaacgccgcgctgcgcatcagctagcggcgccattcatgcgcggcaaaagcttgatcaaggcggatggcgacaccgggagcgcgacggacggacggacgcccaccaccaccaccgtgacctgctgctccggctgatcgatccccctctcgcttgctgcatatgctggcaatttgcaagctagctccagtgtttgcgtgtgtacgtacccctagctcgcgtgctgctagctgcaggccgtccaggccggtgaatgcgcatcgatcgcgtgcctgcacaccaatcagctcccgccgcgacccggccccacatgtttgacacagtcagacacacacacacagtgcgatatctgcgcatgcgaggagagaaaagattattacagtgtggagtagaagtgtagagacatactagctagccgacacttgtttggataccagccgatgcgtcgtacactgatcgatttacgcacacatttagtaagcgaggtcgctgtccggtggaggttggcgagaccaacaagcgcagctaaagctagtgacgacgacgacggcgacgactgcgaccgcgcggcctgtgtttgtgtgggtggtgatgtgacgaatcctcagtttcctttccaggaaaaagcgccccaccccaactctgcccttctagcttactcccccggcgcaacgcgcccctgcagcctcgctctccccgtccatggcttttctcacagcgcggcgcctctaccacagaacccattaaactccctccatttcataatgtaagattttctaacattactcatattcattagattcgttaacatttatatgaatgttagcgatacgctagaaagtcttatattatgaaacggaggaagtatgcgacgttctattagtgtcggttagacaaaaaccggctccccgaaccaccagctgaaacaaaactagtacgtgcgggacatattctcgtactagttttgtttattttgaaatgacggagagagtactgatctgcgccggaggcgccaagaaaattaacataataactaagcaactgttatattggatgtgtggtgaaaagagatagtatatgtgcatgcaattgcagtagtagtgcgtgtggtggtggtggtggtaggaagattctaggatatcttgtcacctcaagcgccacctttggttggttgggcgctaggtctagcccagctacgtcgtacctagctacacctcgcgctcgatcgatccatcgctgctgtagctaagctatcgatcgagcaaagcaagcatatgcagcagcttattatcaggggcatgttttttttcagcgggatgcgtgtatgtaacccatctcgagcacactgtacatgtggcgtctgtgcccctcttctccattgccatgacatgccctagctagctattactagtagagatcgcagctagtagtagtatagtatagtactagtagctactatgctgcttgcattgctgatcgatgctgtgtgatggtagtacaggggaaatttaatagcagtagttcaactgtggcgcatattgcttgtcagctgcatgtgtcaagcgcatgtagtccatcgatttggatgctgctgctgctgtggctctcggtgggctgtgggctgtggctaagctagctgacaaccaagcggggacaaaacgagctcatcgatcgatcgctacggatgaacacggcgggcgccctagctatagctagcagcagctggacgttttggctgcttcaaattcgcagagatcatatcacggccggtgctaacacacaaccatcgatctcactggtgctaacacccatcccactggtcttagcaatgatcgcaacgcttcaccgtacgtgtcagctgcaaaaaaaaacaaaaaaaacactatttgatcatatcatatcactggaatgtatatatcgataatacatcaagagggatatatatagctttatattgggctggctgcttggattcttggcatatcagaggaggcatgcatatatgatactccatatatatacggttcaggcgcaaacagggatgcttgctgttactgcaagttgctaggcacgcagcagccgattgctgtttgtttgcttacaacacgtagctaggttagaagagagaccctgtttaaccagactggttgatcgagcacaatattgtgtgcgtgcgtggtacccacacaaagttaatgccgaacaaccatcctgtttcaatccaaacgaaatagtgttttgcatcttttgaaatatgagcacggctcgtcgttgactccctctccaaaccttccaggtttgttgaccaaacatttctgcagtggcaataagaggaagaaatcaaattgaagcaatgattaatttgagtgggcagctatttaatcaccaaagaataatgggacaacattcatggtaagctagctataggacttcattaaactctctccacaagcttatcaattccattctgctattggatagaatgacagggaaaatagggggttccggcgagccaaatactgtaccttttaattcaagttgttccagtcgaattctggctagtatattgaccggaattgatataaattgttccaagcatgaattataaattcttaagccatgttgtattataaactcatttatctatatcatattttctctcattatagtaccattttaaatataattacatctgaaatttcgatgaaatagcatatttatattgttttattaatcccaaaatggtggatcattatcgcctagctggtatatatctgaacattgagtcaaaccaaaatatcctctgtgattgaatggcaagcctccactacacaagctactccctccggtcataactatttgatgcacggttgactttgtccaaaaagcttaatcatttatgttattaaaaaaactatgtaaatattatttattcttttgaattattttatgattaaaggcactttgaccgtggtatatactctcccgtctcattttaggtgtagttgtgggttttcgtgtacaacatgatcgttcgtcttatttgaaaattttatgaaaaaattaaaaaaatcacacataaagtactattcatattttatcatccaataataataaaaatactaatcacaaaagaatttttaataagacggacaatcaaacgttggacacagaaattcacaactgcacttaaaatgggacggagggagtatattttttcgtatgtgttctatttttttaataagataaataatcaaagtcatgactaatatactggctagctagacacgtattggcatgttatttgtctacgagtgcatagtttcagtaaatatatgaggttttaattgacagaagaatcaaaaggctaataaggttgggaaaatattaattgtgatcgcaatgctctctttgtaaagcagtactgtttgatttgaacaataaaactagtaatttaaaaaataattttcttgttgattttcaattcgtatacatagacagacatatatacatccatgcacttccctgtcaccatgttggttgtctccagtgccaggacaggtgcactgtcatacctttttaacgaaatactggtggtagtgcatgcatggacgcatcaatacggggtcgttcacatgcgtgttttctgttcaacattgcatgcataattctatgttcataatgtaagaggaagaaaaatatgaagacacattttcctaatagttcgttactctctatccatccacaaagataagcattttaagatatcaatgcaatctttgaccaataataatacctatgaggaaataaaatactttaaatgaaaagagttgtatataacgatggattgtttcacaacaaatttagtaacatatcattcttaagtcactaatctttataattgttttttttctattgacgatcaaagttaaaagagaaatgcttgacttgttaacactattataaacgtgctcatattatatatttgtgaacataggaagtaaaacacacaattaaacggatattaaatccagccatttaaagccgaattgatgggaaatcataagaaaaatgatgatggatgagtggggaatcaattttttgcaatcaattggagaaggaaatgcatggagagacagatcgacgtggcgacggaggtaggattagcctgggaagaaaaaaaacagtgacgaaaagaaaaccgaaaaatcggaagcctgcaagaaaaaaactgcaaaaaaaaaacagcggtggaaaaaagtatgtaaaaaaccatgacggaagaaaacagcgacaaaaaaataataaaatcgcgatggaagaaaatgacgacgaaaaaaaatcagacggagcttggagcataaaaaaccaaaagccttacaatttttttattaggtatatagattaaaaccgtttgaaacatggacgacgtgccaaaattctggcagaaacatcttcaatttttataataatagagatatactcacaaggaacaatattaagtggttttcgattacctaggttatattaaatctgattagaaagaatgacccattagttcctatatatatgcgatgtttttttaacataatattcactttttccttttggacaggagggcgcagcccctttatgtgctctcatgcatgcaatcactgtgtatagcatgccatgttaaggtggtatgcatgatgcatgatagttaatgatcgaagtgggatatgatatggtagcagtgtatctctacaaaacaaacaaattgagacataaaagagaacttgtgagaagtaaaggtgtattgtgtttgaaaccacactagcttgtataaacaataggttggaattatgtttttagacatcaatacgttgctacttttccactaattaatttagaaaagaaatatggccactgtctattgacttgcttataattatgaatgtaagatcattttttgttggatatatgtacatatgctttcttgtgctctccacgcggtgtggcgcaaattaattttgttcaccacaaagtatagcaaattttgtaagagtttgcgattaattaggttgtgcgggggacaggataaataagctagaaaagtatagcttgccacaagtattgtcgcaatatataaaataaacatgttggtaatataatatatagtcaaacttccctagctacaacaaatgtggcaagttcatatccaaccaaatgccccttaattaaatcgttgaaaacagtttccttttttattcttgagttgaactgtcaaatgtaagagaggtctccccttatacaaatttaacattttcttttgttttaatgtcattcatgttggcatacactgtagcaaattaaatatgttgttttgaggtttttccatgtggtcatgttcatcaataggaccttatttgtatgcttctatttgatgcttgtcgagccagagtagtgaacatggaaaatacgcattaaatatataggtgtgttattttccaacaaggaatatatggtggatgaatgcgcatgcttcccaagctcttaaacgatatgatttgcttttctttaaaaaaaattatacgaatttcttatataactattttaatttcatttttaactttataatattttattaacttgtcaatagaataattatcacaaatcacttcactatttcaaccatttaagctatgccatgccgccattcagatattcagtctcatacaaagacgccattgtgatgatataccacacctattaaggtcggatcaagctataatggtttaatttgctccaatatctcacatatttctccgagatgcattcaagaaggaagtttagattggcatcgtcattgaatcacaagctaagacactacgaaaagaaccaaaaattaatattacttccgtcccaaaatataacaaaacttataactatgaatctagataaacatttatccatatttatagttagaaatgcttatattctgggacggaggtaactaatactcgaatgaagccaccacacaggatgaccaccgcaaaatatatattcccattccccaacggccacctaataatcgtaccaccttgaagccacacgattgggcatttatatttctaagatgtacatcccatgcctagtatgtcctcctatcaaaataaattcattttttgactcattccttgcataccaatacaaaacaaaaaactaaaatatacatattttatcaaataacagttcaattatttctttctttatatactcccaatatatttatcctctaccttcacaaattttgataaaataattacgtaaataaatttattttagaataaacagggggctaaaactaaacttattatgaattactaccataataaaaaaaacaagatttggagggagatacatcacatcaaatattttttaagaagaaactataagcatgttagagattgaacacttattgtatatactccagtaaccctatagtaacgatcgggtacttacaatcatatccttgactttgacactttacttgcctcggagacacgcacacatgcatgtaggtgcgcgcacacgcgcaatgatggtgcaatgagacacgtcggtacgaacgacccgcgctggcctaatcggccaaagaaaaagccaaattttaaattttcaaacttaattttgagattgattttaagatattttcaacgttgtttctttttcaacattgcttttaagttaccaagaacacatttataaaagttttacttacaaatttatttttattttctaataagctgttttggcttattaggccaaacgatggagaccgaagtataaagtatagccgtagtaacagcaattgcactttattagttgtacatgtcgatccgttagagacatgcgcccacacaacaagcacgtatatatgtacacatactgatcgatcgatcggcctcc

SEQ ID NO: 74897 - DNA, 4911 bp, Oryza sativa
caccaccacccacagccaccgggctagctagcttccggccgcgggcgcggacgtacgggcggcgggcgcgcggcgtggggagtcgggccggtttgaccaccggggagacgtacgcctcgtgcctgatgggcctctcgtcgctcgctcgatcgatcgcagttgatcgggagctacggttgatttgcttggtgctcgatcggagatcgagaggcaggcgggcattattgtgcttgatcattgggtgcatgccctagataactactgtatccgtcctaaaagaaaactcaatctaataatagaatatggtacatcctaatacgataaatctaaatatactaaattgtttatattctaatattagattgtttcgtcccagggagtatagtgaagctgaaagttgttgtaccggctgactagtactgtacttgttcagagcgccaacgctgcaggacgtacggttttgattaagggattaattagctatatactacgtaactttcgacaggtgattaattaatctacacgcttgatgggatttgaggaaccaaataatactactactactactaatcatgcataaaatatggatatctcgtataaataaaaaagagaagttaaatatttgtatacacgcacgtacgcatgcattcaagtgatcaggaccttgatcacgggacacagccagccggggtccctaccaacaacactccccctaatcgatggttatcgcagtagtgggcacgccacacatgactaggtttcgcgctatttccacgacatgccatcgctgcccgactgccggccagccggccggccggcatgcagctgggtctgttctggctggtcctagcggccggccggccaaactcgcgacctcccctcctcgctgatccgatccgatctctttctttaatcagcgcaaagcctgcgtctgcaacgtactacgtgtcgctcgagatcgagctggatcgatcgcgatcgatgcgcacgcgtacagggcgcttacgcgacgaatcacacgccctgcgccgcctgacgagagctagctgagctatcatgtcgatcgtccggccgcggtcggctctccgctccgcgccgcgccgcggcgtgcagtgagtgccgcgacgacgggcgcctgggccgtgcgcatgcatgcgcaacacgagcaagcgaacgtactcccccgcacggtcgtcggtgatcgagctagctacgcgcgggccattgatgatgaggttgatcacaatctggttggccggccggcgtcacatctctcctgaggtttcgcttgctgcctgcctgtgctgcgggtccatcatgaactcaatttgatcatcagagattcacttgcacagtagttagtggaaccccacctcgctgcacgaaaatgaaaataagttacgtaaataccccttgcattatatattctaccgaaagaacagtttttattgattccgatttcatgcatgtgcatgggttggttgcaatggagtggtttcattatctaaaatgaataacatttccaaccaaaagataagtcgaatcaattttgctatatatttgtcgacaaattttctcccaaaaatttaacagatgtaatatgcagtacaatcgtagtgtaattacacagtaactgtatgtaattacactttaactataatgtaacttatatgtaactttcaaaaatctctccgtaacatgttatttcggtaaaatagaggtcgtgggaacaaatcctttcacatatgtgtgtgctgtgattttttttctttctcaccagaacaaatattgtaatggatctaacgattcaaaattacgtgaaacttgcatacaagttacactatagttacatgcaagttacagtataattacactacgattgtactataattacataatttttagaagaaattttgtcgacaaatgcataggtggtcccaagtcggataatgccatccactagtaaatagcacgacgcttcttcgtgaagctcattatttgaatatattgaacatcataccattgcgaaagatactccctcgtttcagggtataagatgttttaactttggtcaaagtcaaactgtttcaagtttgactaagtttatagacaaatatagtaatacttataatactaagttagtttcatcaaatcaataattgaatatattttcctaataaatttttcttgggttgaaaatgttactacttttttttctgcaaacttggtcaaacttaaaatagttttgacattgactaaagtcaaaatgtcttatagcctgaaatggagagagtaacaacaatgtttgaacgagctccttaggataagggctccttcaagcaagaaaaggaattgtgaatgcgtctaattaagaagggtaagcaattaattccgagttagagctagggacagatttaaggtgtgttcgctaatggggtttaggaacccatctcctccgcacggaaaatggaacagtccattagcgcgtgattaattaagtattagctaattttttttcttcaaaaatggatttatttgattttttaagcaactttcgtatagaaactttttacaaaaaacacattgtttagcggtttgaaaagtgtgcgcgcggaaaacgaggaagggaggttgggaacctagggcaaagaacacagccttagagtataccgaatcactggtggagaaactgtctttactctcggtttgtaacaccctgtagtcctggttttctaaccggccgagtgaaataaccggtagttaagttgtatctttagtcccggttggtgttatcaaacgggactaaagagagggatctttagttccgattggtaacaccaactgggactaaagagagggtaggggcagtcccggtaggtccattttctttttattttctcccaaatcgagtgccatgtatatatccaaatcaaacaccaaatctccaaatcgagtgccctgcatatacccaaatcaaaccccaaattctcaaatcaaaacaacatcccaaatcattcacatcacaaatccaaagttacttacacacaaatcaaatactcccccgtcccaaaaaaaagacaaaccctaggtttccgtgtccaacgtttaaccgtccgccttatttgaaaaaattatgaaaaaaaaataaaaagataagtcacgcataaagtattaatcatgttttatcatctaacaacaatgaaaatactaattataaaaaaattcatataagacagacagtcaaacgttggacatggaaacccagggtttgtcttttttttgggacggagggagtacatcacaaatcttaaaaaaatacacacaaatcaaatacatcacagatcgattatacatctcagatcgatgcaatgaatcacaaactgtacaaaaagaaattatacatctctcaatcacaaattatcaaaaaaaaagccggagagaaccggcgcgctgccgctcgccatggctgctgcttgccacggccggcgcctgccgccccgtgcacggcccccgctgcccaccgccgcgcgcgctgcctcgtcgcctgttggccgccgccgccggccgcctgcccgctgccggatgtgaggaggagaggggaggggagaaggaggaaggagattcgaggggttgaaggatatctgattttatctaaatatctcggtgaggaggaagtctcatctgggacttaaccgatcatatatgggagagaaatatttactcacggttggagactccaaccgggactaaagatagatgtttagtcccggttggtaattaaactttagtcccggttggtagtatcaaccgaaactaaagatcctcgtctcctggcatgcctctgacaggccatgaaccgggactaaaaatgatctttagtcccgattggtaacaccaaccgggactaaagatcaaaattttttatgaccgattgtttttagtcccggttcttattagaatcgagactattgtagaaaacagctgacccagcaaatatcacttttccagcagtgaatgagggcttggtctctagcaattttacaccgatcgatctagtgggggcaaatgcgtccttatccatttttaatttctcattctatgacactcgcccccacgtactcactcattttaattcctgcggatgcccttgctctgagttcaatccaacacggaattaccgtacctctcctactttaaattgctagggcaataaaaatctattaggtgtgtgatatgtatgatggttatccaactctataccttacggctaggttgattatattgccgtgggagctgcccgtgcatggtgggaattctgttgtaggcataattattttggagtatcatttagagtcgacaagggtcatatacggtgtttggtaataatcacaaactaaaggttaggaaaactcttttgataggaggttgggactcgtgtcattcatacatatatctctctctatatatatatatatctataattactctctctattctaaattaagttaatataatacgtgatgtgacgaatcattgtaacacgaatctaacgagacgtacatgtcctgattcatcgacaaatggatataaagctagataaactctttgaatcgaaacaagaaggcatggtgacgagtcaattgatccaccccacatgtttttgtgacccagtagttctattgtatagatatttacgccaaatatgtaatctatatatgcaagattagctggtgcgcacagggatttaattagttctatctctacaaacggtgcattaaacagtcacttgcaaaatagaatatatgcatctagaatttcctaatattcaagaaatgttacaatcattttaaggggcaatgcaattttactttggatcacttcatttgattgcggacttgcagtgccaagtgg

SEQ ID NO: 74898 - DNA, 5586 bp, Oryza sativa
ctgcaccccaaaatatttattgaaaagtgatatatgtatacttttatgaaaatatttttcaagacaaatctattcatataatttttacatttttaaactcaacaactcgagagttattcataatttatatttccaatgtttgacttaaacattgtcataaataattttttttacgagtacgaagggagtaagtgattatattttgaggcggagagtataactttagcatatatatatacacatatatccagctggggaaaaaatgaagtatatatatatgatgggacagatgaagacgaagatcgtgatccttaatttaatttcgtcctcgcaaaaacaaataaatgaaggaaggacttaatcagatcccatatgagacttcgacgatggcaaataaattactggtttccctcagatttggcaagtctaaaatgggattaataacaagatggagatctcagtggagatgcggacgcacggaaagagtcacaagtaggacatgactgtggggaaagtttcatactcctatatatctggtccctgctgggacaacctgatcaggtgatgttatcttttttgttattggatttgacagcattaatacgtgtaccagaaagatgcagttgtactacttgaagggagcactaggatcttatctcacccccaaaaaaatagggggcaaaaaacggagccacctgtgaatgatgggattagagacatactacgtacgtatgacccggccagccctgctccctccgttccttaaaaaaaataaatcctggtttccgtgcctaacgtttgaccgtctatcttatttaaaaaaattataaaaaaattaaaaagacaagtcacgcataaagtattaatcatgttttatcatctaacaacaatgaaaatacaaattataaaaaaattcatataagacggacagtcaaaattggacacagaaacccagagtttgccttttttttttggacagagagagtatgatttttagtttgaaccaactgcattttttcgttctacacatgtttttttcttgtctttgttgcagccctagaaattttgtttcccctaattaactattatacatcctcaaagatagagtacttgttgtatatatgtcctcccgaatgtatacgaatataattaagttgcatatatatgtggctattgtatgtaggcatgtcattaattcccgtagtctttttttaaaaaacaaaatggatatgctaattgccacttgctcgcatgggatgtcgaccaaaagcttaccattattccgcagatatataggttctctgtccccaaactttacacctggaactgtagtgatgccgtttgtggggttaaaatgtatttactactttagtaattgatcagtccttcagttccagtgaaattaatgtctttcaacaccgcacgcccagtgtattttacatacagctaataaaatctgttatgtaaaaccaacatttcatttatttacaactgcctccatcgtcctgcatgttttattgtttctttaatcaaagtagagaacatgaactgcattgtttctttaataaaataacttttcatagtttatgggcttgttctgtttgttcccaaaatttggcattaatatcccccaaaaaattggcacactttggcattaccatttttttttggcaatgttggatgtgcttggtttgccacctttctagaatttggttatgagatgttggttgaaaagaaatgctctcatttttgacaatgtccaaccatctttcaatacttggaaagctgatttcaaggaggatttcgctcttcttatgcatagagtgaaggaggaggataaacctagatatcaatcatggattgacaacattttttaaaattttcctcttttgtatatatatattttgtaattttcctgtaactcctgttcatatattaatatatttaccacacagtaggagcctctcctactgtttaaggtaaaaaaaagaaggaacttctgaaaatactaaattttggtagagtgataatggcaaaaaatgtttgatttgttaacttatcaaattttggtaaaacaaaaaatcgtagggtcgaaagtggtagcaaactggacaagccctgtgactatatatatatatatatatatatatatatatatatatatatatatatatatatatatatatatatatatatatatatgatcataccagagacaaacttaagaacttaggactcttttaatattaattacatatagatcaaagatgcacacgctcctaacaatgttcttgttggactccaataagattaggaacaaaattagcttatatgcgcataaaaatgatagggaaatttcgtacattaattatggtgttttgttggatctttatgcccataaaatagctatttttttgtttactagtaaaatatattggacacaataagtacatatttgaacccctgtgttatataacatgtttaaaatttgcaaatagtattcctgaacattgaaagaactgtggcatgcaggaaatatataatactaatatacgtgtgtgtacgcgcacgtgcgaggggggtcagtcatataatattccctcccatatacatatatatgcatgtgagcccgattgagattacaaagataataaactaaagcctatcaccgataggtcttatcggtgacgggcttaaaatacatgcacgggtacggtatatcttttttacgagtatatttttgtcggtgtttattttaacctgttagagatgacgacactgtgacggtctgtaagccccatgcacgggaaaggccgttacagataagtagttctgtactagagtgtgatttttttaaaagaagaatttcttcacttgctctcattacatgcactaacacgaggaccccatgccctgtatgtcagtgagcaagtaattaagagatttaactaaagctggtatatataatttacgaggaaaaaccaaaggatcacagaaaatcacagaaaataactaaagctggtatatataatttacgtggtagtactgattgatcgatcagttctctgctggccgatcaaacgagttgatgagcagatgtgtgcgcgcgcatcgagcaaagctagcggcatcatcgatcgatcaggaccacaataattattcgatctctgcaaatacgaactaaggacagtccaatcctcgtagggtcgcacaggggcagtgcttgtcccagattagcattggcacctgatcaatgtgtatgtccatgtcagttagacgcttacatctcccagaaatttccctctcttttcattgcgagatctatgagtgccctcttctttttttatcaggcccactgatcacattcacactagctcggccagccagcagctgcttccacatggaaaactaaggcatcagcagggttaattctggagttatgcatttgctagattggcttagcatgcaaccgttcaactgagaaatcatcaggtgcgtgcgtatatgtgtgcgtgggacaaagccaacggcaaagcgtcacatctcacgacaatctgggcgcagaagggcaccacgtactgctcgaattttggaaccacacgtacattttatcgactgacgaacaacgtcgaccgaatagccaggaatcatgtgatcgatgagtttggggtcatgagagccccatgtacattggatgttctgaataagctcatcattatgctggagctaatgtacgtacggagtatcaaacaaaattgctgaatggagatgagatgtgatcgagtgctggcacaaaacgagtatgtgtcgtcgatttccttttccttgcacggatcggagcagaaatcaagctagctagcatcctgacagttctctgacttctctcctataaataaactagtcaaactaaatagacccaatagatgtttgccgttggagtttggagataatttctccattcactactagaaaaatgatccttgctgggtcgggtgatttccacaatagtcccggttttaataagaatcgggactaaagattgttgctagtcccggttgatactaccaaccgggactataaagatcataattagtcacagttcatcccctatcagaggcctgttagggggccaagcatctttagtcccgttgatactaccaaccgggactaaagatgaccagtaccggttggtaataagtaaataccatttaccaatcaatcttcacgggagtaaatatttctctcccatctctgatcggttaagtcctagacgaaactttcctcctcactgagatatttagataagattggatcgatcacatcccctctcctcctaacccctcagatcccctttcttctcctcccccctcctcccctctcctccccctcctcccctcccgtccagcagtcggcggtggccagcggggccacgcccggcgggggcgcgcacgggtgtggcgagcgacggcaggcggggccgcgcacgggcgtggcgagcggcagtaggcggggccgcgcgcggtgacagtagcagtggcaggtggcagcgtccgttcttttttttatatataatttgtgatttcctgagatgtataatttgtttttttagaacttatgattcattgcatggatctgagatgtatttgatttgtgtataatttttttaggatttgtgatgtatttgatttgtgtgtataagtaacttaggatttgtaatgtgaatgatttgggatgatactttgatttggggatttagggtttgatttgaggatatgcatggcacttgatttaggagaaaatacagggattaacatattataagactttctagcattgcctatatttatattgttgttaatgaatttagacacatatatatatatatgtatagattcattaacatatatatgaatgtgggcaatgctagaaagtcttataatatgaaacggagggagtagcaaagaaacaatgaaaaaaaaaagaaaagaggagattcaactttactccggttatttcacccgggattaaagatgggaatctttactcctagttcccaaccgggagtaaaaacggttaccccagtagtgatttgtccttaacccttgccacatacaaagaagaagaagaagaagaagaagaagaaaattcatgtgtatccctgagattgcatgtgtttgtgatatatatacatgcaagtattcttaaactgagctgaataaaactttttttttgcgtggtgaataaaactaatttgatccatcagttgacctgtgtgtgtctatatcctcatctcccaacttccccagccctaattgagcacatgcaagctactagcacacactatccacgtactccagtacagaagtactacgctctaattaaatactactattagttaaactccctgatgaggccagttagcacggagagcagtgctagctagcccagagagagttaagaaggcccatctttggagggggttggcatcctacactctagctagcccacagtccgctgccggctgccggccagcgcgcgcgtgcaagtctgcaagcaaagagttttcagatgcagatcgaagcaccg

SEQ ID NO: 74899 - DNA, 14184 bp, Oryza sativa
ctcgctcgtggtgcaataatgcaaaccgcgcgcgcgcgcgcgcccgcgcccgtccacgcgcacgtccctacctaccggctcacgcagcgcaccgggacgcgcgtgttttgacggcttgacgcgctcgcgcgcagtcgcacacgtacatccggcttgtgtgtggttttgcctgattggctccgtcgccgccggttgtcccgcttgcggcgcggagaggagacacggggtcgttcatccgtttaattatttgttggtttcctccagcgcagaagctggagagtgaccgatcaccgttccgccctctccaggaccgttctcgccacgttctagtactacctaccgcgtgcagaagattgctgtaccagtttttttttttctttttggagccacatccgtcacaccgtcctctctcatcaatggcgacatgtctgtcggatcaagacgttggcctgcagcagagtagaccatacatatgtgtcgaccattcgcccggggtggcactgtcactagtcttcgccaagatttgtactttgtaattgaggaggaacatatagaacgctagctatatagttaggtccaacgaaatactttatatggactgacatcgatacaatacctaggtaccatacggatgttaacataaacctcacgtttcaattaattgcatactgtacatgttgcagtatttctatttgcaatcggctaaaaaacagtcaaagggttgctaatgaaattagagggagactacaaaaaggatcccgttagaacgggatattttaaatgactccttccctttctttctgttagcttccacatgtgtttctcctagcacctggtaccttggataccagctagtacctagtacctggtaaatttggtaccgaccgatacttggtacctggaaccttggtactggctggtacctaggtatcacaaactttggtacctaggtacctggtaccttggtatcggctggtacctaggtatcacagactttggtatctaggtatcaagcatgatacttgtgggtaacaggcttgatactgaggtatcgcgattaatacctgataaagatggccgtggcacggacacagaagatggtgaggtttggccataagtcggcggcgaccatctacaggaacatgcgcggcagcaacttcatcttgaagttgatggcgaaagagaggaggtagagattctagagtaggttatcgtcggcgttgcggcgacagaggcaccgggaccgccgacttcttcttcttcttctgcggcggaggaggagccacctgtgctcactagcaaggaggcggcgggagcagcgggcaaggacgatggtgctggtggctcgcgaggcaacggagaccttggcgaggagtgtgagggaggaggggagaggcctcgacgcctacagtgacggggagcgccagtggaagaagcggcgccgcagcaggcggaggacggcgtcgaggaggcacggcgagatcaccctcgacactgccccgacctcgccgacgccgggccgttgtcgtccacctcggccgccggagacgacgacggcgaccccttcctcctagctggcttcatttccgcgctcttggagagagagagagagagtttgtggaggggaagggaaggagataaggtagaggagaccttatcccgttgtgacgggatactattgtgtagattctctttttattaaacaagtggtcaattacccgtgcattgctacagaacaatatatatcaagaaaaatgtatgatttattttgctataatatttgaaacatttttaaacaaaatattagttgtgcataggttaagaatggtttctcagtaggactgtatactgctcatacgaccaaaacagcaccccggatctgtcaaaatttacgatttgtcacatctaaaatatacaaataataaaaaaacaaatgggccggcatactgtgaatattattacggcccaaatgaaaaacccaaattgaagcccactcataaaacaacttaaacatattaaaacaataataggcccatcatacaaagaattttgagcccaataaaaattgtccagattaaaaattcaaaaaatatttggatcaaggccaattcatccaagcccatatggaggccaattatataagaaaaagaaagatagtagcattttcttaacatgtgtgttgagttgttgatcgactaaacatgtgacgaaatacaatttaatattagaggtggtgaaggaggtacaccaaggatcatgcagggcacatcaagctgcacgggcggtagcatactagcaaccaagatatttcgccaatggctatactggccaatcctgctacatagctccgaagagcatatcacgcaattcgtaggtgccaaaaacatggtatatctcactccgtcccatagtacaacctttagctgatcttgccggtctggccgttcgcacactgggagctactccggatgtggattttcatccctcgaggggacatctcctcgttgtttgcatgtcatctaaatagttatcaaaaaattttaaaaaaattggcaacatagattaatacgaaatatatcactccacaaacatgcgagaccatattcaacttctataagttgcaacaaaaataacaaactaaactgaaaatagttatcgcacattcgcaactatatttgttatttttgttacaacttgtagaagttgaatttaaacttgcatgtttgtggagtgatatatttcatattaatctatgttgccaatttttttcatattttttgatgactatttaggtgacatgcacgaaacgaggggatatcccctcgagggatgatttcactttcccgagctactccctatgtttcacgatgtaagactttctagcattacttatatactatacatatagatgttaatgaatctaaatatatatatttatctagattcattaatatctatataaatgtggggaatactagaaagttttacattataaaacggaagaagtagatataattggtcctttcccaacgacaaagaatagctacaagttgcaatcaagtacttttgaaggtggattgaagcagaattcttggccaccatcacttcagccaccgtataatgatttgtgtggaagaaaaacattatatgtcgctttgcattggcgtattgaaataattcaccgcgaagggtctggctcataaactggaaacaggaaggcttaatataaaatagttattgccaacttaatatattgacattggatttatccttgttcagttgccagcttggttttctactatagtatatacgattaagagccttacctggtgaaggtaggtgggcctggctcaccacaaaacctttattctttctcatgacgtaaactagtggagtcctatcgatatcgatcttatgttgctatatacttagcatttgtgtctacgtaaaccaacataaaagaatgtaacaaataattaatgattgcttaccttggggaagatctttttagctcagatcttcttcgtatggtcacctgaaccactatttacatgtgcgatgcaataccagcttaagcataacgaaattctcagtaaactacgttgtaggattctatgtggcccgtatctaaattggttttcttaaaacacgatctactgtagtgccgtgatatagaataaaccatattgcctccgtttcataatgtaagtcattttagctttttttatatttatatattgatgttgataaatctagacatatatatgaatctaaattcattaatattaatatgaatattagaaaagctagaatgacttacatgtgaaatagcttacattgtgaaatagaggaagtatatagtaagcatgtaattcaattttccttcgcctcttttctttctgatgactggttgtctttccatgacgcaagccaccccacggagagctagtttgcacctaatttatctgtctataaattgtaatgtaaacaatgtcatatcaggcataaaccttctgcaccactaagcataaacgatgtcctggcttgctttaaatgtcttatccagcgaacactaacacacaaacgttgctccgaaagtctatcttatccgataacgattagcataaactaaccttaggccggtgtctaaatgactttaacatctcatgtgatttcttaagtgccgtcagcatataggcaataccaagtgattttagatggtttggacgtttggtagttttcaattttcatccagatacctctcttgacaattccatccacttgtctattcctgtcctgtgtggaaatgatcatgtctcgattctagataggcaaaatcaatagatatgcagttacagaagttaataggacgaaatggtaggtcctatataaggataacgttcaaaattatatataagcccctgcgtaccatgtcaaattatcaattgagactttgaaaaggaaagcacaggtctcaacatggcagatatggagtgaaggatcatcgtggcctcttcctttatttctgtgcatttttatgcttcgcttttcatatactcggacaggacattgctacggaagaatagaagatggtccctttagttttacactccatttttttctggtttgttggatgccactgctaacattaaactatgcaaacagaacgttcaccaaagaaattaaaaagaaaaccacactaacctccgcagatcgactctagctaatccatttttactagtatgatgttcaaaggccaatggtaaatatatggtgaaaatcccaatttaagtagaaactagtgtaaacccatcaataaaaaatggaaaccagatatttcaaactgtaattggaattccacctctaatattaaaaaaatgatagatcccttaatattcttgaaaaaccatggataactagtagcttgaaaattgtttacttgcccgttcgatagtaaacaattttttgctcaacttacagccttattatatcaaaatatatttcatctttctgtcaaaataatatatatttcatctgagatgttggtggcctgattgaacttatttctacaatttccacttgattttgattctaaaaaacgttaacttttctttttagaccaatactatactacgggttggtttggtttgtggcctaaatagaccttaccaaattttgtcaatgccaaatttaggcaagttttggcatgactaattttggtaatgcaaagttatgtttggattgaagccaaaatagcctaagttctctattgaaatggcctatttttttaggcatgctaaaatttggcttcaaaccaaatagacactaaacactattgaaattgctaaatattggtaagcctaatttaggcatcaaaccaaatcagccctacaaaatcatttaataacatacgcggattgacgtggatcacaaacacatagtgcaagacacctacatctctgagtttgcgtctttatcacaaacgtagttttttctccacatctgtggtatatacttttatagactggggagacctgtgtcactatatttgattgtagtcacatctatgacttgacttttccgagcaactcaaaaaaatgtcgtattttactagatatactaggtactccaagtattcatacacatgcgcaggtcacatgatctttctcgaacctcccagataggtggcttttcctatgactcaattttgaaatcaaaaataaatttgaacaccttgactcctttagcctcgcttttgtttgtaggagtcgtcatgcattcatactatagcaataacatagagactaaaacttgcactttgtcctcaataaacatgttaatcccttaattagtcgcattgttaacccaccaggggctagatgcacttctagcgagtagattgcattgagatctacaattttgatatataacatgtctctgtctaatataatttaaaatttttgtttttaaaaatagatttgagaacttgtaaggatactgagacaaaagtctataatgaaaagtacttagagacacaggtataacctgtgtccgtcatagatatcaggcacactttttatggaaccaagtttgtgatgataaacctcattcattgacacgttttctttatccacatctatgatttcttagcccatgtgttttatttcgacatgtatctgatagcttcacagacctacatctctatggtcatttcagagacacagcgtcaccaatttcgtattttgtggtagtggatgttaattgtcatgaaaataccataacaagttaacaacaaaatcctcagctgaaacccccacatagcatgaatgataacatccctctgctagaatgatggatatatcaatggggtcgtgacatcaaacaagagaaacagggaaggcattaaacactcttcatcctaattacatgggataattgaaaagatgatttgttaaaataaagtgtatccaacacattgcataacagaccgttgaaatataggcaactctaaccctagtttgttgcctccactactttcctctgtccttgccaccgccaaaggggtgccctagaatctggctgccctcgaggaaggtggtggcggggtctcttccttttctggcgtgtgccctcttccggtggtatcgtcacgaagttatcttctttttaatcaaggccttcactctaacctacaaactagagtcatcttggtttcgattttcgatgtcgtttacgtcgatagcttagtgactcttcatatggaccgtacggattgtggaaatgtgtatattgccttcttcgttttataatcatttgagtagcatatctaaagatgcttgtagctattgtgtttctgatcgatcgaaattgtcctaagggttggagggggtggaggttatggctcgcagcgacgaggcaacaatattggggactttgattacataggtggcgctctttgggtaccgatttcttgagtctaaggttaaatctctaggtctgaccttcaaaatgatcgcttccttgttcaaggtaatgtctggagtcagtttttgtctccagcggtttagtattatttactaattgatcaatgggatcagcagcgcatatgcatcattccctttttgaaggcattgttttaggagagcatttttcatagtctaagttttgctttggtggtatttgagaatgagtatcaattgtggttgtattttgctctacggcatgacattctttccatgtcttccttttttttctttttaataattataggttatgtgcatcttaattatatagaggttatgagtgatttttagaatagttgtatcatcttgatgtaattgtttaatatcaatatagtttcttttattaaaaatattaaaagtatggctacataaaagagcttttcacgatgaatctagctatcaatataattttaatatttccaatgaacgatgctagtatatggtgaaaataatgttgtgaaaatataattgtctactatttggatggagtaccggttggcaagatatcaaactcgtatcgtaccaaatcgatttttttctgaaagcctcctgaactggtatgatgtcatgatgcagtgcatgtaaatattgatgttcaaggcatggcactttcttgctgatccaccaaggaagtgtcacctgtcaagcaggatatatagcttcttatgcactcaaagctgaattatcttggccatcggccttccaagctaaatgagcaatggatgtacagccactcattatgctacaactgactactgaggtaaacatccattgccatgcattatgctaaacgcactcgatcgctagaacaaaaaattggcagcacagccacatatcatcgagaaagtccctcttgggacgtatagtttactcactaattccccttttgactggatagtgttctcttcattcgtaattgattatcgtattatcaaaaaaaaatctgatttgatcatgacaacaacattgggagctagcgaaaatgtcctttttataacatgcatgtatgcatgactttaatgcggagattagttaaatcaccgatcgtctttaaccatatccaatgcgtgcatgaatttaatgcggagattagttagttaaatcaccgcttgtctttgctgaattaaagtaaaactatatttatttagggatggagggagtagttttcggtaataatccaatgtggtggttactccaattactcactccgtattcgtaaagaaagttgtttaggataatgttcaagtcaaaccttagaaatataaatcatgaataactctcaagctgttgagtttgaaaatataaaaattatatgaatagactttttttttgcaaaatactttcataaaaatatatcacttttaaataaatatttttataaaaacaagaagtcaaagttgtgttttggagaccgtgtcgctgtccaaaacgattttctttataagtacggagggagtatattagaaagatactacacggatagcaaagtgaaagtaggataaggctattcccaactcaatgactaggatgatgtccatattattaaataagctaccatctaagatgaaaaatgatgtggaagtgaatacgtgaggaaagagaaggaaaccatgacttgcatgagacatggtttctacacaacatataagacattatgtgagataagtagcattaaatttaagtatgtaatagtggtgtttgtattggaagagtagtgtctagtactagttttttgatgatgtagagtttatggaaactatgtctagttccttgggttgagaatggcctaattaactagttaggttttttttatggtataacctgttcactcaagttcaaacctcttcgacttaatatgggtagtcgtatttacggctaattattttttcaacggtagacaatatagccatctgtaatgaggtatatatggtgattttaccaatccctaaaagtactgaactaatctgttggaagtgtttataggagtatggtgaaatacgccctcagttttcaattgaataactattgccagaactactttaatggatcactcgtcttttataaaatgtacaaatatttctaattataaataacaatgatatcatattataaaaatgtattactaaggttttgcaagaccaaacaacgaatttattgcatccaaattaactcgatgatataaagtgaacgtagctcatatcagctagttaagtttcatacggtgaaactagctcatcaagtttttgtaaaatcaaaagtgtttttgattattattatgtgataaacaattggcatctgagattattggttttgaaatttggattattgtcgaagtggttttggagataattggatttacaggtgttaacaggtactgctgctgttttgatctggtcagactgggcaggtgctgccggtcggaccggcgtgtattgcgcggtcagactggctagcccgcggtctgatcggctaacattgtgtcggtttcggtttcagttgtttgtttggatatccgtgtttgtttcatgtttatggattctagacggatactatgcatatgtaatactgttgtttgctaacaatgagtcaagttggagatagcttggttttggaatatggtttctttgtttgattcatgtgtaggtgacttgatgcctcgggagagtatatccggtgatggatcggaagtcgacttggggataaggcgatgtctgtgacgatcatatatcatacgggatacttaggctaaagttcaatgcacgtgattggtgaagattccatatggcatacgacggaggtattgtgtgcgtatgggatgtggagtcgaatttggaaggagtccaaatttggtatggttagagtttgtaaagtttgtttcttgtgcgggaaggttttctaggtggattaggacttctagaatgagtttggttcgtggctttaggctgcctacctcatgtataaatagagagggagcgtgaggcttcccggtatcgcttttgagagcattgagttgatagtttagttagggtttcgagtttagtcgagatttttgtaaggagtactgttgttgcactttgtaaacatagagaggagcaataaagttgtcatctactttgagagttcttcgatttgtgttttctcgggttcggcgctctaaccggtgaaacaccgtcggtctaaccggctgcattgcggcggtcagactggcggcattgcggcggttagaccggcgtcggcgtcaggaggctgaggcgacttcggagcagtcagatcgggcaatctacatcggtcagaccggcggcacaggcgcggtcagaccgacgggactactctagtcagactgatctatatcgattcgagggtaacttttaattccgctaaaaaattatgttttttggtataccaaccattcacccccctctggttgtcttagttcttgtgtttcgatcctacagttttaaatcctgtaattattacagatgctcatatttacggctaattattatttagtggtaagtaacgtcaccgctaacagtgagatactcatgcttatagagataaagcttacatgtatatatgtttatacaaatgagtataagtatgttacgagcgtctatgtatgtttaagggttgtttctaacgagaaaagaaagtgactcaaaagatgagctggttgtacgtactaaggtctatgactgggcacgacattaattgcgtccaagatgatcctcatgtgggtgtgtcacacatttaattttttttagatatgttgttcattggttattgttagctaattattaattttgaatctcataattaaattagttagatagtatattctttcaagaatataaaccactaagaaaataaatatttagcaaaatgagtgtaactcaactggttatgtttcttacggtgaaactagtaaacacctcggtttaaatccgagacttgacacgagtcctcgtatttttatactatttcaaatgttagtagttgtggtgttcgttctgccacaccatccctacccactaacatttggtccccataatctatactattacatcacccctcaatgacaattattcaataacaaaaatcataaaaatacaacttggactaaatatgtgcttaattgacttagttagctagaaactcaatttgttttccgctgcaatgcacgagctcttccatagtatttctaattattctttaagtgctaggcaacatatctatcaataacaagatatctgccgtgacttgtcaatctcaatatacgtcgagcatgtttgtactgtgtctctaaaaaagaagatcaacatttataactttagtttaaccattaaactaacaacatacattagaattcctagtaatggtggataaaaagtaattagtcaaatatgtggttttatcagtttaacatatgagtatttatagtaatggtggataaaaaaaaggtaatttggaaccatgccattataattttttaaagtttgagatatgccatcggtatcacaatgacatgtaggacctacatgagtcaatgacatgtgggtcaggatggcatatatcaaattttgcaaaattataatggcatagttacaattttccctaaaaaaataattagccaaatatgtggttttattgcaagggaaggcttcatcaatctcaatatgtatcagctgcgttcgtactatgttttaaagaaagaaaatcaacatttataactttagtttaacaattaaactaacaacatactccctctattcccaattgataatcacatatatttttaggttattgtcaaatgatcaccatattagtattcgttctctaagtctattcgcataggagtaattaatggatattggtgcatatatccatgcacacaaccatttataaccaacatgcaatgttttggtttgttattggcataaggtaaacaatatatggctgagtaaggggacccatcccacatgacattgtaaaagaatgcaacatttaatagaaatgcaggatatttgtaaattgggtacaatatgatcaattgtaatgcatgactttccttgctcttgcactgatgagaccacagcaacgtcttcaagaaaccgcggatcgacgaaacggccgaaatctacgcgacaaacagagcacacaagcaaaacacactataagactactgaaacaggaaacaaaaccatttttaatggattctagggatttttatgaatttactgagacttgaatggacttaaacggagctcggatgaattacttatgaattttagaagataaactatgtttttactaataaagaaaagccttaataacttttattgcgtaatattacccagggctgatgtcagccgggggggctcggcaggtgggccccgcatgtcagcggcacaaggggagagggagggggtgccggcacgtgggccccacgggcaatggctaaaagggggggtggtccatcggctggtgggccccaccggggcagcggcacaaggcgggggagggggtgccggctgctggctcggcacggctcaagctggccggccatggcgtggcggcgacggcgcacgaccgccggcaacgacaagcggcggcgcgggaggcggcgcggacggcgcgaaaggtggcggcgtcggctgaatgcgacggcgcacacgcggagggtggcggcgctcatgggagggaggaaaggaagaaggagaggggatccctcaccgaggcgatgacggcgatcggcgcgggaagagacgagcggcggcggcggttcggagaacggtggacaaggtcaggcacaacctgggaaaggcgatgaccgggttaggagaagggaaggatgaccacggcgactagaacggccggccagagttgggcggaaatggagagctcaccggcgtgcgagggaggcggcgctttggcgacgtttggcggcaagcgagcggcggccgaggtgtgccgtggggagagcggcggagtgcacggcggaggccctagcggcgacggcgtgtggccggagatgggcggcggcggcggagctcgggtgtgccgtggggagagcggcggagtgcacgggcaagcgcggcaagagcgaaaaaaggtcgaggggggctcgagggagtgatttataggtacaggagggggcggacgtggcctgggaggtggccgatttggccggcgacgtggggtggagagagagagtgcggggtgggattcaaaatgaatctcgcccatttttgggcgcgtgcgagggcgggaggagcgggggaggggcggcgacgtgggcgcagggcgcggagtgggcacggggaggcgggaaaggcggcggtgtgggcggttgccgccggggtgcggtcggctggaggaaggggacgaccccgacaggtggggtccacctgtcggcgtcccggagggagggggaaggggaaacgggccggtccaacaaggagaggccgagcgcggggtaaggcgaggtggactgggccgatggcccaagaagagggaagatgaggaaaataaaagggaaaaaaatgaattccctgggatttaaaattgcactttggtgatttttaattggtaaaaattatttccaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaactaattttttttagcaagaaaagggggaaacttcagggcgtgacaatgtcgctcccgccatcgctgtttggcgctaccgcgcgagcagccgcgcgaacttcgccgccgctcggccatgcgtcgccgacagctcctctcgacgttttccccactgtcgctctcccagagaccccttcaacccccctcctttggccgccccgcctctttcctctagccgccggcctcccatccccttctatcgccgccgctctgcttccgccgctgccgcgcacaaccgcgcgccgtcgtcggccattccccgtcgattcctctcgcctccgccctcttggagctcccgtggccctccccgaaccgccgccttgaccgccggccttccttctcgtgcccgcgccgtgccaccca

SEQ ID NO: 74900 - DNA, 4418 bp, Oryza sativa
cgagcgggcaagaaaacgtgcgctctgcttgtcaaaggtcactcccggctgtagactagccctcattgtaaaaagcatgtttcctttcttaggcagctagaggcccatgtggtgacccctgaccagataaaaaggaggcccaggcctaagagagaaggaagaaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattcctcagatcgagggcgaagaatctcacttagcgcccccggccgaaccggcaaagggaggcctgcgcggtctcccggtgaggagccccacgctccgtcaatatcatattataaacataagattggaaacatccaaaatttgaccaaaaatttaaaatctgatatttcagaatttttgcccaaattttggaagtttttgtttcaggggtagtcatttggacaaaattgtacattactaatgaaagctaatcggatggcaatggtaaatcatagaagttaagtaaaagttgatggtatattatagaacgttataaagtcagtggcaaatcgtagacatgtgacaaactcggtgccatataatggattctctctatgttataccatgtccggggcatttcgttgctatgctggcagggagctgctaggggcaagctagtatagtgcaatgttccgtagcatccaagattccctcattatttatagcgtgtatatcaaactactagtatatatagcatgtgccgcatccataatacgcatgtaagaaatcaagctacaattcaagtttatgtgcagctagctagaccactaatgttaccatcatatattttttctagaatcttttactgaaatatatgaatagaggcgcagccactgtggtgggatggggtctggccttccccaacagcccagtaacaaccagcccctcctttcctacaccccaatagtttacttttgcttttaaatactaccttttatcaacatataagtaaaaataaccatgtactattttctttttaaaatatatgacaccgttaacttttcgcataacgtttgatcattaatcttatttaacaatttagtataaatatgtaaaagtataagttaagattatattttatttgatgataaaacaagtcataataaaataaatgatatatatatataataaaacaaaatagtcaaacattatgtgaaaagtcaatagcatcatacatttttaaatggaatatattttttatatcattagttgtctaacacttcaaaggtataatttcacctctccaattaaatttcaatttttctaaaatattagttaatacttgcatgaagatgcgtatatagtttgtttctcattttactaaaatatagttttttttggattgcttgtcaatttatttggaattttagctcggatgatactatcaccgcttatgattgtctgcttaatactcataggctaaattgaaatgaataaatatattcggtatatcaacatacctaccttttttattatcatgtgctattttttagttgatacgatatattacgtacctttgggaaacattacgtatattttttacactatatttttaataatcataatcgctttgtgaagttcgtcttcctcgtatctaaatcctagcttcactacgttgcatgtacaaaatgaggggacgtacccttaactttaatgaacaaaacgacattttacgaactactgagctacgagcaaagacactccacgaaatcgaaatgttaacttatatattttttttttttgaaaactagagggtgcatgcagcggtcgaagatgtagtttttgctagtctcattatagtctcttacactcattatagtctcagttcttcacaatatatattgattactattgaattatattcccaggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttagttaacttagcgttccatactgaaagttatataggagtagtattattcatcgagctgtggattgtccctgcaggttgacaaggcatccatacttgcagaaacgataacctacctcaaagtgttagagaaaagagtgaaagagctggagtccagcagcagggagccatcgcgttggcggccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccttaagcgtttctctacctccatgtactattggtgccatctgaattaccgcttactaatagactcgattctctccacacaagctcaatatgatttcagcacatctgctaggttttgtcccttttattaacgtctattatagctagggatgcatttacgagtgcatgcatgtgtaaacatcttttatataattgcaaatagaagaataaattccataaaactatagactgcgaataaagtatcgcaagttcacataattaagatgatgcatcacttttattacagatcgaactacatatataagatggagtgttagaaagctacagatttaataataaaattaccatgaaactacaacatttataaatccaacataacaatgcttttatatttaaactctaaaatatatagttttgtgataacttaattattaaatgtgtagttttgtgatactccgccaatttgatatatagtttcatgataaatttatactaagatgatacactgtctcaaatatatatttttctataaaataattttagtttcttaaattttacctattttaaataatataatggctatatcagttcttggagacaaaaggaaaaagccaggaaactcaagttggaaaagacctcacattttcataatctaggaaaagacctcacatctattatataattaaaggaatataaaaggaaacctccacgttcgctctcatggcctagaaattctcacattaatcggagaaaaagaaaaaacagagtccatatagaaatacaatttagaaatagctgaaattcggaattaaaaaataaggaatattagaagaggagactagagtccatatagaaatacactttagaaatagttgaaattcggaattaaaaaataagaaatattagaagtagagtatagagtccatataggaatttaaaactaactaaaattcgaaaaaaaagagcctccacgttcgctctcatgacctagaaattctcacattagtcggagaaaaagaaaaagcagagtccatatagaaatataatttagaaatagctgaaattcggaattaaaaaataggaatattagaagaggagactagagtccatatagaaatacaatttagaaatagctgaaattcggaattaaaaaataggaatattagaagaggagactagagtccatatagaaatcctatttagaaatagctgaaattcgg

SEQ ID NO: 74901 - DNA, 3540 bp, Oryza sativa
tgcgccgcaccgccgccggacaccgcgccgccccaccgccggacgttgcgccgccccgcgcgcgtagccgccgtgctggagaggtgaggggaggggaggagaggtgaggacaggccagccgtgggtgaggggaggatttgagacttagaaaaaaatcactcctatccaagtctatttatattcgagtctattttcgcaggcggaccacttaacgccgcttaagtggtccacctgcgaaaatagattttcgcaggcagacggtagatttcacctcgatttatatttttataggcggtcatttggctctaagggttatgtccgcctgcgaaaatgagacccccatgttgggaaaaatgctttttctagtagtgaaatatctaacatttggatccaggggatttctagagatcaaatgaaaaggatcaattatatgagcagcataggagggaattttcttttggtatcaatttttggtaccaagaaaaggaaacatattgatagaattttggcatgacttacaactctgcactcacaaaatgaaagttgcacagatagattttcatcaaactagtttttaatgctgagagaaaaaggggtgttacaacgaaggtgagaagttacattagagttgtataatatgtacttataatctgacgtccaagaatttgtaatggagttgactgtcgatgttttaaatttttaaaatacaattttgcattctattttaggaaaaagtatattttacatcttcagctattattgaagtccaaaaaatcacccatgtgttagcgatagcgctattatcgcatgtgataatatatgcatgtcgtgtattagagataagagagactttggataagaaacttcttgtactacaatgcatgtatcttctatctctctgtaagccatgttggaggctatttcgaaccaatacaaatacatatatgcgacctctgtatgaggtgagaacgcttccatattttctacagagaatatatggtatcagagcctcctcaccaaaactagatcgcatctagccatcgtaagtaactccagcgccgccgtcaatccattgtccaggcattctgcccctgagaagttgacccggggcaatttcctttccatggaaggcgcagatccttccaaacctccgtggcgcgcgtatggaaggttacatcaccggcacgactcgcgctctagctgccaagatcgaggtcacagagaaaaatggcaacaagacgacagtcaaggcgctgaatccggcgtatgacgcttgggtggctgcagaccaacatgtcatcggtttcatcctcgcatccctctccaaggaaatcctgatgcaggtcgctaccgtggagaaggcggcccatgtttggagatcaatctcatagatgctctcctcccagtcacgtgcgcgagctcgcaacacctgtctcgcactttccacaaccatgacagaatacattaacaagatgtccactgccggctaaccctgtgacgatgaagacatcatgtcctacatcctcgccggcctcgacgacgactatgaacccgtggtttcatcactggtaggcaagaccaagccagttcacatctttgtagtttactctcaacttttatgttttgagtacagggcaaaattgcgtcaatcggcagcaaaccaggtctactcctccgccaacagcactaaatgtggtggtgggagaggtggctacaacaacaacgacaacaacaactccaactgcggtggatgcgatggcaactccggtggtggctgtggagatcgtggccatggccgcggcaacggaggcgatcgctacaactccaaacctcatatggtgtgccaattgtgtggcaacactggccatttggctggcgattgctggtatagatttgatgatacttttgttctagatttagaggtaacaatggcagcctcatacaacgttgatcccaattggtatgtggacactagagccacggcatcaccggcgagttggagatgctaacaactcgggaaagtacaactctaaagatcaaacatatacagcaagtggtgcgagtatggagattaaacatatatagaattcagacacacacgcgtaatctttatctttgaaatattctacatgttacttaagccaaaaggaatctcatatatgtacattgataatcatgcttttattgaagtatactctcgtttctttgccattaaggatcaggcaatgaaaagtcttcttcttaggaggcaacgccgcaatggattgtatcatctaccgaaaatattgcttccttcatccaagcaagttctcggagttgttaagcctagtattttgcagtggcatagttgtttgggtcatccctctttatccaatgttcaaaaatttattagcaataactagtcgccaacccgtgcatttcacgggctatgattgacgtgacataaatattaaattttaaccatatatatataatatcttataaattgtaaatacttggtaaaaagttactttgcatcgatggctacatgctgatattaaattgaaagtataaaataggaccatatttcttaattaggaaattagaaactattaaattctggaaaggaactaaagagttggtagtaagtgtacggtactactacggagaagttgtcagcttacactggtaatactttgggggtaaatgatgcaactcagtataggagtatatttggagctttacagtacttaacattgactagaccagatatctcttttgcagtgaataaggtttgtcagtttctacatagtccaacagtacaacaccggatggcagtcgaggatattgagatatattaagtcatcagttaatctattttgagaattgataaatcttattttactttgttagtgctttttcagatgcagattgggcagttctgtagatgatatgcgatcagttggaggttttgctgtgtttcttgggtcaaatctgatatgatggagtgctagaaaacaagctattgtttccaagtcaagtacagaagttgaatataaagcagttgctaataccacaacagaggtaatatggatacagactcttcttaaagagatagggatttctatgcctcaaactataagtttgtggtgtgtgataatttgggagctacatatttgtcagtggatcccctttttcatgctagaacttatcatatagaagtagattattattttgtgagagaaagattttctaggaagcaattggaaattaagtttatatcttcaggagatcggatagcagatggttttactaagtcacttgctgttcaaccatttaagaattttgtatacaatcttaacttagataagttattattaaacgagaaagtcagcgatggcgctattatcacatgtgataacatatgcatgtgataatatatgcatgtggtgtattagtgataatatatgcatgtattctatctctttgtaagccaagttggaggctatttcagtaacataccgagcatttcacctaggaaaatttttgaggaaaatgaaa

SEQ ID NO: 74902 - DNA, 17170 bp, Oryza sativa
acggggccgggggccgtcgtaggcgatttcaacctcattctcgaagctcaggataaaaacaaccttaatctcaatcgtcgtatgatgggtcgttttcgtcggctcatcgacgagttggaactccgggagctgccgcttgacggacgtcgcttcacttggagcaatgagcgtgagtcgcccacgcttgttaagctcgaccgcgtcctcttctctgcggattgggaagagcttttcccctcttgcctcctccaagcggcctcttctatcgcctctgatcactgtgctcttctccttcatacctgcgtcacctccccgaaagcgcatcgttttcgttttgaggccttttggcccaagttcgacggctttcttcaagtcgtgtaggacgcctggcatccccctgccaacctaccccctcttgccgctcttgcttggtgcttctctaccatggccaagcgcttacagagctggagtgaccgtcacattggcagtgttcgtctgcagcttcagatggcgaaggaacttgtcttccggcttgatgttgcgcaggagagtcggtctctttcccccttggaaacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacgcgcctttatgatggtgaccagcttgccgtctcccatgatgcgctgcaagagcttgcctcctctcacttttgcgccatcttggggacgagcgtcgagcgtgaactcgccctagacctccactctcttggcctccgccctgcgtagcttgaggggctggactgtcccttcacagaggatgaggtctgggcggtgatcaagtccttgccctctgataaggcgcccggtcctgacggttttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctctcctcgcctggacgagcttgtggcgcctaatcagagcgctttcatcaagggccgctctctccatgacaactttcgctatgtccagcttgcggcaagggcgctccacgccaaacgcgttccccgacttcttctcaaggtggatatcgcgaaggcctttgacacggtcagctggcctttcttgcttgaggtgctagcccagcttggcttcagtcaacgttggcgtgattggatctccctcattctcagtgcctcctcttcccgggtgctggttaatggggtgccaggtccacggttcccccatcggagaggtcttcgccaaggagatcctctttcccccatgcttttcattctagtcatggatgtgctcaatgcgatgctccgcaaagcctctgactcgggtggttttcttcccctcaatgatcgttctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcgattactccgatccgctgctcggttcttgacctggagctggttcagtcctcttttccttgctcgatctcggagtttccctgcacctacctcggcattccactgtcagttcgcaagctgccaaaagcggccctgcaaccgcttgtggataaagtctcccattggctccccccctggaagggctgtctaaccactctggcgggtcgctcggttctagtccagtcggttctctcttccattccggtccatgtttctatggcgatcggcttgccaagctgggttatcaaagccattgacaagaagcgtcgcgccttcttgtggacaggtacggactcggccaatgggggacagtgccgggtgtcctggacgagggtttgtcgtcctagggatctcggtggactgggcattccggatctcagggtggctggctttgccttgagagttcgctggctctggcttcagcgctcgggacacccctactggtctgatctgaaggcccctgttgagcggagcgtctccgacatgttcgtagcatccaccttctctatcctgggagatggtcagtccacgctcttctggactgatcggtggatcgatggtcgctcgatagcttctatagctcctgacctcctccacgtcgtgcctccacgcttccggggatcgcgcacagttgctgctgggttagcgaacaactcctgggttggtgacatacgtggcgccctcactgtcccggtcatctctcagttcctgttagtctgggacgcggtggttcctacccagctctcgccgggtgttgaggatcacctcgtctggcgttggacgggtgaccagtgctactcagcgtgatcagcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagcgtggtatcgatagccactctgcttgccccttttgcgctcaggagcttgagacagcgaaccacatcctcatcgattgcgtgttcgctcggcaggtctggctccgtgtgttgtcccctcctggctgggctgccctctctccccctcgtggcagctggctccaggattggttgtcatcctccagggtatgtttacctgagcaccttcgcagcggcttcgactccttggtactcctagtctcctggcagctgtggaaggaacgaaactccagggttttcgactctgcgctcgcttcggtcgcagtggttctagagtccttccgctcggagggccagctgtggtctttagccggtgttacttgttttggggatttcttgggagtgaagcgtggctctgccccctcccgctgtttggagttgcgtttttaaccgtcgtagtagttcctagcttcaagtccccccctttagacataagccagtctagctgattgctttgtgtaacaaaaactcttttcctgctaatattttgacgtgcaatccttttgcgcgttcgcaaaaaagtttccacttgtgcatgccatatatactccatactagtataactaaacatgcatcagtgatcagtcaggtctgcatctataattatatttcacttcattttgaattaaagatcacaaatgaacctatatgttactccaactattttcaggttatgagacgttttgactttggtcaaaatcaagctgttttaagcttgaccaagtttatagaaaaaaataataataacattttcaacccaaaacaaatttattataaaaataaattattattgatttgatgaaaataatttagtattataaatattactatattggtttacaaacttagtcaaacttagagcagtttgacttttaaagtcaaaacatcttataacctgaaacggagagagtatttaattaattcccgtattacgtaggacactatcatactatgtccatcgtattaattcatacaatatgtataaaacactacatgtagagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacctacgcctttcgacccggccaagggtgcgtatctcatctgctaattgctgccagccaacgcacacatgcatgatgagatgatccgttgatctgccctacacatatgactgatcacttgtcggttgatctgctagcaactccaataatacgtttataaaaaaaaaactccaataatactccgtaggagagaacacaaagcttatagctgggtataagctcagtgacgcagtcagaaagatttttaagcccgaacaaattttgatataactagtatttgctattaaaaattttatttactcattaatattgaaatttaatgtagttttcaccagtgagtccgggaagctgcccaggctagccgggcggtggcttcgccactgcagcctagcaatgttcataggcggatctaagggtggttccggtgatttcgggaccacccaaaaaaattcagcccaatgtatatatatacatatgtgaaaaataaacttttgaaaaaaaaactcatttcatcaatctatacttttaactttattgtatttaaggtattttaaaaaattatataaattagatcacctatataaagatacgtcacttcaccactggcaatgtctctcatgagtcccatgttgacaagaatttgctttaccgtgttgttgttattgatctgctggggtacattctgccaggttacccggcagaagctatgcaagcaatcgatctgtttggttgtgcaatgctcagtctgcagatagcaaaacctttctacgtgcgctcttagcgaaggtacatatatatttcccatgctgtgctagctgctcatggcatcgtcccttatgcctccaaagaatataatgttcagttcccgagaaaaaaaggataatgttcatgcattctccttgatctaatcatcatatttagttgttatttatctccctgtcatgtcatgatctaactcgcatgctctctctctctctctgtgtggtccaactccgtccactaataatatcgtatgcaaagagcgcgtctattcaggtatgtaggtacagttgtacatagtacggagtatttcagttttcaaattgatgtatactgtacgtgtacgtcgatatctctgactccatctgaaatatctatacattttacagacaattgtctgcatccccttcatgagtggcgtgcttgagctgggaaccactgatccggtaagttcattggatcactcagcacgaaaaactatggacctatatatatgtagctagctcaatcgcctagtgatgatcgaccaacataagagtatactagtatgttataacagagtatcacatgcttggtatatgttatagagagaacctattatatgtcctgagtttatcacaggtctacgatttgtcattgattttgtcacgttctataatatgctatcgattttgcttaacttttatgatttaccataaccgtcagtttaaccttcgtttgtattgtatttttttcaaaatatgataaaaattgtaaaatatctgtcggtgacatgggaccgggggtatcgtgactagaggcttgggcagccgcggtcacccacgtggcctgaccccctcgggggggtgggggggcgggcccgagggtgacgtggccacccctccctctgtctccccgaggggtcgggccgctcccgtttcggccccgagggttggggcgccccgaccccctgtggtattggtgccacgtgtgtgggttaggtgggcacaacggcgctcacctaaccgcatttatagcggattggacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattccttagatcgagggcgaagaatctcacttagcgcccccggccgaaccggcaaagggaggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcatagcctctctccgaacgctagcggcgacgacggggagcagaacccacgccgtcgggctcgcaccccaccgtccccctctcgtcgaaatcttgggcggggggaggcgctcggggaggtcggaggatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccggcgttggctggatgacgtggccgacttggtcatgacggcgcagcagagcctaggcgccggcgggaggtcctccgccaccgaggcctctggcgctgccgccgccggctccacgtcgtcgaggcggagggcgcggcgagcggcggccgttacccgccgttcgtccgccattccctcatcaacgcctccgacccaagaagatgtgcgtggggggtcggatgcccgcctcgatatcgagcaccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgagaggatctgtaccagcagttcaccacgaacttccagagcacatatccacgcccaggcgaagaagcggacttgcacgcggtacagcgaagggacgatgagtctcttcgctcgtacattcagcggttctgtcaagtccgcaacaccataccgtgcatccctgcacacgcggtgatctacgcgttcagggggggcgtgcggcacaaccgcatgctcgagaagattgccttcaaggagccccagaccaccgcgcagctttttgagctcgcggaccgtgtggctcgcagggaggaggcctggacctggaactcctccggttctggtgtggcagctccggccgtccccgggtccgccgctcggtcagggcggcgggacaggaggaggaagaaggggtcggcccgttccgacgacgagggtcatgtcctcgccatcgagggtgcttcgcgggccccccgaaaggggaggccagcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaggtgagaccaagcagaaggccaccgccgaggacatcgacgatggtgacgatgacctggggttccaggagcccgaggccaccgtcgccaccgtcgatgggggagcgtgcgctcacgcttctcgccggagcctcaagtccatgaagcgcgagcttctggccgcggcccctacccatgaggcgacgcggcgggcgcggtggtcggaggttgccctcaccttcgaccaaaccgaccacccgccgtgcgttgcccggggaggacagatcgcgatggtggtttcccccaccgtttgcaatgtcaagttggggcgtgtcctcatagacgggggtgcagccctcaacatcctttcccccgcagcctttgacgccatcaaggccccgaggatggtgctccggctgtcccagccgatcatcggtgtgacgccggggcacacctggccgctgggtcatatcgacctcccggtcaccttcggtagttccgccaacttccgcacggatcgggtggacttcgatgtggtggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcaacgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacgtcccgtccaagaccacacgaatcggtggtcttctggacgacaaataggaagacgcgctcgtctccttcctgcgggcaaacgccgacgtcttcgcctggagaccggcggacatgcccggggtccctagggaggtgattgagcaccgtctcgccgtgcggccgggcgcaaggccggtccggcagaaagtgcggcggcaggccccggaacgtcaagccttcatccgtgaggaggtggcgcgacttctggaggccggattcatccgtgaggtcatccatccggagtggctggcgaacccggtcgtcgttcccaaggcgaatggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggctaaagaatgcaggtcctacttttcaacttactactcgaatttctttgggtagccagataggacgcaatgttgaggcctatgttgatgacttggttgtgaagacgtgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcaaggctgggagagaaggcagtacccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcaggtggtcagtgcggcgttggtcgtggagcgcgacgaggacaaccctcactccgcgcatgcctaccctgtgtcgactcgacccgggagagagcagggaggagaggcccccgagccgaacggtggcccaaggcccccgacggccggagttggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctcttggaccaagagcgccatggagatgcggcccctggcgaagaggatcggccccgccgaaaggtgcagcggcccgtctacttcgttagcgaggctcttcgggacgccaagacccgataccctcaggcccagaagatgctttacgctattctgatggcttcgaggaagttgcgccattatttccaggcgcatcgggtcacggtggttacgtcgtaccccctcggccaaatcttgcataaccgagagggtactggacgggtggtgaaatgggcaatcgaactctctgaattcgatctgcgctttgaaccacgccacgcgatcaagagccaggccctcgccgactttgtagcggagtggaccccagctcccgagcccgtctccgcccccgaggccagctcgggcccctcgcagttgcctcacaccgccttctgggtgatgcagttcgacggctccctgtctcttcagggcgccggtgcgggggtcacgttgacctcgccgagcggagacgtcctcagatagctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggttcggcgtatggagcgccatttcgacgggatagagcttcggcacgtgcccagacgggataacgcggtcgccgacgaactctcaaggctcgcttcctcacgagcccagaccccaccgggcgcctttgaagaaaggcttgcccagccgtcggcgcgacccgaccccctaggggagacggacgcgcctgaacggcccctgaggcccgtcggagtctaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgctaggcaaacccatcagccggcccaggccctgcagaccatacctctttcgtggccgtttgctgtctgggggctcgatatccttggtccgttcaggcggaccccgggcggtttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgtttcgcctcccccgcccaccccagaagcaacggccaagtggagcgcgccaacgcggaaatcctcaagggcctcaaaaccaagaccttcaacatcctcaagaagcacggctactcgtggatcgaggagctgccagcggtgctctaggcaaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctactcctagtgggggtcgggtgttatgtctcgggctcgggccaaccccgcgcctcccctgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcaccgtttgaggctgggacctgggcacgagcccttgttcaagctaagacacagaaggaccgtggcacagaccatcctcgtctcaaacacacaacaaacagaactgacgcagaaatttcctccttacttgattacagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccaccctcctcgtcggagtcgagggcgaacgcgagccgaggggccgtaccctcgaagctgtggacgatgtgatcggcggcgtcccggacctgcgcgcgcgcgccgtcctcggttccgggagggaactcttacagcgctgcccacggagagaagtcagggtccctggcctggtagcttgccagtacgagctccaccgccccccgggcgaggtccctcgtggataacttgatcgtctcctcgagctcctcggggagccgctggagggtcccggccatctctgagaggcgctgggcgaggcccccctggttggcggcgtacttcgcggtccgcccgccctagaggcccgcctgccgcccggcgcggtctagacgggagacggcgtcccgaagcatgccgggtcctacctcgctcaccaaacggagggcctcgacctccctggcggacgagtccagtgcgccctgcagcccggcgatggtgtgttcggcggctgcgaggcgggcggctaggtcgccgtcgcccgcggccgccccgccgctgtgcgctctcgcgtccagctccttcgcccgcgcctcgagctcagcggcccgctgatccagtgcggccctctcggcatgggcgccttccagattgcggcgcgcctgctcctcccgcgctgcttcgcggaggaacaggctgtccgccagccactgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtctttctccttcgtgtccagggcgcgggcgcgcttctccagcgccgtggcgcgagcctcaagggcctcttcgcgctgccgggacgccgcctcgatctccgccgcccgccgttcccgggcagcggcggcgtcaaggactccccgggcggcgtcgagcttcttctctagctccgccgcccggctcccgtattggaggcggaggtcgtcccgcacctcgtcgagcacggcgatggcgatgagggcagtctcccgctcctcctccacctccctggcgatctccgccaggtccctacgacgggccttgagctcggaggcgtgccggcggtgtgccttgcggcccgcctccaccatggcctccaccgagcgccgcccctcctcgacgcgcgcccacgccgcgtcgagctccgcccgctctgcctgcagggcctccatctgggcacttaacccgtccagcaccgtggtgttcgcggcggctaaggcctgcaggaggggctccgcactcagtggggcaacggaaggcagaggggagagccgcctcggtgtgggtgccgcgcggctcggcccgccgatcgacgtgccggacccaggggtgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtgcacgcgccgtctcctcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcgatcgccgtctcctcggcctcggaccggccggacttggaatggcgggggggggggggcgacgggatctcgctgaggcagaagaaaaaccagaagacaaaaagaaacgggtgagtgaaaactcgccttgggagatgggagaatgaacacggccgcggtgggcgcggggacgaacctgcggggaggtcggctaaacgaccacctcgggagcgagatgaggttcccccggcatggctcggtcccccccatcttgcggagccgtttcttctttcgctccccctcaggctgtggcgtcggcacggcaccctccgggcgcctgctgctggcacgcaccgcctcgccctctcggggaggagatgggggggtcgtgccctcctgcttcctcttcccccgggcgtcggcagggcggctgccccccgggcccccgtcgcggggcccagaagcatgaccccctcccagggtagattgtttccccctgcggctcccgcccacgccatcgtggcctcgggggggccgctcccccgacgccccgaccgcctgcatgatggtcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatctggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccagctgtacggtgaagaaccactggaacagccggagagatgggcgcaccccgataaacatctcgcacaggtgcgcgaagatggccaacgtcattattgcgttgggggtgaggtgcgccatctggagatcataaaactccagaacatccatgaagaaattagagaatggcgggaccagcccggccattgcgaaagagaggaagaagacggaccgccccgggtagtgtggcaccgggcgtccctcgcccagctcgaccacctcccggccggtggcagattccggcatgaatcggcgcggcaacccggcctgcctctcgctcacgatgcgggaaggcggcagcacgctaccgtcgagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatctcttcctcggcgtctttatacccttgccaacgctatgcccggctcctcgcttcccgcgcccactatctcgccccctcgtttctcgcgcccacgcctccactaatcccactcgcccctttgcagcgcacgcggcagatgtgcggccgtggcggttgagatgggacagatcgtgcgcgcattaactacgttcgccaaccgagaagagcgccatcatcatgtctccaggcgaaacgaaccggctcgtcccgattcgcgcgctgctcgagtaatgtagcggtcttgaagagaccgctcattattgtcggtcggtttttcccttgccgatgcgcgcgatttgcgaccgctgggtttctgcccgcctgtagagaccggccccgcctgtcaccaggcctaaggagtggcgtcacgcccgagcgcttccctcgaggggggtgatcgccctggcgtaacgccggcggctactgtcggtgatatgggaccgggggtatcgtgactagaggcttgggcagccgcggtcacccacgtggcctgaccccctcgggggggtgggggggcgggcccgagggtgacgtggccacccctccctctgtctccccgaggg

SEQ ID NO: 74903 - DNA, 2230 bp, Oryza sativa
tcaatgggctccttccgatgtcactgaggaaactctcaaggagatggtggagcacggagtattaccatccaaggagatcatcgaatagcgtccagcatttggtgaggcctttccaatccccgatactcatgaaatcgtagtcttcacccatttcttctatggtggctttgctcttccaacctctaaattctttaggggtattcttgaattttatggaattaatatctaccatctcaaccccaactccattattcatatcgcaaactttgttcatctttgtgaagccttgctgggcgttcgggctcattgcgccttatttcgccgaatctttttcttgaaaccccagccaaataaaagcaagccttgcattgttggggtatctagctttcaacttcgtggcaccctatgccaaaaatacttcacccttcctttcaaaacctccaacaagggctggcatgctagctagttctatatccaaaacccagatccttccctgcccaaatactcatgcatccctcctaagtatcaagatatctggaactcactccctatgggcgatgaagcttctcaagctcttgaactgctgaaccggctgttgaagttgaaagaacagggtcttcaaggagagcagatcacttggcatttcataaagtgtcgactggctccaattaaagaaagatctctcgcacggccttcgagtatgatggggagaatgaccccaacctagaagaccctgactccctcgaattcaagatcatgaaggagaggatgtataaagtcttttcatccagtattgcggtcagcttttcacatctactgtcagtcgtgccatacaacgccttcaatcctcctccagcggtaaatatctaaatgtttaaatttccatcatgcttgctgcctttggaaataatctttaaatcattatctccaggaaaatgccttgatgaaatctgagccaccaactactgttgacgaccaaatttggtagatcatgcatcaaattcaaagctaagatcgaagcggattttgtggaaggtcgtttctcagaaacatagtatgcatcggctacgggaggcatcgactggcgcctgcatcggctgacgttggatcagacaaataatagccgatgcagccgatcttggtaaggtggttctagaatcatctttgggattgattgatgtgatgcagaagtattgccacgattgggataagcccacagacgggcaattgtatatattaattaagatattttgaatagtttccttagagatatttatcggcaagagtctgcctaaacgacttgttcgtatcttacgtttgtaacatatttggagtcatgtccggcaaggacacattatgtattttgggtataaatatgacccaagaccatgtaaacaataacgatggttctataacactttcggcacatcaccacctttttctattttcattgtttcgacgagttcttgctttcaagttgggctgcatcgggttcgatctccgacaagaggtaaaacttgtcatggcggcttgcgttctcgggattaatgcttacatctctatgaaactctaatcttgtttatgtaaatcatcgagttatcatatgtgcaatataatctttatcaatattgctatctaaccctaaatcgaccaacatctatcattaggaaacaaccgatagggttaaatgtcaacgttgatctagattatatagtatatttaccatctcatagaggtcttcatcaattttcttagatcttatgtttctctttatgcttaatgctgcatcggttgagttcgatctattaagtaatatcctgaactataatatctagcttgttttatgatcatcgataaagatagtatcggggtttcagccgatcttacctgatttagtcatctggttctctatatgtttacttgatttactaaatttgccctttatattaagatcttcttgcattaaaatatattaggttcactgtttgatatattttgtctgttttaatatcttaatatagagtggtatcggagtaatagccgatacatattagatttacttcatcggctatgctataaatatatataatctttatcttaaagtatttttaaacataagtgatttatactgtctcggctcactgtccgatctatctcggtcacttggtttaaggatatttttagaaatagattatatatcattgggacgtgactacacagctagtggtag

SEQ ID NO: 74904 - DNA, 46809 bp, Oryza sativa
taaccgaatgcagtttggtgtaccagaagagagctcattgggtcagtattggcatccccatttgaatgatgttttattgttttgtttcacaataaattatcatggagacttagatttattttcttaacataatcaaatattggtgtcatcaggtgatggtttaggggaaggttatggcatgcttggacaggcaggaagtggaaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggaaaagcaagtgctaaatggattttgatacatcaggaatttatggtactcacagcaggatcagtgaacactattagctgcttatcagcagtagacagtagaagatttgtgttctctttgtttagagcgattgctgtgacgtcctggcctttccccagctccattgtatgaaatacctgccagtaaaatatttctggtaaggttaccacaaatgaaaaataagccccccccttttttttttgcttgtgacactaaccttaagtttatgcagatcaacaaagcatacagaaggcacatgaacagattgcctagtttcagcttgtttagatatgccatccttgccatttggttcattaggttcatgatccccagtctcagtactgtcctcacacttataattgcttgaagaacatgttcccattaaggcgaaatggccatcagtagaaatctcaatgcaactaacccgtccacaaaaaggtgatagaactgtggtagcaatagggagtccattgacagtgaatgtagatagtcttttctttgattcattccaaaccagaatgaccccttgagaagataagcatacagcatgtgcctccgctacattaagcttccttatcagacgaccagtcctcaaagaatgtagaagaacacctgacatgtttgatgaggatacaacaagtcccaagtcaggactgactgaacagctagtcacttcctcaagatgtcctctcaatacatgcataggaccttcaattcgacgcctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatctttggattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgataacgaatctgtctggtaagaaaatgattatgaatctataaactccccccaaatctagcaggtaggatgtctcatcctccactagtaagcagagaattccccagaaaatggaaagaaaatgatggatgaagaggaaagatcatctaaatgaacaaaaaaaatacatatagaagctaaagcataaacagtcaaaagaaacaattaccagtgataatctctttgtcacatgtgacagcaacaactgctgaactacggatgccagaagcagcaaatgctatagctcttgggaagtcataatcttctccagaactagcagatcctttaaaaatgcgcatcagtgcaccaccggttgaatttgcagcatttctaccatgatgaaatagaaagggtgtcccttggccatctggagtatttggttgccaatggtgaagtgccacatgagcagcaggcacatttacatctacaactacaatagagtcattggatacaaacatggtactggccggaacattgcagcgatctggatttggaagtaaatatgatttaagttcacttggattccggaatatagtctgcacagcaaataaaagggtcagtccatgtaaaaaacagtgaggcaggccgcaagtaatgtctactcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatatgcgaggagaaaaaaaatagaattggcttcttaaaaatactaaacagaagtcctatatcaccctacatcattcataaatgctaaatttcaataattcattgatatgatgatccaacaggaccattctacctaaaatacaagcagagaaacatttacaaactcaagaatcttttctgttcatgtggggcctaacttattgaactttgtcattgttgaaagtcttgcttcgtcttcctacaaaacacatctttctattcagatgcagaacttgtaacaggatgctccatcagatggctacagttctttagaaggatctaccattatacctagaggagcacactttcggaatgataacttgcagtaatggcttataatataagtacctattacaagtatcttgaatagcaagtgattataagaaagggcaaagggaaggtgaattacaaacttatttatacctacaccaaattatagagtgattgcataatataagcattcaaattaaaaaaaaaaaaggaaagtgagggtacccaaatattaaatcaatccactcatgcaaatgagcagaaacatgctcactctcaagagccttccggtgtttatggacaaaatcaacagggtcctcagcccaaggaggcaaatttacagaatctgcatttatgttcggggttacataactctgcttttacgaattgtactgtaaattttacacaagctgaaatacaagtacctagctttcctccaagctgagttgtcccgaagtcgatagaatttatattggtaaatacttcagggaggtaaaacatctcagggacctgataaatatcatcagatagttatattgcagcaaaagatcttgactggatttcggcgctgcctactcaggaaaacaaattgctggtaagacttactagctcttttacatcactcatgtcttcaagaacactgtcccatgtaccagatagatcagaaaacatacgatcagcatgatcaaatttgccgccttgcagctgtattgagagcgtagtataaggttccaccctgaaaaggtaatacaagacctgcaacggatatgtattgttatcaaccaagatatacattgaataaaaaaaatcaaacaacatattgaagttgttatattttaggatggagggagtaataaataaacatttgattcagctttaagatgtaccgtgccagcactggagtaatgtgaaccataatggaactttgggatgattggatcctcaaacgtagagtagcgctcttggaatttttctagtcgctcagggtttagtgcaccaatcggctgcatcaaataatactcacaacggttagcatcctagataggcaaaaatatagaaacaactgtcagaccaacctttgaaagatcccgatatgtacatgggtcatccagattaagaatttcggatcggtaatcagcaattatccaaggaaaaacaggatactgcacatgcatgtaaattgttagaatgataagttaccttgttttagagaagaaatacaagtgcagtaaactgacctgagttatgtcattgtaacttcgtccagccagtgtgttcagttccatcaagtactcaaaattgctaatctgaagaaattgaatatactgagattcaaagctaccaacaacagcatagaaaaattatatgttgtgttcatgtacctcccagttagcccagcgctccgtcaactgagttcttttgagaatttgctcagctctctgaatcaagtataatatattactgacaaacgtcattgcagattgatcatactagagattaggaaaaatgggtttcacacgaacctgggtagctagaaaaatgtcattcaaattgggaggcttgctgtgaacaattgcccgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaatacaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctactgcagcaccccattaataataattaacatgtgcacactgaaatataacgcaagttgtagtggctaaaatccaattccaccatagtaactgagaagtgttataactaatacaccacacatcggtccacaattgcaacttgcccttgacattctttaatacgatccctaaaatatgtatgtttgtaaaaggaaaagtataagcttgaacaattgcatcttagcctcttggcattatttatttgtagcaagttgccttacaatgttatgttggagcattgcaacgcttactggtaacaaagacaatgttattcgatacacagtagctgaattatgtgatgagtaatcttaagacaattgacaacctaaaattgacattctggagtctatcagaacacatcagtatgacagatcgtggatgagccaagttgtaataaaattaaagttcactttctgattatttttttttaagaactggtcatggcaccatcaaaatttagtaaatatcaattacttacttggaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcctgcaggttgtcttttccttctatttttgtttcttttgtaagggtgctagtataccagaatgcgctggtctggaaacaaaatttgctggggaacagggcagaaaaacacacacacacacacatatgcaaaaaaaaaagaagaaagattagaaaaagttgtacatacacgatcaggagcacacaagggttcaccgaaaggtccatatagtctgtccatctctgttaggcaatgaagaagatggcgccatgctcgaactccagttgacacccgatgtcgattcagcacatcagcttgtgtttgcctctccatctgcatgttccagagttcatatgatttatggtaaatttatatatcagaaatggacatattccaagtggattcacctcaactcgctgtaagttccgcgccaacgcaaaaccagagacaagaatagcgacatatttgtatgaaagggctgaaaaatcccttcctgaaactgacttggaatcaactgattgcaggcactccatccaagcagcactcatagcttcagatgtgttccacctctttgcacgctcaatatcacctgcactcctcctttgtcctgatgttgccattgctacagcactaagaccccttcctgaaccaatcttagcagtccgctcaaggtcccgagtagcagctaatgctgctgctttgacagctgctttatcctttggtgtggatccatgcttgttgggtgctgtttcaataggcttctggaaacttgtaaaagactgtagttttggtgctgctttacgctcaggcactgacgtgtcacgcctgttcaaggtccttggaggtgctattgcttctgttccagaggcaccagcagccatcatggctaatgccaatgcaacaggtggtgaggcaaaagcagcagcccaaccaggtgatatcattgaaagagcagcctgagttcaaaaaagtaggaaaaaccccttgaatatatttttttctttgagaaaacatctggcgataaaactttaagacagacaactagacaagtacaattttctaatctatgctaaatgtaaccacaactagactagacatatgatctcaggatggatatcaaaatgtttaccttatcattaatatgctaatatagttacataagcgggaaaaaaaacaacccatggttgctgagatactagttaccccctccctcccaaaacataacagcttctagtatttaaaattgtcacaaaatataacaacttcttcacctacattctcttctcaaccaatcacaaccttccaccttctaatttctacacctacttcctcttctcaaacaatcacaaccttcccccatttaatttcacctactttctcaatacccatgtccaacccaaaaacttcttatattttgggacagaggtagtacttttcaggtttcagcttctaggtttctcaaatatcaagtgcactcaatagtaccagattaggttaaggttgccacttgccagcttatgttaagttcatgatcattgaaagcaaccccaacttcttttcttccgcagtattagtaaactagagaggaatttttgtggactgcgtttttcccagcttaaggataaaatatgtaaaacaaacacaactgaaatcactagttggaaatttcatagatatcatagtggtatctatatgtcactgtctcactgatgtataatttagcattaataccacataacttaagctatagttggattttacaaagaaccagtccatacctcaatgggtaatgcatctgctgccaaagcgcgatcatcagcaatcagtggattttgcccatctgaagaagttagctcatgaataccagccaatagtggacgccaccttctcaagatggctataaatggtggtaaaatcagctcaatgtactgtttccttagggggctcctgtccctaccaatagcatgccatacctacagaatgaataatatcgcataagctttatgacaaacgaggaataacttctttgttatcccctacaaaataaacattgcaggaatatagtgcctaaacattataagcataaaagattaacatgcaacatctgtacatctacaaatttacctttgattatagtgtttggatgagcaaaggcaggttactgttcaaaaatcagaatcacaggcaaaaggtataacatggaattcgaaacaactacaaaatttggtactcaagagtaaataccgaacacactttatctaacaggtatcaaacataattgcaaacactgagagtaaaacaaatcaaacagctaaataggagaaaacgaaggaatgtggaagtatcaacaattcaacatgtacacaactgcagatgggcatcactatttcttctcttttttaaaagtaaattattagaaaagaaaagagaaaattaacagaaaaagaaaaagaaaatagatttaagatgtgagcatacatctagtcacttaaaaatttgcagagaaagaaatctactttcaggtgatataatctgtagaactttcttgaagataaacgatagaaaaaaaactaaaatattgcactattttttattagatgttccactccgtagcatgggtccacaatcacttagacaaactatatgcttaggttaagaatattaaaactaacctctgaatagagaatagaggaagcaaccaacaccctttgtctcttagattcattaattggcatattgagaatgggaccaagcacactgaaaaatcacaagagtaccaacaaaataagaattgataaaaccagagtaaacgccatagtcacctagatatattatcatgtatataggaagccaactgtgtttccatcaaagttgcggctaccaactgattgtgacatatcatgccttagagcagttatatttttcaagaaataaccaatgccagatattatatcaaagcatatagtatacaaatcaagaaatgttaggaccctgccagagattgttagcacttcaccagtcaccagtgcttttcttagcttggtggattttgctagtgtttcccctctcaacattacccaacattgaataaataattttcagcttccattttttctcctgcagttaaacacataccactaactttgattttaactgttgatacttgatggtgcatagtgcatacctccacagaagtgcagatcggggtttccttgtagatgagcgattgttgctgtcaagtggcatcatgcttccagcttgatggcccaacccttccgatatgacatcttttatgctgatgttgcctgtgaaggcatcaccttcaccattgtcatcctccctcattgaaacaagagtcattctgagcatgcaaaggaatggctggtcgctatccagcaactgataaagtgcagtcataactcccataccagggccggagccccctccaatacctagaccaccaccaagtccagaatcatctaacagcaatgcctgcagcactgcaactgatttcttcacaagtggaaggtcaacccaagtcccatttgagtccttctccagaacagatttccaaaattcccaaccacttccaccgccaccaaatgtatcagatttggatgggattccaacgccataccacaagcggctcctgtacttccaactttcagcaagatctgcaatgcagctcccataagaaacaaatgcatgtttgacagattcataaggttcagctgctgctgctgatgtaagacgctccatcacagcagcagagatttgtccgtttgaatcagccattgaagtaagcacctgcttgatcacacagtaaacaagaatgaaactacattcatatgaaggaacagtggactctatatatagtcaatacgtgaccagaaatctattaaaactaatgatatttctttcaatagcacttgtctgttttacatgcattatcatgctgtcaacttcccataattgtgcattctacagactgaaaggcatatgaattttcctacgtatcacatatttagaactttctttcagaattcctatccagtaaagtggtatgcatctttctgtatgaaccattagacatatacctccgtccattcagtattattgtctatgtagatttttttttaaaaaaaagaagagcagtattcaccatggcaataatattctcctgtaacatgtggttaaaaaccaatgcaggacagggtagcctaagtgactggcataaagagcctcaaagatataggtaactatgacgaaaaaccagcagtagtaagccagaatatagattaaaaaaattctaaaaacttaggtgactaattgtgacacatagtgccaccttttgcaactatgcaccatcttgaagaaaatagtaaatggaatctcagaacaaacatgttgacgaaacatgctagtgcatatagacctaaaaatacaagtattccagttttgagtcctgttagaaataaatatcatttgatcaaaatgatgctaatagctgaagtaacataaaatatatatagccatgcgttacatacatctaatggaaggccaccagcatcagtggacaaagatgatcgtcttgaggtcccagcatccataggctcattaccacttctacacaatgaatttgatcgactggcagcagacgaaaccattgaggcagaagggacagcactatcaagtgatctggatgtgcaaaaatgttgaccttgtgacctcagatgatcttctacaagcatcagaataactattgcattttccgctagtgctactgaaagatgagcagcattttccgcttgggtttttgcttcttcaggagataaaccctcagctgcaacaccagctgcagctgcagcaattacttcagtctgttgtatgacaagcaaaacaaagacattatagatttgactaacataagatgaaacagtatccatgaaaatgatagaattatcaaacttcacgaaattgtatcaaaacataacaaagacagctatcttcaaattaacataaacaatacaatgcaaatggtaaagtacacccagtaacattgataacagaaaccaatgccactgacatggtattgtctaggtgtcaacccttttcttttgtgcagagtaagcagtgatgtagtcaaagctaccagttttagtgttccaccattttgaccattacagtaccaaaatttgtaagttcatgctgaacttttctggattattaccaccatttaaactaggccaggaccaaactatacagcacaaggcaaaggtaaaaaaaactagtgcagaaagtagaaagagcaaaaaaatacaaaaaaaaaaaaggctcacacatatacacaaaacatctctgcacagaaagtaaactgtaacttttagaggaaagtccaaccacctggacttgaagttctctggcagaaaaatcaagcagaccgcctagcaatctcctttttaaaattggcaatgattcttcccgtctaaaagaacataagtgccatattgttataaaaggagcaagataataatgccacaagtaaaaaggccagaaaaattgtagagaaaatgactctttctctatctaagccaattgccaatttcaggtcaaaactcctcacgcattccctctgctagcctgcacacagaagggagcacgagagagagagagagagagagagagagagagagagagagagcacctgattctttggtctcctgtgctagatcctccaaccattgaaagccactctgcacaatgaattgttgcttccacatcctaaattgtcacagcaacaacaaaattatgaggaaataggccaaaatcagcaatgatacaagcatcacaaacacaaataagagaggaaggttgggatggcaacagcggaaaagattttctgcataggatgctctacaaaagaaaaatagcttgccttccacccatctttttgccgcattgaatgctccaacatgataatcaggaaattgtgtatgaggtcttcaatatcaccaatgcttatgccatcagcatatttcttagcacccatctataattagaaatttgtgaattagatcaatgggtagtggacagcacaaaatgtagcatgattcttcttgcaatatattctgacataaaaaaaaggcctacgatacttacctcatgattataaatcaaaacctccaaaatccattctggccattctgaaattgaggtcatcgtggttctattctctggatgactgcaagccaaaaacagaagatcctgaaataatatagagggaaattttgacaccataagaaatttaaacaggtaaggtcgcaaacaaggtttcaggaaaaaacaaagaatagataacagcaaacagtactgatgagcaaaaataataaaaaaaaaacaccaaacagtactaacatagaggttatatgtgggcatataatgcaatggaagtgaatatgattgtgcagccatgcaggtgtttggttaaaagcataagaatatagttaaacacggcatggaatattcccactaaatatgtgtcagttgcatagttcaagcatacattctttttcttttcttgagtttccaaaagaaaagaaatgtgcttgaacagtgcaaagtgacacatatttccttaattctcttagttcttggctgacttctactgagaacatggcagctggttgtcccatgtaaatgtattaaaccacagctgcatgtgatttcaatgagaataattagaataaagcaaaaagaaactgactaataccataaagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacactaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcggacactcgactgggcagagaaaatctagcgttcatgcttatttttacttgaaataccataaagcacaatccaagagattttgttgatagaaacttagatatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagtcataagcctccttggggctgcttgaaatgctttctgcagagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctgtaaaagaacgagaagtgcatccacaccaccacaagatatgaatgactgagcaaacatgttggctctagaaatgttaggctgcacaatcaacctatagatgaggtgcaacacccttgcaacctgttaacaaggacattgttaagatcacaagaaacagcttagactatattgtcagatgagctatatagataagatggccctagactgctacacatttgtattgtctttcaaatgatcaaggcaagtataaatatatcccaacagaaaaatagcacgtactccctccagttccataattcttgtcgttttggacaacaacatgatctccaaaatctttggctatgattttctattataatatatacaaaaaataagtaaatatttagcttttaaaaaatatttttaaactaatatatgcatcatgttctagtgtcttcaaattaaatattttaaaagttagtgatagtcaaggttctaattgtttgacctcaacctcatccaaaacgtcaagaattatggaactggaaggagtaaccacagacaagctttaagagcaaagagctgatgcaccatcaaatttgttgtgactcacggttaaaataatacccacttatccttatgatatgatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggaggaaacagtagaggcatcagcatgagtttgtctagcaatcaatggccaaattacctgattaggctgtgggcaatcaacaacaaatccaatcaagcagcgaacatcatcagaagctgctgtggaagatgctgatcctaacagaagttcaacaacaaccaagagttcatcaatcagagcattaatttcacccaaggatctctttgttccagtaagggcaaagttatcgatcgaatttggttcccggattgcccagtagcaccttctgcagctatcaagaagcatttgcaatgcatttgcatccctcatgcaagcagcctctgtaaatatcatgtctgcaagcgaggacagaagcttcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggacccccataggctaaggcccataaagactccgcaggccgcacacgagatgaaacatgaaccaacccaagaacttctgcaggccttcggtgagtgcctacagttcaaaagaagatactatcaataaaatcatgtacatgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcggagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcagcggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaacccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactatttaagcttggaaggagttgctttcctcctttctctccgttaatttgtaatctgtaatttgaacaatttgctatgtatctctttcctctaattagctctccccctgttgatatttcaaaaaacaacactcgctggaatagtggaagcagctagcaccccaaagatcattcaaatcacagatggacaatagacataggtaacggcgcttaattgattactctgtgcattagcatttgtttacctcagcttcccccaacccaagggccaaggccccaatcccaagcgtcgaccgacaacaaacggccccattgtcctgtagcatttccagtaaaaaaaaacaaccctattgcttcacttattcgagaaataagtgaaacgatgtaaatcctattgcttcacttattcgagaaataagtgaaatgaagtatttacagataaaaagtaatttataaataattttttttatgtacgtgttcttaacaatttaaaatcaaaggtcaaaaataaacttagatgaaaaaaaacataaaatcaactctaaaaattgaaaattcaaattttagctgataagtataagcataagcgaaaagatgaggctgaaagctagcagagccgcagaggaaccttgaaactgatcgaaacccaccaggtttcagccacccgtttgctcgaaatgaaccagaatgaagcgctcaggcagagccgcagaggcgaacatcacatccttgccgtattttcctcttcgattcaaataccatgcggcacgcacggcctgttggcctgattctggattccagtcgctcacatacacagccacgcaggaattcatatggcacatcaatacatatatgtacctcagcaataacaggaaaaatcgatattggaataacgggtctagaatgggccagatcggagaagataaaagatcatctagtttacaggagtactaattaatgaattgacagtactctgatcgacaggtaggatcaaacactgaaagcctgcatatatgcaggaacccgatgcaaaaacaagcattgttctgttcctgctggagcatgagagcatgcatgcatatatatatgcctgatcgcttgatcagctagcacgcgcgaacgattgattaagggaggcttgggaacatcttggttaattcagagggctctcgctttgacgatgtccatgctcatctcgctgggatcggtcgcctgcagctccacctggatcccgtccagctccctcttgaaccggtccttggagctcgcgtacagcatcttgctcctcaccttcgacgtgtccggcgacctggaaaccaagtgatcacaccgcagattcagagatccaagattagtcgaggcatgcaattcaatgtgaaggcaaaaattaattaaaaggcgctggttaaattcatatattttaccaggagatgaagaagatcttgctcttctggcagttctcgtcggtgacgaagtcgaagtcgaagacggcgtagcggcactcgctggcgggcatggaggcggtgaagtcgtcgtaggtgtcgcccggctggcccagcctgtccacgaccacctgctgcgtccgctcgtcgatcttgaacgtgatgaagcggaagctcctcttcgacttgagctcctggaacttgagcttgcactcgtcgcccacggccatccccgacgctgagttcgcctgcatgcccagatcaagcagcaacagcaacagcagcagttagacgtcgatcgtattggcatatgtaattggtcgatcgtatactcaccatggttgataggtttcgatctctgcacggcggtgacgaggagagacggatcggcgtggaggaggaggtggtgggcaatggcgatggcgaatggcaaagagatcgatctccaaggcctgaaagaggggggaagcaggcaaaatatagataagcagctttgcatggcgccatgccgccacgttaggaggaggagccgggccgcgcgtttgaccaacgatcccccttcagggccttcactactatacgtgcgcgagacccagaccaacatgcgctccaccacccatccacccatcgccgtgattgcgagacaacggacaggcatggcacggcgagtcacaaactcatcttcttgtctgcagcggctgaatgcttcagaagttcagagaatgcgcaattgcttcagaagttcatctttggggcagcaaatactgctccagaaatctataacgcggtttatttgagtcgtcaagcgcactagattcttcaactggtatttaaacgaattattgatgactatgatggtaacaaaacaactagagactggcagagaagaggcgttaacagactggcagagctccttgaatcaacacaaacgcaatgttgacacccaagaacatcacttctcaaaacattgaacagtagatcatattaaattcccgttgtacgttacaaaaccgtgatcccccaatagacaaaattgttcggaaggatcttcttctgtatcattactggtaagctacaaaggttacatagtttaaccaaagaattttacaactttcggagcttgttttacttttgccttagtgttggtattcttgtcaccatcgcctgtctctgtggtagattttgaactagattgtttagccttctttgccttggtgtgtcttgtttcttcttcttcaataaaatcgtcatcaaggtcatctccaccccggagaacagcattgtcttccaggtgatgctcctccgtattgaaagctagaaataagcagaagaccaaataaatgagcggctactaataactgtacggaaaaaagttaccagatgtttgatagcaccatcggacaaaattatagaccatctcaaacatataagaaatcataacttatctcacacattagcatgatggcatctgcttggcgccttagccagactgctactactaaaggcgtattcacccaattacccatcggcacagattctatgttacagtatagcatcatgttatgtttctttaacaaaacaaaagaggcacgcctggcaggctagtcattttctcctcataaggttagccaaatgcttacatctaagtattaatccttaattctcacatggatagaaaaggtaaacataatctgttcttctttctccaatgtattgtcaaaacaagcgtatggtctatacatccatgaaaacacttcaatggttatttactaaatgtaaacagtattaataacaagtggatacaaagatcagctacaagaagttagtgaaagttccaaattttttaaaatgaatcagcaaaagtacaatacacatgataccgtggaggaatgttaagacagttcccacaaaatgttacagttgaggtttgtgtttaccatcatccccagaagatatcaagtcttgcctccctctgtttggacaatgcttggccaggtgtgtaacttcaccacatatcttacagcaacctccctaacaaatgtatagagttagaatccacacgtaatggagacatgcaactaaataaaggaaagataatgcaagcagaacatccttcaaagtggacattttgagcccctaaatgcagaatgttatctcagtccaagatcttgtggtgataagggacaacagagtatctgataatacctttggataaatgccgtgtttgttttcaggacaattcttgctcaaatgtccctgctgtttgcagacaaaacagcttgcgaactttgtaccccctgtatgcaaaaatcatgctaaatgtgcgaggaaatcatatggctgagggtaactatttgcaggtatcgagtatggaaactggcaactgtatgagatgaaaggatgtattatttaccattttcaatgggtttggggcacttggaaagtgagtgcccagattcaccacaattataacagaatttcttcaaattttcatcatttttgtcagggcaattcttcaggctatgacctcgttgcctgcagagcaagcaaatctgaaagaagaaaatataaatattaaattttagcttgaaaaccacaaatgaactggtcagactttgaggcaactaagtactgaaaaaaaaaatactactgactgaaaatatataactgtgacagccagaatccactgattaaaggttggaatggaagcagtaaaacacttatcaggatggcctccagaagtcaccgttttgccattcacctagagatagatacaacgtgtgataaaacaaaaaaatacagaacaaccaatacacgcactgcccagtgcccactgctaggtattgcataacgtaaataacaccccgcaacattaaacagaacaaggcataaacagaacaataaacagaaaacccatactgatttcgttggttttaacccccaataataacagaaagtcagaaagtacaaatgctgatctaaacctaaggtcaccttaattgacgttcttaggtccatggcttctatagcaaaagacattgggccgagcaaaaattatccccaagagcttgcaaaaggcagggattttgagacgaatggtggtaggcagataccttgttcttctcccagagggacttctcggggcagaccttggcgacgtggtccgcggccttgcagatgaagcaccgctccccgggccgcatcccggggacccggagcgggtgcttcgacctccccgcgcctcccccacccgccttactcgtcttcttgaacatgctcttcttgttgttcttcttcttcttggtgccgtcggcgggaggggtcgggttggcggggaagaggcccgggttcgcctcgcggaagcgcttccgcgcttcccgctgccgcttgttcgccatcgccttgggctacggacgctctctcgccgtcgcgcgtggtgctgtcctcgagcttggtatctcactctctctctctctctctctgggcggcggcgcgcggcggcgggggacgggagtcgggaggggagcaagggaacagccgagcaaggagggcttcgttttgggaggcgctgacgctttgagattcgggctcacgccttgatccaccgtccacgcatctagaagcagtgggagccactccgcgaaataacggctaaacgaggggtatttctgaaaaaggcaaatcagggatctttttgtaaaattcgcgtcaagcgatctttttagataattcaaaaaaaaaaaaaaaaatggattacatcgattctgccataagacatacttcctccgtttcacaatgtaaatcattctagcatttcccacattcgtatcgatgctaatgaatccaagacatatatatgtcttagattcattacacaatgtaaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagaggaagtacaaccataagtttaataagaaaaaggtaaagataaaaaatgtaaggggagaaatctaacgcaaaaatggtccagatgtccagcagttcagcaatcagcactctagactgaagtattgaagtcaatggcaatgcaatttcctgcatcgagtaattcagcagccaaggcaatttcctgtaaggaaccaatggatttacaggttttacagctactagccccgtctattcaaattcaggtacagatttcatcagtggtacaaactggactgtccaatcaacgtttatagagagactcccagaggacaccgaggtcaacattgcctccagaaacaatgatccctatcttactgctctcatgccaagcagagctttgcttaaactcgtcagagagggcggctgcgaggcctattgctccactcggctcaacagccaccttcagcatctcgtagcacattttcatggcgtccacaatggcattgtcatccacaacaatgatatcatccaccaagtcgcgcaccaccggcctaaaatgcagagatcaaatctaagaagttttcttgaagcatgactgcctgctgggtcaatagatatttcaaataaaaccgcataaatatttgcaaatgcatttggaaaagattgatgctgacaacaggttaacattttactatggttgtaattagtgtggggaatgcatttggagaagattgatgctgagaatcggttcaatgtataatgctttaccatgtcaggtcaccaagaaaagctcgaagtccatcagcaatggtgttggttgaaggcaatgttatgatctttccagcagccttggactgggcagaatcatcagcaccctttggttctgctgccagaatacgtattgaagggtttatggccttggcagccagtgccacaccagaaattaaaccaccacctgtagtgtagccaaaagtatatgcatgcgtcaaaatagaaaagaaagacttgtgttacagaagaagttaatacagtagagtacagaccactgattggaacaattattgtgtcaatttcagggacttcctccaaaagttcgagagacactgtaccttgaccactgaaagaaaacatcatatcagaatttgcatgattcactgaaaagttcatgtttgctattcaataagctaagagtacacattttaaagtggcaagacatggaaagaaactaaggttgttaaacacaagctgtatgaaatatgtcaagtagatattgccctttttagtctaggctggtatataaaaaaaatcatgaaacctggatgaaatatgatttaagagtaatgatatcatatacagtttgaattaagtgctgatttcatgaattgatagtgaaccaaggctactatcaagtaatttcatatactcgtaagaagaagagcctatcaaagttcaccccgctctgtccatttcaaatcccaaatggacttcttttgcatcaaagtagtaagctcaggaattgggactaccagataaacaatagagtactagtgacatgttcaatccacttagactttagcagcaccagtatctaggggtatgatatgttaaagcaaacagcttttagtctctgtacaatgtgttcatgatttgagatatgaacaaactttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagtgactctcacgccttctggaagcactcgcacttgaagaacagctgcttccccactatggcatcgatcgatgttgatgacagaacgggcgtcttgtgcacgtatggtgcgatgcgagcctgcgcctccctgatggagtggatgtccgcggcatagccatggctttctgcgccatcgccgccacttccacctctgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtggagtagtaactgcatcaccaggaaggcaatcaacagagaaaaatatcaagaactatatgattcgagcaggcaaggtgactcaagaaactaaccgaggatttggaggagcaggtgcagaaatcttgcgcggagaggaatccgaagcaaggagaaatcgcctaaccttgagtgacagtccgggcggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagtaatagctattaagccgataataattatactcgtcaagcatttcttgatcaatctgtgatcacgtaatggcggtagatacagaaagtattctagttttgcctttagggagtaatcgatcactgagtgtgagtcattcgcagatcaccatacgtaaggaaaggatcacagggaaacgctcatcactgtcagtgttccccagggaggtcatgaaatctgctcaatggggcacggcatagtgtattgcctctattttttacaagcatttgtcgcgcttgactaaaaaatgcacacattaaggaaatcactgtcatattaattttgacaaaaatgtcatctgctaatgctgttgcatgaaaaaatttgacagttatcatctgctaaaagagaataagagaccatattgatgattggctcctgctaagggtggagatcgctctatgcgggctgattccagagttgacattcacattttgcctgggcactaaattaactacggatagatacagcttagctggacgatgacttgccacttggaatgtcggatactgcttggcttttcttcagtgattccgtaggctactgctacaatcgatgtcagtagtgacacctgcctctacctgcagttcttcaggattcatgtactaagaacccactcaggaacaaccttcccctaaacgagctgaacagctagtcttaaacaaaccagttgtttaactagaaattaagcagccagctcaactgattgactgtcaggttaagctatcgcctatcggatgacgccacgatgcagtaaaacaaaaaacagcgccttgattaactatcacgcaactcgatcggattagctcccatgtgtttgacttttggatgccaactttgcgttaaatcgtccgagtttgaatttttcgcgcgattttaaacgaagatgccagatggctcttctctaaacaacgcttaaagataccatcagagcaagaaatctctgcgtggttcgagagattagctgttatccagggagaaccgtcacctgtttttgttactactccagttaaaaataacccaaacctgatttgacttcgattgtttttgaaacgccggccggttcgcttacacgtctgtgcttgaaaacaaattaatctgagttgaatttgattcgttgtttcaagaggatttcctggcagcatgcccaaccttgttcggctgttcccacatattctataattcaaaatttgatgcgaacgattgcagacgcaagtatgctggcaccacaagcgaacgaagcaaatccaggtcaaatttgaatttaaaactttttctatccaaagcgctccggtcatccaggcgtttaaatatttattcggggagtacttgacgtgtggaacgtttaaacgggaggcgtgatttcaaattgtaaacggcatctttgtcttttgtgtatgaatgtcttagcccgaaagacgtggacagatgcattttcaaaatgacctataccctccgtttatgaatctggacatacctaaatgtccagattcgttatgtcaaaattcgttgtattatactaggttaatctatttttgaaacgaatagagttattaaaaggctgcatgttaccgtcttccagagccttccagcccgctcaaaacaaaaagaaaggccctgaaaatgtcagcaaacggtagtgatccagcccacgtattcttgaggcccaagcccaagtttgattgtggaaaagaatctactatacgcacacacgtccataacaccggaacgcgcatcagcgcatcactgctagtgtttaatcagtgaaaaatgcctaggatgcataaaatttaataggcgttcatattccagctatatgaaaaataataacgctaaagtgtcaaacaagatttggtattactcgaagcacctcattttatctgtatgttaaaggcttattcacttctcctttgaaatggacactacattatcatttattttaaaagattgcaccaaagaaaaattcctatgcctccacttcaatcctttggatcgtttgctacacaaccataagaaattttcctatgtttttcaattcttaaaagtttgcacaagtattcccatactatttctacatttttttctattattacattttgaatatcctagaaacttaacaagccctaaacttataccattcacgttttgaatattaagtaaccatcgagttgtattttttgtgggggttgggggggtgtgataaatcttctcacactttggtttgtgtttaaagcttgaaaacctcctctcccattgacccatttatttgttgaaaccacgttttcgtatgggaactagaattgattacctgatgacaatgtaaccacatcacatctatttgtaacataccatacctgttaaataacttcccattataaagatcttaaataggagtacagtctaaataataatgcattgcaatctgaaaaaaaaaaacaccagtttcaagtggtgcacttaaccatgtcacaagcatatgctcgaaatgcaatggcgcctgacgtgtaccccaaccaggctgagagagcggtcatcggtcgacgtcccaactttcttttcacctcacgctacatgttgcagcgtttgcgccgttgcgctagcatttatgaggtgcacccataatttttcctactccaatgctgcgttcgcgagcactttcgtgttgcggttttccaatacgtaaccatgcgctagagcggtcgcgctctcttttttctttcttttttcattttttaccctctttttagtttttgagcgagcacgacgatccaccccaccaccccggcgcccctcacgccgccctccccgaccctataaattcggccatgtttaaaccatttcaccacaaaccagcagcaaatcaaacgatcaaattgtaagaaaggaaaataaaaacagaagccctcttccccaaactcgagggggtcacgcgaacacgctgccaatggcggcgagcactcgagccctcttcctctcctgcttccacggaagcggcggcggcggcggcacttccgaggtgagccgccgcctcgtgctgcggccgcggtacccgtccatgccgcggcgaccgaggtcggccgcggtcgccggagagggaggggaaggaggaggaggaggaggcgacggcgatctggaggcggcggccgtgggggcggaggaggaggagaaggtggcggtgttcgaggtgtccgggatgacgtgcgccgcgtgcgcgggctcggtggagaaggccgtcaagcggctccagggcatccacgacgccgccgtcgacgtcctcgggggccgcgcgcaggtcgtcttctacccggcgttcgtctcggtgagtatcgaaggctccgtcgctccgatttttccatatattttttttaaagcatgccgcgtttcttacgggctgcttgcttcccgcacgaccagattgatcagcctgtggatagctaggtaaatttaataaggggaaaaaaatgaatgatgctttgtgtgcgacatttttcggttcatactccataccgttagttgcgggtgcttatacgcaaagtggtttgatcttggaagtaggtacacgggaactttattaaattccaggctcccaggctccgggctcccagctatttagcgcgtagagacaaatacatagctgtgtaacattagcagtagatagacaggtagcatatcagacacactgattaaagcatgtttttatgaacatgttattagaaatgtccatacgcatagtatcacgaaaaaggatttgagtgagctttaattgatgctccacaagttcagaaatacttgaaatgtgaggtgggttcgtgaaaagttctctttgcggtttagaaggttacaagtagacatctttgcttgtgacgttgaactgctagctgcttttggggatcccttgaaacatggattggcctgttggatcccaccaactccttcagctgcaagtattaagatttgcacagacctgtagtttcaatatgaagacgtatttgataaaaaaatggacgtcctgcttattgtttgtagcagacaacctctgcttctggacagaaagtagaaaggaagaacaatctaatgtgcatgtgccatgtaattctaatttacctgatattcccaaaacgactgtttcaagttctttttactgaaatcagaatttcagatttaactaactaattttctgtaccacgtaaactttgtacttacctgttttgcttggcgacttttacactgttgcactcttcattctgttgcaaagttccaaattgttcatttggtgttccttccactagatgcaggcatatgcctgattagttactactaatactacaagttggaatatattttcttattcaggaacaatttgttactcacgtttatcatctcataattacgctctctgatcagtggcgcatttggggatgcaaaattgtaatcttattccccatcattattatcctgaatatattttcggaaaaactaatattttatttgatcaagatgtgtcgcttttaatcagtatcttgaaatttattagaacgaaagggggtgccttttctattattggatgtcattttcccactgtgcaaggctgtaagttcactgttaaagataatttcatttgatccccattgtaggacatgaaacaaaccaaagatatttcaacatagtggttgcttggtcatgcatttccttatttgtgtcaactctctctgcatctagtaacttttggtcagtaatagttagaagatgctggcacacttatggataaagtacattgcaaaggactgatattacaattcgagaaataatctttgatgtaaggattgaagttttgtttacaatcttttgagttgggtggcctgtataacacaaacagtatttcagttatctctgtcaggatcccactatgagctgaagcctgtctttgtcaccgtcccattggatagtgcctctttcttcgtagcgctttatattgattgggaattaaaaagaaagactatttgtgttttggatctgttgaatttctagaaaacatatattagttccattgcattttggataactttgttgttttctgtatttgatcaacatctaacagaacattttcatagtggtaccctttttccattttttcaatagttttacttcatgtttttacattacacatgtccacatgtttcaatccaatttttcttcctttcttatatgtttggaaattgtgctcatcaatgccatttgacaggaggaaaaaattagggaaaccatccaggatgtgggctttgaagctaagctgattgatgaggaagtcaaggaaaaaaacattctagtatgcaggctgcacataaaaggaatgacctgcacatcttgtgcgagcacagtggaatccatcttgcaagttgttcctggtgttcagagagcttctgtcgcattggctactgaagaggcagaaatccgttatgaccgtagaatcgttactgccagtcaactaacccatgcagttgaagagacgggttttgaagcaatactgatcaccactggagatgatcagagcaggatagacctcaaagtggatggcacactcaacgagagatcaatcatgatagtgaaaagctctgtccaagctcttcctggtgtggaagacataaaagttgatcctgagctccacaagatcaccatctcatacaaacctgaccagacaggtcctcgagacctcattgaagtcattgagtcagctgcctctggtgatcttactgtatcgatatacccagaagcagatggaaggcagcagcatagacatggggagatcaagcgatacaggcagtctttcttgtggagtttagtattcaccatcccggtattcctcacctccatggtgttcatgtacatcccagggctgaaggatgggctcgaaaagaaggttattaacatgatgagcattggtgagctcttgcggtggattttgtcaacgccagttcaatttgtaattggccgcagattttatactggtgcttataaagcgttatcccacggctcatcaaacatggatgtactcattgctcttgggaccaacacagcttacttctactcagtttactccatcctccgagctgcctcctcacataattacatggcaactgatttttttgaaactagttcaatgctcatatcgtttatccttcttggaaagtaccttgagatcttggcaaaagggaagacctctgaggctattgccaagcttatggatcttgcaccagaaactgcaactatgttgatatatgatcatgaagggaatgttgtgggcgagaaggaaattgacagtaggttgattcagaaaaatgatgtgatcaaagtagtcccaggtgggaaagttgcttctgatggctttgttatatggggacagagccatgtgaatgaaagcatgatcaccggagaatcacgacctgtggcaaagaggaagggtgacactgtcataggagggacggtgaatgagaatggtgtgcttcatgtccgtgcaacatttgttggatcagagagtgcccttgcacagattgtacggctagtagagtcagcgcaaatggcaaaagctcctgtacaaaagtttgctgatcagatatctagagtctttgttcccctggtaagttcagtttcatcgtggtaattcaacggatatcatttcttatcaattctaaatagtcttcttcatcctttcaggtcatcattctttctttgcttacttggcttgcttggttcttagctgggaggcttcatggttaccctaactcatggataccatcttccatggatagctttcaactagctctccaattcgggatatcagttatggttattgcatgcccttgcgccttagggcttgcaactccaacagctgtgatggttgctactggagttggtgcctcacaaggagttcttatcaagggtgggcaagctctggagagtgcacagaaggtccataaaaaaacattgtacttttagatgcacatgtttgcaaacatcaaattattgacaaattttttatggcatttataggtcgactgcatcgttttcgacaagacagggacactaaccattgggaagcctgttgtggtcaacacaagactgttaaaaaacatggtcttgcgtgaattctatgcttacgttgcagcagcagaggtatgctttcaagcttgctagatctttttgattcaatgcctttattacttgtagcaaaatatcattcctttgtgatatatgaaaaggttggttgagggcatagatgtatgcctagacccacccaagttcaagtcctcatcgaggcgaattcggatgcctatttcttcttaattaattaaaaatgtcacctagttcctcctaggttggttaaggttcttttgttgtgatttgtaaaaagaaacattgctcaaattttatcggttctggtcttcaggtcaacagtgagcacccactgggtaaggcagtcgtggagcatgccaagaagttccattcggaagagagccatgtctggactgaagcaagggatttcatttcagtgacagggcacggtgtcaaggcaaaaataagtggcagggctgttatggtgggaaacaagagctttatgttgacttcaggcattgatatcccggtggaagctttggaaatcctaacggaagaagaggagaaggcccaaacagcgatcattgtggctatggatcaagaagtcgtgggcattatctctgtatctgatccaataaaaccaaatgcccgcgaagtgatttcgtatctcaaatctatgaaggtggagagtataatggtgactggggacaactgggggactgccaatgccattagcaaagaggttggcattgagaacacagttgcagaagcgaaaccagagcagaaagctgagaaggtgaaagaacttcaggtgagctatcataaaatcttttgcatgtctcctggttttttttgccgtaccgttatttggttattcacaccctccgatttttttttactcttgcagtcggccggaaggaccgtggcaatggttggtgatggaatcaacgattctccagcgcttgtatcagccgacgttggcctggcgattggcgcaggcactgacgtcgccattgaagcggccgacatcgtcctcatgaagagcaacctggaagacgtgatcaccgccatcgatctgtccagaaaaaccttcttccgcatacggatgaactacgtctgggcgctcggctacaacatcatcggcataccgatcgctgccggggtgctcttcccgtcgacccggttccgcttgccgccatgggtcgccggcgctgcgatggctgcttcctccgttagcgtcgtctgctggtccctgctgttgaggtactacaagagcccaaaactgggccgttgatcatgcagtacacacgcatagcatttgcttagaataagaggtgtagatatctgttgacaatgtgctaatgtggttctaaaagaaatgtgctagtgtgtgttgtgtggcacctgaaatgtgtacattacctacgtatatatgcaccgtgtgtttacaagtgttaaatatggagcactttgccaacactagcaggtgatacgttgtagtgcaatccatctaatcttggcacttcctaacaatggaggggacaggtcgtcaatctcaaaagcagaaatgctaatgcttcgtgatgatgcccgggtttcccgtgcaacttggctaatcgacgttggtagttacctaactctttttctgggtggcatcatagtaacctaactaagcagtttagcacgcaacgcgcaattgagcacacttcgaaccaaaagatgccctgaactttactactactacctacgtggctcgcagtgggaacatttggtatctgagctgaaactttgcatgggaatttgggataatttggccacttgcattctgagctgaaagatagtgctccgactagggcagtggagctatcttgccgagagcaggcaaacacaactggttcagtcttcagcttagctacctatacaccttcgctcttgtggccgatcattgtcaagggccataacccagccaccgaattaaggcttctacctgatccactgacctcattgcacttgatgatagtatacgatcatacgactctggaaaacatgctcgatggctatcggttgcattattgaatttgttgcttgatccgccccatgaacaacagtaacccatcataaacattgggacctgtagtgagtttttatgggctccatagcctgttaaagcaaaaggttactttagatccttaaataaaggtctctcaaccacaaatctagatataaaataaccctaactattaaagccaatacaaatttaatccctcagtgagagatcgagcaggaattcctaacggcggtgacaccgagctaggatatcccctctcttcaaagtcgctgcagctcagggtaggtgtgctatacgctgttgggaagagagagggcgagggagtttaggctttttttttataatgtgaatgacatgtggatcttatatttttaaaagttttaatgtaccattattactaacatataggtcccattatatatttatttttattatttttttcagatggtgtcacacataaactccacgtcaaacaaagactaagtcaacgtgttatgtaggacaaaacaaccatctaaaaagatcaagagacttgatttgtataggttttgctagttgggctacgcattatagctggttttacaattgagggatacgattcaaaactcgactcctagacaaaggacctacaattggacgttatcccctgttaaaaggcacacggctagaccagaccagaccacctacgttgatcgttcatcgtgtccgaagcctaataaagcccaaacaaaggattttcggcccagcacagcctagctccacataggagaaagtacacccaaggtccctcaacttgtcatctaattacaaaatcgtcccccaaccgcaaaaccgcacacaaggcatccatcaacttacaaaaccattgtagactagatcactcggcggttttaaccctggttttgtccgaagtggtggctgagtcagcgtgagacccatgtgggacccacatgtcattgaaacattagtctattttcccacacttctttctatcccctcccttccaagcagatcggcaacggcgtggggagcggccgtccggccggcggagcgggcaggcgacggcgcggggagcggccgggcggcgggtgctcgtcctcctggtcatcgaggccagtggccggcatgctggtcggcaacgggcgcaagcaccaggctctgacgacgaggttctccaagacgggcgcttgtccccccggtctgcggcgaaacggcattcggcatggcggacgaaggcggcgcaacatccgggtgggggagaagcgagcggaggagggtggcggcgatgaagcggtggagggcggcggcgtccctccccctggtggcgatggagacccagcggcccttccacaggcggcgcaatgcacggtcatcggcaccaccatatgccggccgttcttgtgctgccgccaccgccaagccgacaccgacgccggcggcgagcgcggggaggcgttgaccgagctggaggaggacgacaagatggcgcgcggcgctggaggactcctcatgcgccgtttgccgcttcctccactccgccgccctgctcctcgtcgccgtccgctccatccctaaggagctctcccctcgcctcctctggacccccgccttcgagttcatcgccaacgaccgtggccaccccacctcctccattccacgcggtggagctcgccgacgactgatttggacttgggaggagctcgccggcctccccgcgcctcctctgggccctcgccttcgaactcatcgccgacgaccgcggccaccccgcctcctctctttccacgcggtggagctcgccggcgatgaacgatttggacttgggaggagctcaccggcctctccgcgcctccgccgtgcctccactctcgctcgttcgctggcctccgccgtgcctctgccgatgctcaaggggagaaatgggagagagagagagagaggagtaacggaggggagggagaagagaaagggtgttgacgtggcatcctgacatgtggggtccacatgggtcccacattgactcagccaccacatcggacaaaaccgtggtcaaaaccaccgagggattttgcaatggttttgtaagttggggatgcgttgtatccagttttgcagttgggggacgattttgtaattcgataacaagttgagggaccttgggtgtactttttccctccacatacgatattcgtgttgcggcccatgaggccatagaccatcagttaccccagcccgacccatcgtgctgcaagcctttgcaaccatcgacagttgagcaggccccccaaacgcgatgggcgtgggccgcgtggcgataatgtgtgcgccccgctcccctcatatccgtgtccgtgcacgagtgaacaacccaacccaaccgatgcgcgacgcagtgacgcaggcacagcgagttgaccggccgcgccacgtacggttggttcctcctcccaacacgcggcgggacccgtctccacgagccgccgttccctagaacgcggcggcaacgagcatcctcctccgcgtgggccacacgctgcgtttacaagcgttcacaccttcggcctggccttttttatactcccccccttccccaaggtgatcacgtctcgtctctgtctctcggcccaccgcttccatcgttcgtcctcgtctccacgctaccgtttcgcaaccacccgcttcctcctccggagaccgctcggccgccgctcgctccagcatggccgccgcgccgtccgccacctccgtccacgacttcaccgtcaaggtcagttcctcctctcggtcggcggcgctcccttctcgaagggatctgtcctgcagtgattgggatgggctttccaaaacccgaacccgctcgagcagtcgagccgtgcgtactttggggggtgggtgggggggggggtgcctgtaatccggggtggtgcttgacgtgaatttgttgagcagtagtaattgggtgtttcaccgaatttcttagcttgttttgcttggtgcgagggcgtgcaggatgcaagcggaaaagacgtgaacctgagcacctacaaggggaaggttctcctcatcgttaacgtcgcatcccaatggtacttaattcacttcattacgccccccattttatgatggaattttactactacaccgtctacacatcaacaggttgatgtaggattgttttagcggaatggctagctagaaaacttccgcaagtttttttttcccccaaaactttcagatttgttgtcttttgccaaagagaataataaactgctgcaaaacagaatatcactagcagattcagagcatccccagccctgttgagcagttgaactgaaccggtcccatatgaatcatgcaaatatcatgatacaagcacagctcattaactcattaactcgtattgtgaactgcgatactgtctttgtttggtctactgcaaagatggtccaaatcaataggtccactgctgcttattttatggaaccgttttctgcataattgtccttatctgacgtaggcagctctatatatatttttttatctatatggaaccatttcaccttacaccgctaagcattttcttcgaccaattatttcagtggcttaactaactccaactacactgagctgagccagctgtatgagaagtacaaggtccaaggtgtgtctttgacccgttgcctttgtatatctttgtatattgtaattgcctttgcatattgtactccttcaccatggaagttggaataattatctagttcatggtcacatggatcattaagctttagttattatatgtgctagtagttcttcactttaaacaattccggttgttgtggttcaaaccgctaaggaatattaccaatgtgtgatttgtaggctttgagatattggctttcccgtgcaatcagtttggagggcaggaacccggctccaatgaggagattgtccagtttgcttgcactcgcttcaaggctgagtatcccatttttgacaaggtaagttaacgcaatacttttaactcaatcagagtaattatcagtgtgaagcaaaatgatataagtcacatgttttatctatcgaagaggtgtttctgtggagtagcattgagtctcttttttttttatctgtcaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgaggtaatgtcctgcactaccacttgcaatctctttctacaggctgaattgttaggctctcattataacatttccatactatctctgcagaaggatatcaagaagctgcttgggagctcttaaacctaaaggtcgggatctgtagagcaacctgcacttatgcactgtattcagcactgagagttgtattaataaattggtgacatgtacttcacaggttgcatttgcactatactccttgcatcctgaatctttattgtactctgtacctgtatagttttcatgtcaataaatttccttgctgtatctgtgtgtatgcatctcattggatcctttgtcggcgtgcactgtattgttcgtttattaagatagattcggccaaataaacatgcaagtatgcatttgagctgtcccaaccatggcaagcacaagaagttgcatggggggatgccttggtcatgcgttccaacagtttaagatgaatcagagcatactaatggcattgatgaacacaatctttccctaactttttcctcctgtcaaatggtattaccttgatcaatgtcatcaatgccacaaggatgctcagaaaaaatttgatttgttagatgcatttcataatcctgtgtttgtcttaaatatgactccatacaaatttcctggacatgcttctgaataagcttactatgtgtaagtgatccatttttttctgacattattagtttagtactcccttcgttttt

SEQ ID NO: 74905 - DNA, 519 bp, Oryza sativa
tgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagt

SEQ ID NO: 74906 - DNA, 819 bp, Oryza sativa
  unsure (1)..(819): unsure at all n locations
cctcatttctgcctctgtaatccgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatccttcggcgccacacatacactgatgcctcgacacggttggcgatttccagtgcttggtactccgttgacaggtccaggcagtcgagaaggcactcaggagagaaatgatcagacgttatgtaaaggtattatgtacttaactaactgatttagtagtaatgataaatgaagcaatagtaggcttcagtaataccaacatgctgtcttttattatgtcattactggtgcaatttcagattgttgtggtaaaaaactcatctgcctagtgaaaaacaagatgaaantgtgatttgctaaggngagtatgtaaangattctttggtgataaattagaattaatctataccagagtctt

SEQ ID NO: 74907 - DNA, 999 bp, Oryza sativa
  unsure (1)..(999): unsure at all n locations
gaaatatgttccttatgaggaaaataatctttactggttttattatggttaaaaacagtcttcatagggtttttaatttcggatttttaaagtttagagcgcatattgtccttaataatcattaccagaacatgtaacaaaatatgttcttttcctagttagaccggccggcacctgttaccctcncctttatattagttattttttggcggaaactagataccttctggacagcagcgtactccatcctgcaatcctgctgttacgccttgccatgcataatcaatgaaatgtgaagcaactcctgttcggatagcgcccctcctgttattagcggctttaagtatcccggtcctaaatacgggccggatcagtcactagatctttgcaccaaacactagccatctcgtccaaagatccttagcatttggtggtacgtgtatcatgaaatgtccagtatacatcaataccatcatcgccgaaccctacccgtacgtagtgtacgtagtagtagtacgcatcgtcccaatccaaccataataggctcacgcgcgcacggcccgatccatccgatcagcggaccatcacacgattataattcccgagaaaagccatgcatgcatgtacgccccatgccggccggcggcctaacccggtgggccactcccgaccggtggttatccagacatgtcatgctagtgtgctaccgctgctacatgcacgaacagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaatatccatcacacaacggccgtcgaaanaaaaagggctctc

SEQ ID NO: 74908 - DNA, 13567 bp, Oryza sativa
ccggtcgtcgtcgtcgtccgcccgcgcgtgctggctctgcagcccccgccgcagtagtgggaccgcgcgtgctgggtcggggaagcccgcgcaggcctgtcacgccgccacgatcccacgagccacccacaacgtaacacgagccgatcgagtcccgcgttttcactcggcctacatgggctgacgctgcggcctgcttcggctttgggcatcccgcggcccatcttctgcgagccccccgggaacgtgcggcccgcgtgataatcccgtggatatgggtccacgggttttcctctcctcttcccatcgcatccgcatctcggcatctcgcgtcgcgacccgcgacccgcggcggcgcgtcccgaatggcggccgatcgcccgctcgcgagggttgatgagatagcaaggcgccatttccaaatatttcgatccgcagcgtaatctctctcgcgtgcgccggtgcgcgatcccctccctccctcctcctcaatcccccagatcgcgtgcgccgcgggctctccccgcgttgactctccagcatctagatccgcgcctgcgctcccgacgaggtcggccggtctacggtcaccctcgtggtttccattgacttgtttttctcttctttttctttttttcccctcttctccccaacctcgcaacaaaatcggcggctatcctcgtgtttcttcttcgctccgtggccgcagaatccccccaccgctgttcttgcggcgccggtgttcgtttgaaaggtgaggactcgatctgcttgccgtttctccttctgggcaggggcaggtaggcatggaatgcgatcttgggtggtccatggagggattgatggattgatagttacatggagtttattggtgtacttagattggtgggggatcaattatttcttgagttctggttgtgcacgaaacctctatttaaatcgaagttttcctattcatggtgatggggttgctcctacctaacaaatcgatactccttgctctgcttattctcgctttttatttaatgggcagcatgtatttcatgacgcatccgtcggcggcgacgaactaattttcagttctttatgttattcagcagttggctgcgctgtcctgggaggcctcagcagcagcagcagcgagctttgctcttgtgagcgcttcgtgtgcttgcagctgcgttttattattgcgtcttggagctgtcacgacgtggttgttgagaggaatctatcatcccttcacagttgcgaggaaagcttcctgtggtatgtgttgtgctttgttttcttgtgggcaactggcagattgcaatggcattattaggaccttgtccaccttgacttagacaaactgcgaattaggtggtgtgacatgtgttgatattttcttttccaatcctctgatgcttacaacccggttgtgcttgtgacgtgcccctacctttgtttgacttcaatgtgtagtataacatggttgtcctgggcaagctcattacgtattccccatgagctatttagttgattgggcgatgtggtagttgcatactagtcgtcctttcttcccttgtcacctttggcggcctcggcttgcttaaaaggatacatatgcttttgtaactagaacatttgttgttgaatttggattatttgatcccatggcgaattctcgggctagccgtttcaaggtatttctttatcttgccttggattcctcagttgtgatctttctttggttgtcatcagtttgatgtgttcttactcctttcttgaagtatttctgttcttgctgttcagttctgtgattttgtctgaaaactttatctttgtgcttatcatctgcctgctgtttaatttaatccttgaccttcttgagtcctttcaatgcttgtactgagttttttgttaatataccgtagaaaaacatatggaagcttagagatcaatgttgagcgagttatttttatgaatcatgcttttcttgtgtgtctgtaaagttgaaacagggacatcttttttgctaaatatagcttaaagagggatggtatgacatgtgactagagttccatgatttctttttctgtatcttctcagtgttgtaaactcatattagaatgaacatcatttgacgagcacactttgttctgtgtggtaaattagcatcttacatctcacatattgtggatcaggccatataacttatttattttttgcaatatgtatgaattgaaagtgcttttttttttcttcttgcatacttgattctagctaatctagagagtttgatcactcagtattggatatgtctacagctatatttagctggtgttcagagcactattatgttgatgtacattttagctttctgctaacaatttttgtactatttctagtccaaagtagagatctttttaataagccaagtctatataactgtgtgagtggagctaaaatgatgagtatggtgtagtatgaagctttgattgggatgtgaaaatccatgggtggaatcaggtgcatggggtctatcaagaaattagataattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatctatcagagccctcaaaagaagctgcatcagctgatgattcaagtgctgtccagaaaactggagcatggagtaacacgttgaacattcttctgcaacaagcttcagtctatggtgtggctgctggttattgcctgtcagcatccctgctctccattatcaacaaatgggcagtcatgaaatttccataccctggagcattgacagctttacagtacttcactagtgttgttggagttctcttatgtggacaactaaagcttattgagcatgatggccttaatttgaggaccatgtggaagttcttgcctgctgcggtgatgttctacatctccatcttcacaaacagtgaacttctactccatgccaatgtggacactttcatcgtgtttcgctcagctgtgccaatttttgtggccattggagagaccctttatcttcaccaaccatggccatcactcaagacatggctttcactttcaactatacttggtggaagtgtgatctatgttttcacagacaaccagttcactgtgactgcttacacctgggcagtggcatatcttgcaagcatgtccattgactttgtctacatcaagcacgttgtcatgaccattggcctgaacacatggggccttgtgctttacaacaatctggaggctttgatgctcttccctcttgagatgcttctaatgggggagcttaatcagatgaagggcgacagcgctaaagtgacaaactggctttcatctgatgtcattcttcctgttgctctgtcttgcttgttcgggctatctatatccttcttcgggttctcctgcagacgggctatctcggcaactggatttaccgtgctcggtatagtgaacaagctcctgactgttgtgattaatctccttatctgggacaagcatgcctcctttgtgggaacaattgggctcttgatctgcatgtccggtggtgttctctaccagcaatccaccacaaaaccaaaggcccccaaggctgagccaaaagaggagaatgatgaggagcagcagaaattgctggagatgcagcaagggctcgaaagtagctcaactcagaagcaagcgtcatcttaagcctggtaggaaatttggcgtcgatatcttactctcaacctcaagacggcttccctgtatcatattatgggatgctaaagaagaatcatttggccaaaggatgtttgttcgtcatgctagaatcctgtaatgctgttggcatgaaaaatctcagagaaaacttaatgtcactttaaaattctttgtttagtggtataccgtaattcatttgttagacctgtggtagggtatcaattatcaaagaatcctgaaacatactcgaacagaatactccgtatacaatatgctgtttcattgataatacagggtggttacccttttccatgcagtatatttgtttttgcttttcgttttgtgatgaaggaaaattatcttttgtactcaaattgcctgtatattatgtattctgtattgtgttgaaggcttgaagcaggttttgtcctgagttactccttatctgtgcacttccaggtcctggctggcgatctaattttagcccttcgacactgaaaatgatctcctgtttattttttttggattcagggattcagattcaagtgaactcggacttagcgtcgcgttcactgcctttgatgggccgtaatacgcatcgcgtaggacgggcctattcattgggcctgcaacttgctctgttgtcacttcgccacggtgttcttctccacatcatcctctataaaatccacgtcgattatggatttgcagtagggatgaaaacggctagagaaaaatgattatgaacattgttcggagcggataattctcagataatccagatacaaatacgatatacggtgaaacataccttatttctctttaattctagactttcaacctacctctttatattttctgttttaatagtagcccatctcatgacactatcctgcaccaataatattatttaaactttcaaatgtttttataaattatactatagtttatatattataatattagttagacatgtgtttataccaacgctgttgtacatgttaaacttaattagcattgtttagtttatgatcagacttaggcgggagttcccaattccctaccctcgttttccgcacgcacgcttttcaaactactaaacggtgcgtcttttgtaaaagtttctatacgaaagttacttaaaaaaatcatattaatccatttttgaaaaaaaacagttaatacttaattaatcacgcgttaatgcgaacatcattttgtgtgctgggaaggaggaacccatcctcccaaatacagccttaatataaaacaagctaattatatgtgatgatacttatttctattaaaagttaagacggttttcgtgctctgaaaaatatttgtttatgtatttgtgccttagcatattcggttcttatttgtatttgaggtaattaatatttattttttgtattcgagctattcaaatttatttttttgtccgaccaaaaaaaacgaaaacaaatacattaggagtatcatctgtttgtatcagctttgttttcatcctagtatgttgtatgctgtttttttttcgatggtgagaacgatatgtgaatgtgattaccatcgattcataaattaatcgaggtagagaagaacacattttctcgcaactaaggataagactatcatatttttctcctgaaagaaaatattatctttttgaacttcgaaagaaaaaaaaaacgcagtacagtaccagtagtactgtatttttatctctctacctttattcctcccttcgtactttcgtagccagccagagaaaaatctggaccgtgcattcccttctccaacggcccagatctctcctcccacgcagattccacctccccgtttgttcgctccagtgcttcgcacaagcaagcgcacgcacgcacgcgcggctttctctctcctccccctctctctccccttcacctccgcacccaacaatggcgcagccagagaaggtctcgtaatccaaagcggcccgcctcgaatcccctcgcgcagccgccgccgccgctcgatccccgcggcgtcgcgcggggtcaccggaggagagccgcctaacaagcccctcgcgagccccctgggggtattctgctccagccggaaggaatccgcggtggaaggccgccttcgaactcgcggagaggtatatctatatctcggagcctcgatcctcctgttgagtggtggctcccatttatgtagcgcggtttctacgggtgtttcgatccttgttcgatttgatctagggttttggttaggggggtggggggtattggttggttaatcgcgttgttggtggtgtgagtttttattcatatattattcggttagtgtgatttttgtgcagcatatagtagcggactagcgggtgcttatgattggcagcgattttgcaggagattttacccgagggtttcgattccgagcttgggatgtacggtcagggagggaacttcaatccgcagtatcggcatgctgcgccaccgccgccgccgcagcaagctggggtaacgggtggcttccctcagcaaccactaccaccgccgccgccgcgaatggcacagtatccgcagccgccagcaatggcggcgccgccgcctggaccgtaccagcacaggatgccactggttcagaaccaggcctacccttttgcccagatgcatcagatgccaatgctacctcagcagaggggttacgcccagatgccaatgccagggccgccatcgcagccgccgcctccacaagctatgtatcaggcccatcctcagtatcccatgccagggtctctccctccaccgccgccacggccaccaagctttgctccagagaatgcgctgccaccatctagccccccgcctccatctcccccaccaccaccaccgtcttctccacctcctgtgcccccttcaccaaccgctgcccccacaactgggcagtcatggaattcagagccagaaagaaaagaaggtgccactgccacagatgttggtcatgatgtcaaaactgagaaggtgactaatcagctaattgtctctgatgactcggatatggatatggatggtaagcgaacctacccgtcttctgcctctcaactgtacactgttaatttgtcacaattctaaaaattagtcctgcatgctgctccactctgtatttgtagtcaaactttgtcttactttgtgcatttattggacatgcttcccatcttattcctacctgatataatgatcaccactgtttcttgcaaaaagactggtataatcctcctgtcatcagaaatattgttgaatctccatctgcaggacagtttatatgatgataaactattaatatttattttcccttttgtagctaaagcaccaaacactttacttctcaattgatatgataccttaactcctgtgttaatccactgctagatatttactttatcaagttaaatttcagctgacgaggactctccatcaagggaacatgtcagtccaatcaattcttcacttgcaactgctgaatgtactggaaatgttaacacgcgaaagcctgcgtgtgatgtttctaaccttgtcaaggacagtggtggtaaggctaaaactacaaatgtaactgatgaaggtaggagcacattccaactaattcaaggctatgcctcagatgacagtgaagatgaggatggtgcttgtgctgtcagcaaccttgtgccattgactgaaaataatgagcctgttcattcaattggtacaaatcctgatattggccatcaactccttactgaagctgctccttgcactgagagaagtttggaggatcgagagcatcaactcatgagtaagagcaatccagtgaaacatgattcagatgaacttggacatccagtcaaagaagatttaagtggcaatgattctgatagagggcaacagactagaagacatggcaggagccagtggaaacgaagccgtggccagtcacctcagggcaggaggagctgtagccctctgtcccaaaggtaccaaaccttgtaccttgccttcaacttaaattggtgcatcaatttatctccacaaattggaactctatttgttttagatttttatatgtcatccagtttgcacaagtgaccccctatgggagtctaagaatcttaaatttctttcagtttatcatctggaaggcaaagcaattctccacttgctaagcgggctaatctactcgagagcaaatcaccagatggagtgggtcagactttcagggcacaacctggcgtcaagcttggtataagcaaggatggattctacaacgacaaacatgattcccctgtaaaagttgccactccttttgatattcatcctgctggagggcacatttcaggagatagaatatctgagcaagatggcctgatgggaacaaagaagtttaatggttctccagatgatatagattgtaacgagaaaacgaatgatgcatctgttggttcctttggaccacatggtcatggtgcagttttaacttgtggaccttctcaatcagttgcttcttctgcaaatggttctgatcctcataagatgcaaaggtcaggccgtgcatcaatacctcaatcagacatggataaatcatctctgggtgctcatcaaagtctttcgagtcaacctccaggaatctcatttgcaacagtacatgctactgagaagaatatgatgtgtgatgtgctccaacctcattctcagaatttatgtcctcctggacagatgccatctggtttgagaccagctcatataccatcctcaaatataaccccactcccagggcaacagttactttcgactccagaatttcctcagatgcacttccagcctaatgttatggcaccagctaatgagtttctgcagagtcagatgcaaacctatcctgcaccagatctgcctcatcctaggccattggatttccatcctcatactctccagccagttgtccctcctcatcagcagcctgctgccatggttcactcctctttccaaagattcacaccaaatctaccaggaagtactgaatttggtgctatatctgatactgatctgcctaaatcatctatcaagccccactacaacccttttgcgtctacctttgaacaaacagatccgactctaaatattggctgtgatgttatcccaaatccagttgagtctgcttcaacaaaagcagcagaacacgcgaatgcactgtcaccttttggtctgtcggttcctggatctggaactcatgtgcgtgagaattctgcggaagttgtttccagtcggcaaaagcagcctcatcgtgaattcacttctagtgctccctatgatccactgctcgacagtattgaaccctcaagcagttcaatcaacaaaatggatcttggtcgagaggcaaatctgagtgctagcaatcataatgcatctaaaattgtgaacatagaagtggagagtaaaaatatgcatggcctggggcttgttgctgaatcggaagttgaagaatttggagaggtggcagcagatactgaagcaggtgttgtggataatttaagtcctgagcccttgggtgcaaaagactggagctcagatatgcccggtgatattgacaatgatgaatcggtggataaaaataagaggactaaggattccagatcaatgaagctatttaaggttgctattgcagattttgttaaagaagttcttaagccatcatggaggcagggaaacataagtagagaggctttcaaaaccattgtcaagaaaacagttgataaggtttctagttctgtccctaacaatcatattccaaaaacgccagccaagatcaagcagtatgtccagtcctctcaaaagaaagtgaccaaacttgtaatggtatgtccacgattcttctgtagcaatattgattacttagtttgatattctgcaaatactcttctgaccatatgttgtagttctctataatggattgtgtttagtaactgatttttttatgcgtgatatgttaagtatctaaacagtaaacacaaattttggagaaaaaacaattgcgtgatagtagggaacaaaagttgtgtgttctagtcaactttgtgctattcagttctttgatgttgtgttttgattggagatgtcctggtatctttgtgcaaggagtcttccagccacttggtaattggtttgtgagtttcagtgtcatgttgtaatatacactattaattgaataaaccaggtttatttagctattgaataaatttgaaagcacaagtactttcaagattgaaacattctgattctggtgtatgattttttttagtatatgcatataactctacagttgaaggatcccctgagccaatcctctgagccaatctgtttcttttattcagggctatgttgacaaatatgtgaagctatagttggatcagtaaatgggactatgaactggagcaatcaggacagtgtccttttcctgttgcagaaatcgtgatgggactatggactatgaacagctcacacgaatctgagctatgctatggtattttggatcatcaatttgcagtctttcagcagtaagggattccgggtaatagttctgcagaaatggatgtatttatcagaaaatcacgagtttacattggaacaattgctgcctagtcttcatagccttgtaagatgtatctttgctccactgtttctttttttcttttcttttgagtagtttgctctactatttcaccatcattaggcaagtgatagtagaacgttctttaatactgactgcatgaacgcattgctgaaaagaattatatttcttcaaggtaaatgtaaatgatttaatcttattgctacttcaatagttcaatgaacgtgttcatgtctgatttagccaaagatctccctaagaccctaccgcctttgctggatgctagtttgaccatttgaacaatataaagcgacttaaactgcagttggctcaatctttctaatgtattgttatatttacatgttacaagtaatgaacacacaccaatttgacaaatatttctcatgttgagctacgtatgttaccatcgtgaaggggatcgcattgcaagattctagagcgtggtgttgggcagaggcagagaggaggaataagttcacttaacgactgagtttagatcacgtactaaaccgcaatataagggcagtagcaatcatggtttcccaaaccgccgggttaccgtgcctcggtggtaagcacggtaaccgttgcaaaccgtacgaaaccgtgtaaaatttatcaaaattattttttaaaaaaaatatttatggaggttaccgcggttgtctttttaccgtacccccgcggtaagcgcggttaccacggttaccggcggttctgcaaaccctggtagtacccatttgaggaacctaaaaatgccataggttctgcaaaccctggtagtacccatttgaggaacctaaaaatgccatataggctataggtaccgtgtccaaattttggttccccacagtgcaaatggtctcatgggtgacttcaattttttgtttcagcccctactacttttgatttcaaccctcatgtttttttctcaatttacaaagaagtaaaaattttacagtgaacatcttacagtggagaaaataatacaaatcacaaccccacccaggtacccaccaccactaggtccacaaccctctccactttccctacccactcggcgagttcaccggcgacaccgccgcctcccgcctcttcccacctcggcgacgaactctgctgctgccagcctttccccactccccataccttggcaacgaactccgccatcggcggcctcttccactggagcagcgtgggagctcggcctccaccggagctcgagcggatcccacctggagctcgatggtgctacccgaatctcgcccggcgcggggtggcgttgccggacatggagctcggcctccaccagagctcgagcatatccgacctagagctcgacggcgccgcctagatctagcccggtgcggggtggcaccgccggacatgaagctcggtggcggatcgggcgacggattggtctctcttatcctctgttgccggctcctgtcctcctcaacgtcacaccaccatcctctcccctctcacctctccgggcgccggatgctcaagctcactgcccctccccaactctgcagatcggggggtgtggagctgtggaggggctcaacggtgataactgcggggtggggaacatggagcgttgatccagtctactatctctccccctctcctacgcgttctctgacgaggccgagtgttcttcagtaggacgcaatgggtgagctagagaaacggggccccaccatctctttcctccaagtaagctattcaccgacgtggcgcgatgaggtaactcgccacgtccctgcactgtgaagggcctaagatgtttaacttgcaaaatcggagtgcacgaggtcttcagatagtattgaggtcggttttagatgatatggcacttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacagagagagctcgcgcatgcaaggaagtatcatcgtcttcgcccatcatgttggtatccgcaacattcgttggagcaggggggaccagcctcgttccttgtcatgctcgctgtcgtgttggctgtagtgtgtgtgtgggcggcgtcggggataggcaggaggacgacaggcagtgcttcgtcacaatcaacacgctcaccatggccatcgtgttgtacctcctcgttggcgacctcatcggtgtcggcgttgtcaataatggcagggttgtctcgaacaccttcgtgggcatgctcctagtactagtgctctctctctctctctctctctctctctctctctctctctcttcgtcgatgttgtaggaggctcaccgaggggcaggacaagctgtcctccccggcgtccctccccctccctgcgctcaaagcctccgttgaaatccaccgccgccgcagaaccccttttaccccaaactggtcatgtggcggctgccgcgtgtttggacgaaggtgccatccacatcattgtggtggaaacaaaggaaaattcgatccaagaggttggggagtgggggggtggggagagagagagagagagagcatgggtttggggatggaattttcgagcttagctctcctcccgtcaatcgctgtccttctccctgctagccaccatcctaccttggagtccatagaaatgggaatagaggggaggaagtgagagataagggcccctaacatgtagggcccatgctgattcagcgttgttgatttcgatcaattagccacgtcggacaaaaccagccgctatattatcatgggacctcctttacattggttggttttgtaagttaaggaagatgttatatctggtattgcagtttaagaacaaaatttgaactaggtgtcaagataaggacctaaagtgaactaagggg

SEQ ID NO: 74909 - DNA, 9256 bp, Oryza sativa
attccgcttgctcaaatgccagcccaatttaaattctaaatgtggctcccaagaatggtggattatgcgattttccaccgaacatgcctaaagcacaatgaattgctcacggtttgcttgtgttcaggggaacataaccttttcaacataacgaaaatcagtaagattttcctccatccatgtccagcatatatgaggaaaagaatatgaaaatacccgctgagtaacaatctaaatcacactgggaaaagaactacaatgacaccctactggtatgaaacttttgatccgcttgtgctttttccgtgatcaatgcatcaagctccaggcctcaacgtccagaggatttaaagagaaatgaaattacaggtcctgatcaatagggtgccagggaaacgttcaaggcaacatgttttcatcacccagaaaactacagccaccacagccagatcatctctcttttcgcaccgcacccttggtgaccaaggccatatagcaaaaggaaggttggataagttatgcagctacaagatcaggcgtctctgcctcaacggacaacagggtggtatgcacttttccaacccaggcgtccaaccgctcgcgcaacgccttcacctgtggaattccaagtactctaggctggacccatgacacgtgaactgtgctgtccacctcatcaattatcccctctataagatgaacctgcaaaatgggggaatcattaataattctctcatattccaatttacttttaaattgtatggcaattgatggcctcatggaaatacagcacccaggctccattagcaactaaatagaaaacatcagcatggagcttttgtaagaagctgatagcagtggcattctatcttggctacctatatattctgcctttcaggggcagcattattatatactataatgtactaactgatgtagaaaagaactgtaatggaagaaaaagatgagaacatcaactaggaatactagttgatacattgtgcaaacactgaagccgtataaggtaaaagcaatagtagcatgtaacaaggagagacacaggtttgctgtgatcaacaaacacaaatatatgaatcacatgtctagtttaactgacaacgcacacccataactcacaactaaagattcacaaaacaaaccatcagcaattaaaaaaaaagacaagttcacaaaggggaggaattgaaggcagtaattatcaaataatcactatccatatacagctgccacattaaaatgacagaagcattagaagcattctaatgtctaatcttaaaaaacaatttatgcacaacaaaactagatgtttatgaatggcattcatgcattgtctatcccaacaatgaattaacatgatattggcatattgcaaataatatcttatgaaagatcgaatgtaagaaatgcaattaccgagaggctcttcataagaagatattccacatcactgatagaaagcttagtgcgctcggctataacacttaatgggatagttctgtcttctgacgcccggctacaacatgaaaaagaacacagggcttagaaggaataaaggaaaaggggcaagacatttgtggtggcatagaaaagcaagtagcaaagttgtacctaaagattatctccatcagacatagaatgttgatcttctctagcagtttccgttcattctgcaccaaagctggctgagcactgagagcagcattgtggaccctacatagttcttggtagagagctaggttgccggtgttgaatgcttgtaacatatgatagacccactccaccttggttccaataagactgttgatctaaggatataaaaatataaacaacttcagacagagatgtaccaaatgacaaccatatatgccgatatatagatttaggggccattcaatatttcaatcccataaaggctaccttgtgtctggaatttttttgtttggtatccacaagtcaatattgatttttccatgcacaaaaaagatggtttgccattaattcatgcaaacttaagtttatgctatttcaattcaagaaaatacgaagtttacataattataatatagtggttcacaattacatcattcaacattcagcaaaaaaggatcaggcataggatatttcatcattttgatatgctttacacaatcggtagcattttattgtgtcaatgttaactgcatacattcaactcatgaaatttctgctaccgatttggcaatagatgtaagttactgtgtacaaaactccgaaacttaactaccataacatacacaggtaccttggacgccttgcagttctagcaagcatcagataaaaacaactaataaataattatcagaactggcagttgtgagtaccaagaaaagccacatgtaatgtttatataggcaagcagagttaattttaatcaagcaatcaagaaacacaaaaaagtatggataaaacaaaggtggtactactaactagtggcaacaaaagaaatcatgcgtaagcaaagtccaacttacaatcgggtgagctaacaattccccaaagttgtagatgttatcaccaagcaaggctgcaagggagagatcaaatgccaaatcctgacacaagacagcatcaaagggtaaacatagatgcaagatacattattaaaataatgcgaggaggaaatgattttttgtcatgtaattgcattgttaacaatagaacataccagtttgaaagactcagagagtgactctacagtagtgtaagccagatacagaagggcattcttgtagaactcagcaaattcttggcgagccttatggtactgagatgatatccagtagaggctagcatgaactgtgggatcaacatcagtcatgctatctagagtagattttccttcgtccaaaagtttcttgcactccttctgatttcccttctccaggttaatcgcagcgatttgcatcttgacgtagagaatgggttcattgatgcgcaggtcctttgtctcgcgcaattttgtgattaccccctcgaggaaacttatagcagcatccttgtcggggtactggcgcgaagcgatgaccgcgaaatgcgcaagtttgagaagattgatcttcgtctcgaaatcagtgatgaaattgttgtagagctgtatgagggtgtcacccgtctgtaggagaatggatgccgctgttagaattgcaaaaacgcagaaggcacaacacagcagttacaaacctaagcaaggttcaaacaacaagagtaaatttcactttgggcatctttatcaaccaatatttcacaacagagtaatggactagggttaaggcttatcctttcacataacatcacatataattaaaatcttttgcgctttggaccacagcttattccctggtacctcaatttccaggtagtgaaatctgatctttaaatatttcatatgcaagtaatgaaacccaaatatttatcttcgaatgttcatatgtacttttcaaggttgaaacatgaggtttaaatctccacaaagtggcggcctgtttgcggccggatcggtatcgaatttagggcccatccagtccaactagggttcaaatcgaactaggcacggtgggtagggtttgcggcgagatccgtacgggggggacagcagctaacctaaccaagaacaagaaggcgcttgcaagagagggtgaggggaggaggtggtgggaaacctgcgcggcagggagctggaggaagtggtcgagcttgagggtgagctggtgccagagcttccgctggtagaggtcggcgaggtcggcgtacgggtcggcgagctccggccgcgcctcgcgctgcgactcgacgaactgcagcgccatggagaaaaatccccccacccaggagttggtcgctcgctagggtttggggaggagaggagaggaggcgagagggggatctgcaggcgcggcgagcggaggcgaacaacaaagagcaatctcttctctttccttctttcttgtaagaggaggaaagagtaggagacggagacggagacggagagagagagatactttgcgtgggctgggctgattggtgctgctgctgccggcccgcacgaggtcgggcctagtgggcctagtgggccttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggttcctcttgcttaatttactctaatttagatcaagttttaagctgatatgtgtatgcctaagtttgtattaaggagggtgcacacatggtgaaaatcggtgagttataactaaaaatttttttttgaccggattcttgggcaccccttccatactctacctccgccccatcagggaggtggagttaacacagtcttaaggtggagcccaagtggcgtgcagaagtttctctagatttgcaagtgtttgggaaatgcacatatgtgggctctacattttcctaaaagtaaagaaaaatagaattccaaaacaacctgtgagtgctgctcacatagggtgtaggagaaacgagaaagggatcgtattcttttaaatggagtattgcttgaagcttggcataaaactcgagtttggcttaaagctaaggccaatctaatggggtcagggttgcagttgtggttacgtacctcgctatgggtttttgactttatgccattctcccggatacgtattctcaaataccatcattataatatacttaaattatttgtcatctgtactcactagattctttctattttgtcacttttaactaccaactcagcaacttgagatgagaatgactttattgcaccatctcttccttctttcgttcatctctactttgtgtatgaacttgtcttctctctccattcgtccctctccagcatgccgaagagtctatcaacattagcgttggcgccatccatgacacctcgatgaggaagttaagtaggccccaggtggcagagctacttgagagcatagtattcatcgtctagattgacatgctggcggaagttgttgcggcgacagtcccttttccttggcatcgtcggcagtcgatgaagaaggggaaggggtagagctgcgacgaggtccttgtcaaccctgcagtcaccatccccaacaaggtgtggctcaggttgattccttgatcgacgatcactgctcggggatccaacctagatctaagcgaccgtccctcacaactccacatagggaaaaagtgacgacgtcgatagcgcaggggaagagcagagagaaagggacaactggtgcttgtaggcggaaagcttgtccgcgtgcatgaccttgtcgaagctggagcaactcgttgaccaaagggagtggagtttgaaagggtgggagagagcagataagggataattagatcttttgttacacggttggctgagctagcaagaaaaatggcaaaatagcaacaatctagtgggtccgatggcaaataaataaagttgtttggtaagatggtattggagaatatgtcgctgagaaatatggcaaatagtccaagatccccctagctacttccttctccttcgtgcgtgttttagcgtgtaactgcttcgtgctggctttttctttctataaacgtttgatgaattctgaaacagctggaagagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttccccccctcatccgccgtttgcctccaccccccacccactccaccgtccccgctctccccccattgccgccgccgcctgcgacggccgcgagctcatcccgagacgacgtctctagctagcatcgagcgttctttctctcctcgggctctcgttggtaagccctcgattccggtttcctcctgcttctcctccaacctgcccctcggattagtcgccagtttgttcctcgttagttcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtacttgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaaggcgtcatcttgcagtatttaccactgcaagcctcccatggatgacaggaacggccatcaacccgttgttccgggcggcctatcttgcaaaggatggggatagggaggtcaccttggtaatcccctggctttctctgagggaccaagaattggtttacccgaataagattgtgttcggttcgcctttggagcatgaggcctatgttcgtcgctggattgaggagaggatcagtttcagaccttccttcagcatcaaattctaccctgcgaaggtacattgatatattaacgcaaagagttcattaaccatttaaccctggaattctctattctttgtgagattttcttttaggtggttctgtacttgatatatcaagttctctatactttgtgggattttcttttaggtacattgatttatcaagttctctacaatactattgtcttctattttacttggaaaataaaatcgagtcaaattggttaaatatttaccgttgattgaacctgattaccttaccatggagttatggttaacctgggtcagttttgtcagaaactcaaccccctttcaggtttcagctaactttaaaaaaatgcagctcaatacagatgatgtggtgcatataccatttttatttgcactgttagcttccatctagtaatactcatatttatatcttttttttgctttagggattttcaagacaattaatacccttttttctttatgatgcagttctctaaagaactgagaagtattctacctgttggagatatcacagaatgtattccagatgaagtggctgatgttgctgttctggaagaacctgaacatctcaattggtaccaccatgggcgcaaatggaaaaataagttcaggcgagtgataggtgtggttcacacaaattatatagcatatgtgaaaagagaaaagaatggacaagcgattgcctgtttcatgaagtacatgaacacctgggttacccggatttattgccacaaggtaacatcaacgccatatataacaacagtgaagatcccaagaattatggtgattaatctgaggatgcattttgcccatttaatttatgttccaattttacatggcgtcttgatggaaatgaaaaatacaagagacatgtcttttcagatttttctgtctgaatgcatctggttgttttggcttatgctctattacatatttattgaatttgaagaaccccaaactcccataatcatcatgtccttattaaagcatgcaatactgacttttgttgattttagaacagattatcagattgtcaggtgccacccaagatcttcccagatctgttgtgtgcaatgtccatggcgtgaatccaaaatttcttgaggtaggtaaactaaagttgaagcagctgcggaatggggaaatagccttcacaaaaggggcatactatattgggaagatggtgtggagtaaaggatacagggaacttcttgacctgctgtccaaatatcagagcaagttggtgggtttggaagtagatttatatggtagcggagaagattccgacgaagttcgaaaatctgcagaacttctgagtttggccgtgaaggttcacccaggacgtgatcatgcagatcccctgttccatgagtgagttctcttattgttcaaaaacttccttccgtcttcttaattatttgaatgaacatgagcgtacaactagacaagtttaaccagctacttttttcattgttgttcaaaaatgagtttgagggttacatatcattataattcattgcaacaatgcaaggttactgaactaaacaaaacgttgaacacaggctacataatgaggtaagacaagaaactgagagtgctaaatcacctaggaatgcaatataactcataatatattttgtcatctatattacattcagcatatggcaatggtttgtgtggatactgaaacacttcaatttcccaacagctataaagtattcatcaaccctagcacaacagatgtggtctgtacaacaactgccgaggcccttgcaatgggaaagattgtcatatgtgccaatcacccttcaaacgagttcttcaagcagttccctaattgccgcacctatgacagtggcgaggaatttgtacaactaacgctggatgctctagcagagcagcctgctccactgactgacatgcagagtcatgacctatcttgggaggccgcgaccgagagattcatggaagccgcggagctgaaccttcctatctcagcagagccaagaatccatcaaacatccaagg

SEQ ID NO: 74910 - DNA, 3302 bp, Oryza sativa
attctgcccatcagtgtcttcttaatgtaacagtacttctgtacttatcatcctacattgtgcgctggcaaatgcttctgaagttgaatttccacggaacagtattataaactagtgctagatctttcaccaatctttattaattttctactacaaggttgcaatttgcttaagaatagtaacgtgcaagttagtagtactccatactatagtatgcaatcattaattgccttgcaagttgcagcatggttcccacacactcgtttgcacttgcagaaaagtttgcaagttgactcagccagcacaaacttgttagctgctgcttaaggctttctctggattgaaggaattttacagaaattttgatcaattcatgtaaaatttctgcgtgtggtacaaaggagtagggaaagatgcaaccgtcgcatggtacgaagcagctgctaacaaggcaactgcaccgcagatcgtacagcggtcagttagcctttattagcacctactccatcagtccaaaaaagacaaatcataagtttccgtatctaacgtttgactgtccgtcttatatgaaattttttataattagtatttttattgttgttagatgataaaacattattaatattttatacgtgacttgtctttttatttttttttatattttttttaaataagatggacggtcaaacgttggatacagaaatccaaggcttgtcttttttttaacggagtgtgtagctattgatttcgtccaaaacaacatcattagctggtgctagtgtggagattatggcgagctgtcaccaccagaatgactctgtagcgaaacaggatgcatgccatgccagggcaagttctgcatggtgcacaactatgcatgtacgtgcacggcactatcagtggatcgactagtaaatgatagtactatgcccgtaatataagcaaagtttatatatacgcagaagaatgctattggaacaagacaacacagcacattcaacttgagaacaatataggtgatgtttgaaaagcagggactaaactcacaaaaacataaattcctatgagagggactaatccctccttcccaaacaccaccgtaacatcattatttgcttgtactatgctactgattagtttggctctgatttgaacctgatgtttgtcgatttaaatgtgtggacgtgtcaatctaaattttcgaactctcaatttatcttaggtgtcatgcagatccaaatagactccaatctactcgtgctaatattcatatcacgataacacctatgtatcaatgggactcatatgttagtcacatagaagaaaataaagatatctcatctctctatcgctaatctattgtaggcgtctctctagcgaaaatatgtttttaattttattttttatatgactaacatatgggtctcactgacacgtatacgtcaccatggcatgtcacgtcagcctacgaagcgggttggtgcctgtttagacttatatgacacccatcacaagtttaaggacttgaaaatgcattttgatagtttggggatgaggatgaccgtacctgcacaaatttagaaaccacccgtacactgcgctctttggattttaagttgtttggatttcccttctaaacacataattgttgtatggattcccatgcattagagttagtatctcacaactgattattttatgtacaaaaattgaatatgactataattatatccaacaaggctaattcgcgaacgcattatgaccacattatgacaagcagctggattagggtttggggttaggtagagggggaagcagggatattccctaagcttagaggagtggccggggaggcggtgtgtggtaggcaaggatgggcatcaaggcggtgggggcaaagcaaacatgagtgaggggaagggggaaggagagcgggaggcagacaggcagtcatccaagtgtgcctcgccgacatgttgacgcgcctttcaacggtggcaaggccgagtggcgccaacggaaggtggtggaggtagggcactgcattgcgagtaggtcgagcttgatggcatcgttgggagatcgtcaaagtaaagtagtagcagcactacgttatcaaagaggtcgttgtctactccttccctctcaccgtctcttcgtacagatgtattagatgaggatgagaggatgaggtggagggaaagataggccttgagctgacatcacacgatgatggctgcacgtggacctcgtcgtcgtttttcattcacgtattgctagacactcgaacgtgtgcgcattagacccatccaattatatttgcaactggaaaagcacatttgagtactagaataaatggttttgggccttcttttaaacacaataactttatggtattttcatgcatcagaatatcaataaaattcctcggttaaaaagtctcgcttaacacaccccaaaattcaacaattaaggctatgttttttttatgtaagttgagaactacacatgtaaaacagagtagcggataaacgcatgattcattaagcattaaaaacttaaaatatattaatataaatttgtagagcaactttcttataatatttttttaaaaaaacacatcgtctcatagtttggggagtgtgagaagtgatacaaattggaaaaggagagaaaataacaccgagtaccagtaggctgtagtggtttattttttaaaataacgagtagtcgagtatcaatactacttcctccgtcctattataagtgcagccataattttccgtgcgtaattttaaccgtccgttttatttaaaaaaatttgaaaaaaaaatgagaacataagtcacgtataaaatattattcatgttttaacatcttataacaataaaaatactcattataaaaaataaataaaacagacgatcaaaattagacacggggaaattatagttgcatctataatgagatggagggagtggttcacttccttttcacggagcaatgagatcacctgatcggccttagccagtgtcgcgatcagaccgacgtggagacggcgaccgcggcgcccagtaaaaccgtttccggccgcccatttcttctccccccacgatcctgaccgtcggtccaatcacgccggagcccgcgcgggcagagagagcagagccaccgctttttttcccgcgccgagacagcgacgcgtcggccccgccgtatccgcctctcccgatcctcctgtccccctacccccaggtaggccccaccccgatttttcacattttggtctttttgaaaaactt

SEQ ID NO: 74911 - DNA, 1080 bp, Oryza sativa
cgccagagtggctggcgccgtcgttcaacaggacggcgccaacctctttggcgccgtccccctgccgacgtggcggggcgatgctgagatggttagggggagtgcgccagagtggctggcgccctccccccgaaattttttatttttgttttatttgtttgatattttttttcacgctttgggacacacaagaaccaaccatagaaaaattgaactcaaatggacgtaatatgtgacatgtagaatttttcctctcctctcctctctctccgaactagtgcagaggagagatgtgcaacttttttatttttattttatttttttgatatttttttcacacttaggaacccacaggaacaaaccatgtaaaaaataaactcaaacggacgaaatatgtggcatgtggaattttccaaagctctaccgaaaaacttctctcctcgaaaacacaatcttgcaagcggaatttggaggttttaatatcgccgaacccggcaaagctgaggagaattggatgtaactttttctgtagatgtccgtgcatatattatttgcctgattccgagtccgtatgagaaagttacgcctattttaatagatgacatattttgtccgtttgggtagagatttggaaaattctacgagtcacatattttgtccatttgagtttattttttatatggttggttactatattcttctaagtgtgaaaaaaatatcaaaaaaaatgaaataaaaataaaaaaattgcatctctatgtactgtttaacttatatatgttatttcatgtggttatattttgaattagattaagtaatttcatatagtggtagagtgcattatgtttaacatgctgatcaaagggttttactaaaggaattatggtctaattttagtgaaggtgcaaagtagactaaatggtatgctatctattttttcagacttagctaagtggttgttcgagtttaaattttttctgtggttggttgtatcgtgatcctgagtgtgaaaaaacattcgagaaaataaaataaaaatgacaccgttgcaactccatacagagaaacaggaatggaggc

SEQ ID NO: 74912 - DNA, 16328 bp, Oryza sativa
  unsure (1)..(16328): unsure at all n locations
cgccctccgccttgtacggtacggcccggcccgtggggcccacctcgtcgcagcggccggtgcgcggcggccctgtggcgagtcgacacgcggcggcgaggctccgcccctcctccatgtgggcaagttgggccgaccggccacttgccggtggggtgtgggcccccacgcgtgcgtggcgcgaacgtgtcgcggtcggcgcgccggcgcacacgtggcgggcgggagggggtagacggtgtacggtgtaccctcgggggaggcgcggagtggggcccacgtgtcggtgtggaggggtgggtgtggatcgggtgagaagaggtggaggggtagtacgtactacctgaaaaagggtgggggccactgtgcaagttgggtgacgcggggtgcacctgacgacgtagtagtagcaaggactgcaggaggtgggaggtggtggtcttttttctgatctcggctcggctcggctcccctctatttcaattttcaaggcacgtgtcggctacggcgatggtcggcttgagccgtgagcccgagctgcggtgtttgtcccgccgcggcctggtcggcttcggctctcggctcctcgcgaggtggcgcgcgagccgcgccacgcgtcgtcgatgggtcgacacgtgtcgcgcgccgcgtccgggggtgtttgccgttccgacgaaaccccacgccccaaaagcgaaagcgagccgaccccgaaaaggaggattttttttttccttcctctctctcttctcctcctcctcccttcccatctccgccgcggagaggcgcaggcgagggcgcgcgttccccgcaatggcggccacctagtccctcaaggaatcctcgtaagtcgcatcttcctctctctctctctctctctctctctctctctctctctctctctcgccgcggcgggcggcagcaatggcggattactcgctcggtcagttcttggctcaccaccgttggtgttcccctgtttcttggttcacgccaggcgcttcttcttcttcttctcggatgcgagagcttgctgtgattgctggctagctagcttgccggaatggagggcttctcgagggacttgctgtgcggcatcggcaagggaggagacgggccccgcggcgaggtgaggccgcgcgtggacatggaggctgaggaggtggagctcaacctcgggctgtcgctcggcggccggttcgggctggacaggagaggggagaagctcgccaggtcgtcgtcggtcgcggccatcttggcggcgccgacggagccgtcggcgccgccgtccgggctcttcaggacgagctcgctgccgaccgtggccgccgcggaggcggcgaaaaagcagggtgtggatgaattgaactgtcgccgcccgagcggcggcgcggaggcggagcccgcggcggcgaggctgccggcgagcgggagcccgtcatcgggctcgtcggacggcgaagggcgcaggcttgaaggtgcgtcatcgcttctctccatgggggcgtgtgctatctatctatctttagcttttatgatttcatacctaaccgatgttaattgcgattctttggtaatatatgctgctaattatgcaaattagacacgaattgtttgggtgaattcaaggtgaaatgcacattgggaaatgtgaaattgccctgccatatgtcatttacctgacgtcctggtggtaaataaagtttggattaagatgcttgggcgttggtctttggcaaagctaatgagatcttccatcactggtgcttcctcgttaacaccgaggactgtaatttcgatttacagcttaaattatccaacagtgaaattcgtctgttttacccctcttgaaaaaaaaaatttctgtttacaactgttgcttccatcatctaaaaatgtggttgctatcagtatatagtttttaggatcgtgctgctggcttggcaagtcagtttcaggatatctgttcttgtcaagtagccctttaagtcacatgacacgcgcaaaaagaatcttaatgggtattcttccttgttctgtaactttctaatttcacctgcagtagactttcttcagtactccttttataggaacgcctacaatctttttaacccaaagggtgaggatgggaattaagtaaatatggataactgctagaatggataactttgtagtgaactgaattcatagatcttattcaactaagcaatcagattcagcaagctttttttttttatccgtgaagattattaccacagttcagtgactagtggcaggacacgtggacgtggtgcagtgtttacagtgatgaacaaatgacgataagcactcgagattaaggaaaaatcatcttttatgtttctagattaaggaagactaattatgctttgcctttgctcaattcatagatactcttcctcacatgaaagaaacttannnnnnnnnnnnnnnnnnnnagcagaattagtttgagcctgggtagcatgcatggtagaaattgaagaagtctttcatacaactaagatctgaaatagtaattagatacagagtggttactggttaccaagtttcttctaatacatagtttctcttattacttaataatcgcactacttcaacagcagaaagaaacgtgtcctatgtgtggattcaagtgttaattggttgcatagcattttatttccaagggaggtgtgaacaccattttgttaacgtcaagaacatatttttgataatttgaaaattttaaaaatggtagttaaagtaaaatatatgaatttcaactctcaaatagaaactagctttttgggggaggcataatttttttatggtgaactaatcacacctcacttcttagtcaataatgattttgatccttgtaatgcaatctatgtatgtattcctctcattaatgacagcaagcaagagctttacatagacattgagttacgtctttggatggatgttggtaccctttgttagtggtagcctaacctaatgcggtgtttattttgaagcttccagaaataatacaagatgttctattagcatattagcaacaaaggacatcagcagatttgtttttgtgttactccgaataacaggtagcaaattcatggtggaaatgtacatggagctcgcaaacattggctaattatggagcaattcaagttgggttcagcgacggttgatgttaattacattttgtttcattatctaatatttaacaacaataatagcaggtgcaacagcacaatgtacatatgtaggtgttgaatcaaggttgatgctacctgggtagctaactaggctttagacgccaagcctcacaggcagctaatagcccgttagttgtgttgtatttttcaaattaccatataggtgtgatgatgtaagaatggagctttactcgcacattgtgcacactacattttaatgctgccatatatgatgagatgaaacaaaaataacattagaagacattcctaaattttccaattctagtgcgatttggtactagagtttgcatgttgcatgccctccccttccaacttgtcgctaacttctggttctgacattgcattagggctgtggacagtaagtaatctgaacctgcccagcatgagctcctagatgcatgtgaaattggtgagctgcaggataggcaactatctcctgcggtctgggaggattcagatattactttactactggtctggtttaagggaaaacataccatttttcctaagaaaagtgaattaggaaggattggtcgacaatagtaaagtccatagttggcgtcaatggatgtaatttcattgtcgcgcaaaagatgaagaccccttgactgtaacaacctagtggacttgcgttcaaaacagacgagttcgaaaggtcggtagagacagctcctatcaacggacaactgtgaaaaacaaaagatggtggaatgcagctattcatggaattggaccttactcttgcttatacaccaagtgaagtagtgctaggaatgtttctagaatctagaatcgtattagtaaagccttatgctcacattgcttttgaagtgtcttgttcttcccgttctaacctatcgtttagccagacatgccgatatattgttctgggcctattttgtcattgatgttgggccaattgtggtccgaactccaaacgccaaataaatttgatcggagggagtacattgcgtagctacgatattacatatttccaaaagaaaacaaaacatgcaaagggagtacgataagaatgttaccgaacaaatttagtttaacccatttctttcgggcagtttatctcatattctgaaacttacagttttctgtttaatttagaatatggcagattccggaacagtttaactaaccatgttttctctttcgtagtgaatatgacagacactctcatgagaacaagttcactccctgccggcatcgaggatgaatggaggaagcgaaaggaggctcagagtctgaagcgactcgaagtgaagaggaagagaattgagaggaggaactctctcacttccaacatttccaaagaggctgttgggcagatattagaggagatgaatgcaggagctgagaaagtagaaagttgcgatgatgttgctacaggcaataagaagacgggaggaaatgtgaaccatagcagtgatagaaaccgctgcactggacttcctccagtccaccgtgccacgtatactcaacaacgtggcagtctgtccggaataccaacaaagcatattccagctatgaaaggtaaaccgcttacgttttgtcgttttgcatttgttttgtcgttttgcattatagatacgtgaaaatattttcttgtcaatctagcttcaagcatgattgtttgatatgatattgcactattttgtagtttcatgttttgttctttatgcttgtcacaacttttgcccctccattatgttcatgtagatctctcatgtctgagggcttttagatgctcaatttatttatattgctctcatttgtgcgagtttcaagtcaaatgtcttgaatgtgaactgggcatggatggttggtgccagatactgttatgttgttagccgctgtgcgcaatgttttttttcctaaatggcagatcgactaaaataaattatgttgtaacaaatgcctaatttagtggcctggattgcatggccctgcctccggtcaaaggatggaaactacttccagacttgaaagtatggagggtccacacaaaacatgtatgacaaggatcaataggttatgttattagatgaaaatatcagcaattggtcatccttccttacttccttacttcctttcatgaggtttgcttatgtttctcattaaggcctgtttgtctgtccttccaggatctgctgatgccgaagagcacaacgttccatcggccgctactgagcaccgaaatggagcagccatagcaacaccgccattttcggcactggcggtgagggcagtagctcttgcttccaggggagagcagctgcgtgctacaggaagagttgcggcaagagccaagagcatgggagatgtggagaggatcatgatgcaggagatgccatgcgtgtgcaccaaggggctccccaatggcaagagggttgaaggcttcctgtacaagtacaggaaaggcgaggaggtgaggattgtctgtgtttgccatggcagcttcctgacccctgctgagtttgtgaagcacgccggaggtggagatgtcgcgaacccgcttcggcatatcgtcgtcaaccctatcccgccatccttatactgaacctctctgtcagctcactgctgctcttgcaagtgttactatagcttcagtcagcccttcaccttagcttcagaattcagttcagagtagaatctgattgtgagacttgtcttaatgttacaagtgtttattatgctaaggagacagcgggagatttgctcctgctgacataaaaagtggttaacatggctccattgatcattgttaaatggttcctgcagctgcttttgttcatgcaggttgtgacaaattcatcctagtgcaagttactctggcaacaaagatctcctggactcgtagtatgttcaagctactacttgcaaatttcccagccagtcagcagcatgacccatggagatgtcaaaatcctgataccgaataaccacggaaaccaccgacaaaaaccaatgaatttcagacagatctttaaaaaaaattgaaagtatgatcaacccaaatgctacaaagaatgattgtaaaacactagatacggctagtgcagacaaatgctacaaagtatgatcaacccaaaggagtgcacaacagagactaatctgtaagtgcaactgtgcaagcatctgtggaagtctggcatacatgggaacaatgtatataggaaattaacatcaaccagttactgattccaattatcaatttcacaatctgtccaggcaaccatcacatttgaagataaaacggctgtataacagcatcacattctggttgcctcaaaaacaagttaagcatgcatctacctataatacaaaaggctaatactagctagcacctaattgcagtggagaaaccataatttataaagctattacacctcaaaagctttcatggacaggcacttcaaaagcttcaccgaaacactgcatctaagctttcatggactcttcaagcttcaccgataattttgcatctagcaacctgtcagcttggctatctcctcgagcatgtacttggcttcagctgcgtggtctaccggagcttcactcctcacagtgatcctctgcctcttctcattcatgtactcattctgagttacgctgacgcggaacaggtgaggaacccaagtagcttccttcagcttgagaaggtaactgtcatcaccctcctgaaacaattgagaccaacaatcttaggcacagcttaaatagcaatcttaggcatgtagaaaactaaagcctagaatctgcacaaagttgaactgaagcctagaattcgcacaagcttgaactacagcctggaattcgcacaaagttaaactaaagcctagaatttacacgaaggtgaatcaaagttactgtgggattggcaaaattacctccttcctaatccgatcaagctcatctgcactgcagccaacaatcctctctgcctgatcattgaacagagaaagccaggcctcaccagtagggtcggagaccttgatgaccatgatgtacctgaagaaaggaaccagtgtagcattagctttggctttgtatcatctcaaattcaagcatgcacggtgtaattcagcccaaagttttacctcagtgagcactcagcatcattcttctggcacccttcacaccagtatcctgatccaattgcctcagtcaccttcttgttgcaggtcttgcaagctcggtaccacatggtttggtcaggcttgataaggctaatataggcattcagactgaagaacacaggctgcaaaacataacaagtaaatttaggacaatcacaactagaaagtgctaataaactaaacatcaagaacaattccattttctttcaaagattccaagattttaccttatcctgacccaagttggggtcacttgtgatgtgagacagaaaaactctatcactgtacatggatctcgcgccaccaacccttgatgcgcccatatctgaaccaattgatgccattgaagtacccttgccttcagagtcatacctgtttgccaaaataacgtcaaggaccaaagtagatagtttgaaagataataaaaggagtgtttgagattaggacaataccaagctctgagctgttctgcctcaggcaagtcaggattcactacaattgtacttctccccacagttgacagagacaaacctgtcgacattatagtagtaatgctgttagcacataatcgccaattcagatcctaccacatgcaggaaggtaacacaaacataccttggaagtcagatacttttaggctctttatcgcaatgataggcgcagagtctaccatgtccaagagctcctgaccagtagttgtggcaagatcattccaaagagatatggttacagttttgctcctgccatcagattaaatgtaagttatcagcacataaaacataaagagcattcacatcatcaaaagaaaggagttaacaagccaaatgatgcttacgagtcatccgctacaacgatgtcacgctttggaatcgtctcgttgtcaatcttcctcctaacactaagagtaggagatacgctctgaacaaccccaataacatctgcaagtagggtaaaactagtcagaacactacattcacaaagtaggaacaagaacacatcactgaactgaaagcactattgccttacctactagctccctgccaccaacatatggccctagctgatcaatcttgacaaagttgtactgaatctgtgggataaaagtttcgccctcagcttcctcaacaacagcattctcattcagggtcatctcgtagtcattatggacagtcttgaactgcttgttggcgactctgagagatcctttggagatgtagtacaccttccccagctcaaacatcggatagaacttcttggcagcctcgttgaacatggttgcctggatctgggtgccctgtacacagatccaacaaaattaactcatcaatcaacatacaagaattcagaattgctcatgaactgcaattacatcctacggaataaacatttcacggtaggttgcacttacatccacatcagtgagctccacattgaagacgcagccttcaccacgagcattcttgtacgtcctcaggttgcccttgcttgtgacacgcaccttgatgatccagttgccctggtaggggttcagggagatcaaaggatgaactcttctcgtcatggccaaccgcgccgcaggagcagcactgcaaacaggaaggcatcaagaatcggcaggttagtctcaccaacaattctgcatcagaaacaactgaacaagagagatggggatctcgcaagaatcgcttacttgccgcgctgctcgttcacgatctgggacgcggacttcacctcctgcttgggcttcagcacaaccggaggaagtggcggcgcgttcgtgggcttggagagaaccacggattcctccttgggactcaacagaatcgccggcttctcctcttgcttttcggcctcgcacttgatctcggaatccagcgccttgaacacgacctcgagcttcgtgataatcaagaccctgtgacgcatatgaacaaaaccagagattcagatttcagaagacaaagaaacgcgagtggtctgaagaatcagacaggtggagcgcgcggatctgtacttttcctgcttttcgccgatggtgttgcaggtgtagtcgaggacgcggatgacgccgagattctggatgttgccggagcgcacctccggagcgagctgggtgagaagcatcgtctttatcttgtccttgccatcgctcgccaagaaactgcaacgcaacagagagatcgtgaggaactcgtcgctgaggaagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtagcctgcctccggccggcgtcgtagttgcgtttcacggccgttatttcagtctcagatcaaattggattgataagccaagcatcccaaattctcaatgtcacaatgtacaaattggcttacggcacagcagcagtaagcaacctgagcttcggcgagatcctcacgaggccagggtggtggtggggcagttgtcgacgccgcaggcgaggatgtcgcggtagtcgcgggagacggtgaagctgtcgtgcacgctgccgtcgcggctccggacgtactcgaacagcagcgccgtgtggttgaaggccgtcagcttggcgaacccgtagtcccggtcctggacgtggctccaccgcgcccgtacgccggcgtagtccgccaggctcgccccgccgccgcccaccaccacgtgcgtcgtcgccgtgaacgcgccgctgtagtggctcgccgccttcgccacgcacacattctgaatgcacacatttcacacacagtaaaacacaagcagaaaatgagagccacagccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctatttaattttacctactttcttatattctgggacggagggagtaccctatcaattaccttccattcaaatatctcgttattataccctcaacaagggcggatccaggaacaaaaaaaattagggggggctcaattatgcagtttctttaacctctagccatttaaggacctttagtttatcatttatggtgaaaaaatcgaaggagtgctccgggaggtatccatgggtatagagttccccctgcacccacgttggatccgcccctccctcaactacctaaccatacaccattcaattcaaatttctctttattctatctccaatctccaactactctctcacacctaaacatacaccattcaatgacgggcactataatcttctctttaaatcataatctacactaaacaacctagaatagtaactgtatgggaacggaagagtaacagtgctcatatacctcgtagactgggcaggttctctcgtagccatggacatggccgtacatggcgatgtcgaccttgtacttctgccagagcggctggaggctctccctgcccatgggctcctcggttgtgccctcctcgacgtagaagctagctgatgagtagccgagaacacggtgggcgaggaagatgagccacggctgtttctgccggtcgacggaggagaagcagtgctcgatgaacttgtactgctcggtgcctggcctccagtcgagctcggtgttggctatgcagaaacggaacatgccgtagtctatcgagtacctgcaaggatgatctcagggtttaacaggtgcaggactgcaggttattggggccataatcttttgtagtagctttttgttcagaattttgatggaccgtactaagaaagatgagattatgcagagttggttgtgttcagtaagagagatcaatgaattttagctattagtacagcctaaaaaaacatgatagcttgttatttgttaatgttgatctgtgtatataagaaaagcatgtttacgcatgatcgtctagtgaaccagaatgtctcgataagtggtcacatgtatgagtggtacgccttaaaatatccaggtttcgtatagtatttcacaaaattcaggggaaaaaatgtcctaccagaattgctcacggttctctgctggcacgtagaacatattctgagctggtacaccgcattcaccacctgaatccaaattcccatagaaggaacctgatccaggccaatctctttcatggttgccgctgcaagcacaaaacaatatcatcagaaacattgtttgaaatttccaccttgtctttggtttgtttctgtcgtcaagtcggagtaccttccaaccatgtaaggcacactggatgcaatgggttcaacttgtgcggtaaattgatcccattgtgacagataaccattggcatagcagatgtccccaatatgtattaccatatcaatattcttcaaatctttaattagctggtaggtcgtgttcagtgaaccaggctcgaagtcattgaactcatttgaaccatcggcctcagcctgtgcaaggagttcaaatgccaattaaggccagaggagaaaagcgaatttgtagcaaataatctctcttgttttagcatgagtagcaggtacttaagtatcttattctttgttagtttgactcgagatgatagaactcataaagagtacaaccttttctaacttgcataattgtcattaccaatttactactactaactaaagataaagacacactttggtggccttctgctaattgttccctatctaatcttttttatataattgagagattttatttaaagcacaagttgtactacatctcccatattaactttgaatagctatggagttccatatcgattcagtgatcagttacctaataatttattgcacttttgggagataaacgtggaaaaacaggcacattgtaagtggtatcatattcacaccttccccatatctccaaaaatgactacacgctgcaaagagtcttcccctggataaggaggtgcttggaagctatactcatgtccccaaataatagagccatctgatagccgatgcccaattctgtatgtatacctgaaatacaaactcacttgtaagacttgttggcacttgcatttgtacaaatgaatagttacaggaccacagagggcacagatgcagacaaagcaaggttgtgtaacactcatttacttgaaattaggccacagatccttgaggaaacttgtatgtatgaaaccaggatcgcgccatccaactgtcctagcaggaggacctgtggtaaaatcatcataaagcatgacaatgttatcatcttattaggttcgtcaaaagttacatgtcaatggttatttgatctacaactgctctgccattataccattattctaagatgtgtttcttttttagttgtcacttgtcagcactaatgggggattattactctgagcaagtaaaaacataatgaaaatttactcaccgcacatagtgctgcgactgaacgtaagggtgcctgcaggagaaaggctttggatttgcccttgtaggccccatttgacaaatggtgtagcctcattggtgccatatccacttgtccaagtcactgtcatctagaatcacttaacatcagtcattattctgtaaacatggtatgatctgatttgcagaagcactttggtgcccatttgtttcataagcaacgcagacaagcaaacactatttcggaagaaaaaaatatcacttaaatggaacaatctgagatgtcttacattcctgtttttgttgctttgacattcgagctcataaacatattccattaaaaaaataggttacttgcattgaaaagtgctaaaggaccataaacgaaattttatttctgtccgcaatgatattttcctttgcagatcacaggctaggatgctcaattgagactcacttcattacttatggaatacttaacaagatgatacttacttcattccaggattttccttgcgctaggcgtgggtacacaggggcctttgggttcgtgaaggttactctctttgagtgtgcaatgagctttggctgtgaggttatataagacatggcataggcaagttagaccatataatagttcagtcacattgtattttaactagaaaagacaaaatattcaagaaataccaccatggtaactgaatcgttcaacaataagttttcacactaaataaatgaggagaattttggcacatacatttgagaggcctccagaaaacaatgcaaatgaaaaatcctccctctgattgattagctgaagcttcatggatccctttcctgtcttctcatagtcaagattcttgtagtttgcaaatataaactgccaaaaaattgtgcctccttcagcatatgttattggcaagttttctgaagtctcatctacagttcacatggaataaggctaactggatgtaacactaacctttatgggagctgtacatagaagtggtggttcaacccattggctctctgatggacaagtagaatcactggtaaattgccaaaaaggcaaaatataaataagatctcaacttctttcttgctgtcttaattaagcattcaattcaggcatccagcatcaggatgattggattgcaagtacctgaaattagcaggagagaacaccccaatccaatcatccttcgatggcttggggttgttataggtaagagtcacccattctctgtcctgtccctgcaacagataaggtagccaataatttgaatacagtgggtctatggaagttcaaaaaaaaaatcatgattgattctcctataaatcctaatgctgcaaaatgcaaatatatgcctcgaccgactaaattaaggcactattaactgggatcagaactctcgagctctggtaagtggtaatggctgactacatcgaactatataggtccgtacaagagcaaaaaacagcagcgagtgctgaattgacgagctagtagatacagtaggttgctgagaaagctgtagtacctcgaggccgaggaggagcggcgaggcgtcgacggaggcacccggctggatcgcgaaggtggtccggtggatgccgatcctcgacagcggctgctccccgcctcttcctgccgccgcgaccgcgccggcgaggctgagcgccaccagcgcgtgcagcaccgccgccgccgccgccgccatcacggcctctcgctcgctttgctccccccaaacgcagcaagagattggtacagcgaggaggaagatgattaacgcagagctggcacggaggaaagagtggcgtctaagccaaaacacaagtggctcgaagaaagaaagagaacgcaggagaaaatggcgttaatctctgcaagatttatcagattagtgatgggacgtgttgggcatgtgtaatctaatcgactaatcgttgtgttcggagctggatccgcagatgctttggtttaaccgtggaatatccttgtggcaattctggtggttatgactagggacttcagatgcaacacttgcaggctgcaagagattaattaatgcacataattgcgaagtcaaaatgggatcttatttatgtatcaacacatggttttgttgcattgatcttacaagtcaaggtcaccaaactaacaaaaccagcaacatacagcatccaagagaagctagcaaaaattggcttaagcatcatcagcactctgaatgtcgtgcagacaagtgcccttgccctgcctgatcacactagcttctacaggattatatgtcaaaagaaaaatgaccatcacgtcgacatttgaaccaccccaaaagaaaaggaactggatattgtacatagctcacactgagaacattgagcgatgaactgttagcgtaatggcattgagctgatgcatcaggtcaggcaacattctctacctgcactcaacttgcattggagtacagaacaaactaatttttcacacagcccaaaacggtttctgcccagaaatggaagttgggttccctccaagcacgctattcgtctcatcgatgttgtcctcttcatcgtcatctccataatccat

SEQ ID NO: 74913 - DNA, 27185 bp, Oryza sativa
agaagttgtttaaaacaaattaaataaatctattttttcaggtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttggatggcctgcgcaattgcgcggctagcactcatacaaaatcatttattttctaatatgattttacttaaaatttatcaaatagctatctcgttgtcttaaggctttgaaaagccaaaccttattatccccatgtttctacttttatagtttttaaaagtcacaccagttgctaccccttacttctatcacaccccttcttcatttgcttgcttgatctaccgttgtttcgattcattctccttggacctttaaaaattataccttatagtttttagagattaatctctcgttgggttttgtttttataatttttagaagtcccatcaaacattgtcactatactcatccacaacccgtccattgccttctctctttattgccattgggatttcaaaaattgaatataattatcatttgggttcattttttactttttagaagtcccgccaaaccattaacggcttttcactgtatttctctatggctcacccattgcctcccctgtttattgtcattgagattttaaaatcgagcaagattatcaattttttttttactttttagaagtctcgagcctttaaaaattggaccttgtagtttttatagtttgttgtatcgttgggtttcattagtagaaactttaggagtcccgtcaaacgctgcactatactcctctatgattcatccactctctcctctctttattgttattgggtttattttttactttctagaagtctcgccaaataatcagcggctttatcaccgtactccactatggctcgtccgttgtctcctctctttaatatcattgagattttaaaatcaaatttgattatcattatggtttatttaattaatctcatgttgtaccctatctggactattcttttaatataattcattttttaatcggaattttaattatttataaattctattcctattagaactcttcattattattattaggattttaaaaatcgaacctaatcattctttggttttctatttttatagtatgtagaagtttcgctagtgcccatctcttaataatacaatacaattcattttatcttttattctacttagtagttttctctaaatattttttgtttctgattttagttatttttaacatatgcccaccataaattggtgcatatttttttctttttctttacttattaatttggtaatttctagatctccttgtataatatttggatatattattaattgtatgagccattgctgctgtagcgggcagactaccgagcaagaggatagattttcttttttactgagcttctttgataaaaagaaaggaacgtgcagcattgcccggttggggcttgagagtccgaatataacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctattggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagccaattcatagcatagccgatcaggtagatctagcatgtatcggcaatactccgatactactctatactaagattttaaagcaagtaaataaaagtagttaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctggaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaactcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctggtccttcgtttttttctatacaatttaaaggggcccttaatttttagcaacaccatgtggtcctcaaactcatcagcagcagacaacaactaaagagccgtgtaatatatcagacaatgcaattagtagggagaggcgcccataacacacagaagagaacaaggatcagagacgaaaagggttagccttttaacgctgtgatctactcgccgctacaaagagaatggacggattgatccaaagtgcctcgactttactacttgcggcggggtacaccgtgccgcccggcgtgccgcgcgctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttaacttttggagtggtcccgtcgggcggtatagcttaactcttctcctccattatttgcatgggcggtttcttccccctcacaggcctataaattccgaccccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggactggtggttgcccccacccccaaccgcgtagaccacgttggcacgcggccgccgcaccagtccccccctccgccgcagcgcaatgcaccaccagatttggcgcctcctccccagcgccctctcgccgatccacgccggagctccccggccgagccgcccgccggcgcggctaggccgcccttcaccgcaacgacggcgggcgctcgcgctcacgcacctcgccacccggcgcacatgtcgcctcctcgctgtctccgcccagtccgccagcccccacgccggcttgaggtccgcacttactcgtcgaatttccttcatcgctattcatggaatctgaggaagagttggaattgtggtttgtggtggaatgtaatacctggtacccttactggatgggaggaacaatgccgcacagctaaactggtgttaatttgggggaagtgccaattttatgccttctagtgctaaagcttgtgaattcagtttttggattatgtgatgtgcattgtaatgccgaattatgtgttagtctttggctaaaacttttgtctatgatcccctgagtagtccggatatctttagatattggatggtatcatgatcaatatacctcgcttgttcaacttttctatgatcctggatgatgccctggatatgaaattgttgttagtccttgtaattttcaggttggatcagtttttcgaggtggagatgaaggtacgagattatgaactcgaccaatatggggttgtcaacaatgccatctatgctagttactgccaacatggtgagttctgttctaccaatgaaacaaactaaaagaacatctcatgtatattaattaggtcagttaatatgattcctatagcatgtttagaatttaattaaaataatatgattaccatggttggttctgacaaaattaaggattcatttattttttaaaaaaattgagcaggtcgtcatgagctacttgaaagtgtaggcataagtgcagatgcagtagcacgcagcggtgagtcgctggccctctctgaactgcacctcaagtactacgcgcctttgagagtaacatccttgtttcccaagttgtgaaaaaaccagaactgaaaaatgttgatgtgatactatgaaactaataacagatcaaactctaaatattgataataggttcatttgggtctaacttctccctttgtttctttgacttgtcagagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgccccacccgtatatctccagagttcctgtccaagctgcagttcttcacttctgaaggcagtagcagttaagtcactgtactcatcgtcataacctgcgataaatcactgtatcccattttccatcgtattgtctttgttcaaatgaaccaattgattgaagcatttgacttcagtgacatttctaatctgtgataaatctaactgcattctttatttgattttcttggagtgagcacgcgttccaacgtttgaatacatcgtccaaattcagcaaaaactttgaatggctatgttgagctcatggatatgatgtgagaaactttttttttttttttgggggggggggggggggttgagcactggttctttctgtgctaggttacatatctatgagacccggctttagtcaggcaagggctcaagttctattcataggagatctgaggtttctgaaccctttccacacaatggatgaacctttcagtcccaggcatccaattactagttgtgatagagtgaatgttcaccaattgactagtataagtagtgaacatctcccaatggaaaaaagctatcgaaattttaactttatgcaaaattttcagttttgagttaaaaatttgcacattcttagttcaaaacatctactaacattgaacatagtagttcagatttttttttatttcactggttagctcacaatggctgctgtgtttgacatgcgaggaaaagagaagatcgaggatacgcaaaacaagataagccattagcattagcgtatggttaattaattattaattattttaaatttgaaaatgagttattaatatataatttttaaagtaacttttctatatttttttctaaaagaatactccctccggtttcattttaattgacgctttggacaatgacacgctctacaagatatacatttgaccttatttttttattataatatatacaataaataaatacatgtttatttttattatagtgttttgaaagacaaatctatatatgtttttctagtttctttaaactaaatatctttaaagttattgatggttaaagttataaaaggttaacattaaccttgtccaagaaccagggggagtatatcgtttagtagttcgggcaatcaatcaaaagctaccgaacgcagccgaatacatatggcgatttcggatagcctcgccaatatgctactacgtggcaatatctagaacgaaattacgtggacaaatccactaggtaacctatgcgaaagcactaaatgaacccacataacaggatcagcgagaacgtaccgtgccggggagaaatgtttccaaatggccgcttgaccgcaaaaagcttagtgcctttttatcccttaacaagaattcctaaatatccactccccggaaaagaaattcaaggtctgccgcactcggaaggtcttgtttgtgttaaagtcggatttcgcaatggatgaaactagggtttcccaaaccaccggggccggggttatcgtgccccggcagtaagcacggtaaccgtaaaaaaccgtacgaaaccgtgcaaaatttatcaaaaattcaaattattttttaaatttatttgaatttaaggaggttaccgcggtttttctattaccgtacccccgcggccggtaaccgcggtaaccgcacggttaccgacggtaagttgaaccctggatgaaaccaccataagcttgaaattttggccaattaagattggattaaattccactagccgaaaaaaaaaaccgaatacatcattggtatacctttttagccgtgtaggagtttgatatagactatatttaggggagtttaaaattcgcaaaaaaaagttagttgatagttccgttcctgagaatatgaaaaagctaaaaatcccatcttcaagtttctaatttattttctaaaaattttttagttcttggagaagttgtatatgcaaaagcttccaaatagcgaagtgagcgttggtagaatatgtgtgctagtatttacccgttaacagcaaggtgttcataataatttcatcaatcacaatatacgtcgaccaatattttaaaagtgcccatccgaaatatatccatactaggtcgaacgaaaacaccccggataaaatcgggcagtctcttgatgcgcgcggtgtagctgcagggagctagcaggagaagctggaggcgcaccgcgcacgcccgaccggagccagccatggagcgggcatggcgcgcgctccgcgcatggagcgccgcaatacgctctctctctctctctcgcgcgcgcgcgcggatggcatgtgccttccctgcaggcgaccttgccggcttgccgctcgtctccccttccgcccgccgatggcgaccagtctgtccactcgttcgccttcgtgccgctgctgctcgtgcgtgcggcgccctatgttgaaccggatcggggggacgggacgacgttccaccgttcacggcgcgcggggttgtcgtaaagccatcacattcatcggaatggggaacctgcctagctgctgccctcgtgcgccgtacccccatcgaatcctagccgtcggttcagctccgcctgatggcccagacggtccagatcagccgatctcgccaggagagctggttggtccaacgtgacggcctctgacgcacgcacgcaaggcaggcaggacgacgagaacgcgtccatgtacacgtaggcaacacacagctggagcttttctttgaagagaaaaatagcaaacgaaggaaatgattctgctcgttttagagaaaaacatataggttacgtgcatatatcggcattttcttttgaaatccacattaacatgcataaatatattgcatggaccttgacaactctcgctgtcataatgcatgctcctgtcagaacctagctaccgactaagtactctaacaatgggataattaatgtcagattactgcgtagggtgcgtcaggtgaaagagataactagccaaattaattgtgcgcgcacgaaactttttcctgtgtgcttgatttccacatcatcatatataggtcaacctagaaaatacaccactcttccttgaattttgctcgtggcatagttccccatttaaaaatgttattactaatctggttgtcaaattgcggtaagtggtgctgtgactaagtgtgaattatcagaatatatgtgacgtatgtggcacgtgcaccagtacatggtaaaaacctttactgtttgagcgggaatttgtttgctcgagagtatctagtttttgaaacatctctctggtgcagaggaattgtcgtgtttatgcttattttttcctccttctgatgaaagataggatcactattgtttgcagcatttttcataaaaaataatcatgtcgaataagcgtgtggctagttttcgacgatgaggaccagcacgttttttacagcagaagtcaaaactcgatcataatgtcctcacgcaccggagtggattttaaagtctcgcgttaattatatcacttaaataattacgatttttttaaaaaatatgaagatgtattaatatgtgatatatcactctacaaatatccaatttagaattcaacatgtcacaacggaaaaaataaatttgactcaacttctacattactaaatttgttttgtcttgcgacatgtagaagttgaattgtaaattttatgtttatggagtgatatataatatattaatacacattcttaaattttttttatacctgttcaagaggcatgcaaacaacgaggggatttaaaatagtatttgtcacggtgcaggccttgcctctaacgaggggatttaaaatgatttctgtcatagtttaccctttgcacgtgtatataggcttagatgtcggtgtcccatgcacacatgtgaatttccttctaatatagacgtataatttttttgcgcgatcgtgaaaaatgcacacatttagcatgtagtatatgcctctttgtgtgtgtgaaattttacagagtgcatatgaatttcacacgttgcaaatttgtgtgttcagattatagtaaggcatggcaattgctaagaatctgcgtgtgtgcagactgtttccgaaagatcaaatgacgcaacctagatacgatatctcacagacccactgtacataccccaacctgacaaatcaacactgtcaggatcggagtaacagtattttaatgcttcccaactccatcaccgcaatatcgtatcagccctaacggtcgacgaccggccggccagccggtgacccccatgggccgtcacttagctgggtgcgccaccagcgacggcgccccaatactctggtcaagaaacgtgccactacactgtggtttgtgcatatggaagcccagttcattctctgccgttgtctcatggtgaccggtccgacgaccaggaaaggtaaaatccagcgcgcgtactctgctctatacaaccgaacagtcttcaacgcaaaaaccgcatgcgagcaaactcagacttttgagggtagagagaagaacggtaatcacctagctagcttacacgccggattggactttccgttgcaaaaactacgtgtgcagcgttgaacagctaatcacctgtcctttcctgtcccacggatcatcacctatataagcgccatgcatgcaccgccatgagggaaatatcacagcaatcgcttcatcagctcgccgattgcaacgtgagttctactacacactagcagttgatacacacacacagttcaggcggcgataagctagcctgaggcctgaatatatatagcagctagagatactagtactgaattcacaatgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggtcctccttcgatcgagatcatttcaccaatctactccattaatcattaatttcctcacttcatttttgaatatatgcatgacattgtaaactttcagacattgatatttaccatcttactcaattttttaatataaaaaatactccatccgtttcagggtataagatgttttgacttcagtcaaagtcaaactgctttaaatttaatctagtttatagaaaaaataataataataatttcaactcaaaacaaatttattatgaaaatatatttaattattgatttaataaaactaatttgtaattataaatattagtatatttgtgtataaacttagttaaatttgaagtagtttgacttttactaaaatcaaaacatcttctaacctgaaacgaagggtatatcatacctaaagtacaattaatgttaaaacaagtccccacagaataaataatacttacttacataaaagtccttttaaataaaataaatgatcaaatatcatgtctaaaatcaccatcatcataaattcatttaaaaatggagattgtaatttctattgttgatcttttgatatttcagagaaaaaaaattaactctgatgttttgggtattatgaaatctctcaggacgaaggacgggttttacgaggtcgagatgacggtccaggacgacgagcttgacgagtacggcgtcgtcaacaacgccatctacgccagctacatccacagtggtaagctaatacatctccaaaagtaactgaagcatctgcatgctaaacctgttataaataatctgaaccgtgcgtttcatgtgtatcaggccgtgacgttttccttgaaaatgtcggcgttggcgtggactactggacgtcgacgggcaacgcgctggctctttcagaattgaacctcaagttctacacgcccttacgggtacatcttctttcttgttttacttattactattttggacatctatctcccaatcttgatcaacttcatgtttttatggtcacggcacacacaccgagaaaatctaacaaacatttgccttgcgttatttccagaaggatgatagattcgtcgtcaggatgaaggtcgtgaagatcaaaggtgtgagaataatcgtcgaacatttgatcgagacgctgccagatcgtaaggtaagcatgaatacacagggattctacagctaattcattctctgttaatttagaggtgattttattaagaggtattatactttttagtgtaaagcttgataccttgggataatttagtgtaaattttaattatctttaggtacttttcaagcatagtaaagtttctctaattttagctaatggtgatcgatcgatctcacacaatgattttactgctgcttctcccagctcgtagtggatgccaaagcaaccgccgtttgcctcgacaacaaataccgcccaacccgtgtgttcccggagttgtcgacaaagttacatcagttcttcctgtcataaacggctctttgttgctctcatgacaagaagtggatgaaccttatgtgctctaccggtgtacagagcaaggcacaatttgtttgatctacattttttttaccagaattatgaagcatactgtagtaaataaagagtgaataagttagtgctgaccggcttagccgtgagccgctttatgtgaggatgagatgtagatacgcaatacaaatgtgcacctgttcagcagctttcatttcaatgggcattccattaaaaaaaaattatgatcttccatcgtgccttggatttacagtttgcatgattgtttctcaacaagtgaaaagctgcgtatttttatcacgtataaccgtagactacactcgagtacagaacagataaaactcgatcagatgtataatccacggaacaagtattagcacttcagcaggtgaacccacaaacgcacgtgttgctagatgagaacacaagcaacagcaagagaaacaaatgtacggctgcttgaccgtttctaccacatggcaataccagtcgttttcattcaaaaagatcacatcaatataataccacaacaaacttctgccaggtaatgacaatagctaaaatataaagaaacacagctagtaagtagtaagacagttcctgtgtgcttgaattttggcggcggctgtgcttttctgaaactgaacatggtctacacatgtcataggtgcttcgacccttgccagttcaaataccaaattcagaagtcagactcaattggagaacagaaacagtttttaatgccaaatgattattcaagtcactggttaataaatttgagaagtgcatgttccacaagcattagattgaaaatctacctacacaaacattagattgaaaatctacaaggtatgttgaagaacctggtctttatgatttcaaccagtcacttatatataggtatgtgacgctgagagccagttttgccaccaatgatcaatccaacagcaccaatattcaccatgatgcagataggcaccgtcattcttcgtgtcagtcactgctaccctggcctgggcacacatgatggagatacagtgtataaattcgaaacccaagtgtccatagcttcaaaatttagattctttcgaatttgaaacttaggtgtccattgcatgaggtgtaaagtactttaggtgtatgatataccactagttaggtgaatttgaatttgagactaagtttcaaagtactttaggtgaatttgaaacttagctgtctattctggtatatcatacatttaggtcagactttgaaagagccattgcataagtttcgaatttatacactggtatatcatgaatttaggttatggattatagaattggtgtccataccttcgaaatttaggttctctcatgttgaaaacgaaactatgttcctcaattatttcaatgcataagctaactaggtccagtgtataaattcagagatgtgttggggcatgcaacccacatttcaatcctagttcacataaagttaaggttaactgtcccccaaagcaaacaaaattgatccagtcaaatccatgtcagataacaatatatcagaaaagttcacaaaattgttcctatcaattcatcaagtgaagcctgaaaatcaaaggtgcaagaataaaagcagaccacatgattgaaatacagtcaataaggtatggatttacctcacatgctcagatggcttgccaatcctgcgtgctgacagggtccctgcatatgtcatcatataatagtgaaatatcattatctacggtgcccagattcatggtctatgaacagttaatgatcttgcttaccatcttcatgtatctagcacttttgtttcacttgccagctcatacagaaagtcagaggaaccgctgttcgcctcaacaaacacttttgttttacactcatagatttgttgacaaaaagtactgcagttcttctcatccaagaataactaaaaagctcagatagcaagattgcattcactgcttcgctttcttaataagactgagcttatgaaacttgtgtgctctcctacattcactgcttcgctttcttaataagaccgagcttatgaaacttgtgtgctctcctgattttttttttgggtgatttttctctaaacaccatggcaagcaatatgtatcttacacccgctgcttaagctggtcttaaattggactgatggagtatcagaatttaacaattcattagaaagccaaaatagacatatgtagtgttatttccttttctgaagtaatagtaaagttatacacgaaatagaagcaaaaagttgagcaataatttagcacaacacacaaaaagcatagcatcgacttccaatggatgccacaagaacattgattcatttcacctgagagtggctgatgttgaaacgccgaccacttcgagtccactacaccatacatgtcaatgtacaccactacactatgctgcgatgaagccaaaaggtttctctgctgcgttcctgcttcaacccattgcatatttgagagaatcaccagctccttggaagaacaggcatgatagagcgaaatccgcaacgaaaatcccaactaaagaaacgaccactgcagatgtggtggactctccaacgcccttggctccaccatgggtggtgacaccccaagcacagctcacaacagcaataatggcgccaaacacctgagattttagcaaggaactgatcaagtcccatggccgcagcgcccttcgcgctgactccagaatgatgctggtactgacaccgaagatcgaatcagctaagaatgccgaggacgccagaccgagcgcgaagctcatgagggttagcacgggcagcgcaagcacacaagcgacgacgcgagggaccacgaggtaatcgacgggctgcgcaccaaggacgcggagggtgtcggtctgctccgacacctgcatggtccccagctctgcagcaaacgcggagccgacccggcccgcggcgacgacggcggtgacgaccggggagagctcgcgggagagcgcgagggcgaggacgccgccgacggagcggtggaggccgaggcgagtgaactcgcgcacgaactggatggtgaaggccatgccgacgaatgccgcggtgaggagcgagacccccgcgctcccggggcccacgcggcggagctgcgcgaggaggttgcggcggtggacgcggccggtgaggacgcggtggaagacctgccccgcgagaagcagcgccgagagcccccgccagatcgcgcgcggcggggaccacctggagaagggagggggcgggggctccggggacgccggcggaggcgagggcggagaattattgctgccggtgggggccggggtgagggagaggcggggcacgggcaggcggcggcacgaatggtggaggcggaagaggaggtgagacttgtggttcgcgctgtcgccggcgccggtacaggataagctgatgagagggtgggtggtagcggagattggacggagtaggaaggcggcgccggcaccggcggacggcatgacggtggccggagatcgggacggtggcggtgggtgggtggtgggcgattgggtgggtcggacggacggaggtgatggggatggcttcgtgctgcgggaaggtagtggttgttcttgtgggcttcttgatgttgggctttctgagctctcatgtgatgggatcactgggccaaggcccaagataagtcaactttgacaaaagttaatctatgttttaaaacttaattttagcatgatggttttgattttgtttttcgtagtttattttttattgctgacttttagttgtttagaaaaaatattatttataaattatttttattggaaaaatattatttataaattatttttattggttcgtttaacttttcatgctttgtaccatagcggcgcaacaactaatcacaaacacaatacggaacgggcgcacacgcagccacccgatccggaacagaacaccattaacacacgggtataagcctccattaatccttacttgcatcttcatcctcccatgcaaaattcaacctgagaattaattcacgtacacgaaagattagtggcagtagtgaagctgtggctatctcgctattgacttactatctcaataatggggcttgcatgtcagggcagagtcgcacatgcgttagtttgccgtgttcaactgcttgcaagttgcaacagcgatcgatgccaagctaataggtacagacactgcaaatctgcaatcctttgggcaagtacaggtacgtacatcatgggcatagggatggcaatgggtcgggt

SEQ ID NO: 74914 - DNA, 56612 bp, Oryza sativa
gtcatctattaaaaaacggaggtagtattacttttcatgtgtaaaacaatgcccactccgcaggtaccattccctctacaaaatttatcagtgtaaagctatctccatatgtactccctccgtcccataaaatactaacctagaatgagatgtgacgtttcctagtttggttttttttttatgaacggaaggagtagtgcgctaacctttggtcaggtcaactagcttatgtctcatgtgcgattctaaccatcctataatgtgctatcaataataagttttaaaagaagttatgttgttttaagaaacatgtttatcttgtggacagtttaaaagaagtaacataaataattgtgactattatctggctttttacgggaaacgttgtaatgtatatcaattataatagccatgtatgctaaaatttaatgagataaataaagctataaattaaatttaatcttatttaaatatatagtttagaattttgccctaaaaataagcacgcaagttttcttctctatttattggttacatggtacaattataaatgatgattggggagagaataatgccatagattgagaaatcaaacttttcaaggtgttgaatgtaaatatgtgagaatgaatgggtacttttgcaaatattttcactgatcatcggagtgcactgtccttcccgagacttcaggagagaccatataatttccacatatccttcatcgtacggttacgattcattctagtgttgtttttatctgcttttcaatcacagtcatcatgcaccacatggcgtggctctttccgtttccatgatcagattgtattttcactttggcatgtcaatgccgcaatgcctaagctttatggatgcggcttccctgttcccaatttgctgttcccttccctgttccttcgaggtgcatgctcctttctcgagagatatatgacaccatagttaattttttccccatcggatcttttttttcccgatcggatctttttttagtacctaactattataataagtggcttaaatcacgttatttccaattaatttactactaatacaagacatgttgtttgtatgaggagcacacactgtgctgaggtccatcagaagttctaacaatcgtcttgtgacacctgaaaggaacagggaagcgaacagcaaattgggaacaggaagccgcatccaaaccttcaatgccagaacttgaggcagaagtgaaaagggcacatcagacactgcattaacaggatagcttgatcctttcaactcaggctctgtgtagttcccaaaagaaaattttttacactgacaaattgaatatttggacacatacatggagtattaacaattacatagattacgtgtaaattgcgagacgaatcttttaagcctaattgcgccatgatttgacaatgtgctgctacaataaacatttgctaatgatggattaattagtaggggtgaaaacggatcggattcgggtggatagtagtcataccatatcctataccatattttttaatcggattcggaggcggtgcggataatgtgcggatgcggatgcggagcggattattttggatgtcggaaatggtgcggagtcggtgcggactcggctcggaaacggataaaaataatcggatgtggcatgtatatacaatcgatacaacatctgatcatctgtacaatgagcaacaatgactcacaattcacatgactcatgaaagcaccgatcacatcataatataatgtcaagttgttaacgattgacttgtcttctgtccatgtaatcgacacatatagtattgacatcatgatatatcgcattcacataacacgtaagacatagaaattccacaaatattagaaaaaacaatatcacatgacatgggtgatagaacattggaggtccacaaatgatgtccaattctcatacagtactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagaaggtaggccgcggcgccggggtggagaaggcaggtggcggcggtggcgctgggtggagaagtcaggcggcggcgtgggaggaatggaagaagagaagtctcgatgaaaaaattggttgacacgacgccgacggagtcacggactgaactcctagatagattgatggataaggtggacgtggatgggctgaatgtttacacgatgaaaatgctcgtgtcaaatgggccaaattgagaggttatatgggctgtgaaattcggattatccgccaaaacgtttatcggataatccgcttaaaatagcggataatccatatccgccggatataaccgataccatatccgcatccgcatccgcatccggccggatatctaaaaacccttaccatatcctcacttcggacggattcggagcggataatatccgtttcgttttcacccctattaattaggcttaataaatttgtctcgcagtttccttacggaatatgtaatttgttttgttactagattacgtttaatactttaaatatataccgtatatccgatgtgacaaacaaacccaaaaattttccccaactaaacaaggcctcagtaagtttacttcatgatctgcccccaactaaacagggccactaaattgatcgagcagtggctgacatggaagcctgctgctgctcctatggccggaatggcgacgtggccagatgggccttgagatataagatggtggcctggcccaatggcaaagccaattggattaccagaacagaatcatcaattccaacgtggcaatctcggtacgtgattacctcgtgatgtaagcaacgaagtcatccaggtctttgcgcgacgaccgacgagccggcggcggccacggaggcgcggatggcatctccgagctcccgtgcacgttgtcgcatggctactcctccgttagaaagcatggcctcctcgatggcttcctggatgtccttcgccggcgtgacctcgttgtgcttctcccatggccgcacgaggacgccggccttgaggtacttgcagaggagctcggcgtcccatggctggtcgcagtgcatgggccaggcaagaatcagctacccgtggctcaggctctccatggtggagttccagccgcagtggctcatgaacgccgccgtggcgtcgtgcgccaggatctccagctgcggcgcccacccggtgatcaccagccccgtactcccttcgttgtgctgcgtgaactcgcgcagcagcttcgcgtggcggctgatgatctcgccggagtcctccgcgaatatgtctccgcggtcggcgtcccgcaacacccagatgaaccgctgattgctgccgcgcagcgccgatgcgagctcttcgatttgctccgctcgcagcgacgatgtcgtgccgaaggagacgtacagcaccgacgcagggggctgcttgtcgagccagtccaggcactcgtggcgctgccgctggtcgccctgcttcgacgcgttcccgtgcagcagtgggttcaacggtccgacggcgaaaaccttcttgccgtcggcggccaggttccccgcgacgacgtcgatgaactcgccctcgagcgcgcgacacgtgttggtcaggatacctctgggaggcgacatctccttggtcgccctcgtccgtctgatgtaatccacgaactcctccgttgcacagtcttccacggtgatgttggtgaggccgttctcgcgcaggatccgttggtgctcctggggagcaatcctcctagcgagcatcgacacggccaagcagtacatgacgaacgcctcgccgttgcgcagccgcgccgcctcctgtgcggcgaagtcgttgatgcggtcgtacacgacgacgacgcggcggtaggaggcggagagcttgtcgaggagagccgcgagcggggcgggcgcgccggcggtgtaggcttcccagaggggcatgaggtgggaggggaagggcgaggcggcggcggggtcgggaggcggtgaggcgtacgtggagatgccgaggtcgtggaaccggacggagcggagcgccgcgtcgtccccgccctgcacccgctcgcgggcctggcggacgtgagccgcgggcgccgcgtagtgcacgtccaccccgccgcgcgaggcgagctgcagcgacaggtgcaggagctggttgaggtggccctgcgccgggaacggcaccgccacgacggccaccggctccattgtaggctcgatgactgtgctcaaccttgatgggcagatgcggctatatgtaggctgcgggcactggcgtttgcgggtcagagtgagctcagccagtggtgaatcaaaaggcaacttggcatccgtgtggaaatgggttgcaccggaagcttccgctgcaccgctaacggctagaattgctccgatgcacagccgactagcaaataatattccacagtccacccggctccattgtgtgtcataccaccatttttctgcgggagaggattctaataactcgagtggatgtccacccgtttattgcatatgaactagatggttatgaaaaatttttaaaaaaattgacaagatatatcaatatgtaatatatcactccacaaacatgcaagttcaaattcaacttctacaggttgtaacaaaaataacaaatttaattgtaaatatacatatagtaatttgagttttgtttgttacaacttgtagaagttaaattttaacttctatgtttatgtattgatatattacatattgatctatcttattcatattttttttatttttttataactatttagataacatacaataaacgggtgaacgtccactcgagctgttaaacagtttcccatttttctgcgcctcgttcggcggcctatatatgaggttattttttcccaaagacaatgttgtacgtagtactacgtatatgcttacgtgcagacaccaccatacacatccatccatccatcctctcaagcatgcggttttgccggctgcagattggaccacgtggcaccgttaaaagttgagataaatacgagaaattacgaatggtaaaaaactccacagcggtaatttcgggtgtttggtctcgcgcggagagtcacgtccttgtcaatctctctcgtggatgggcttgatcagcccatgagcgtagccaggagccatgttggcccatcactatgcgtggacagtgcgggctgagccaacctcgtgcagtcgtgctgagctgcccagcctcccacgcacgtgggatgtggcttagccatgttggtgcacaaacattgctacgggctgaacgccaagccttgtggacagtataaacatgttgcagtatcaaatcctaaaataataataaagaagtgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaatactatttgctatccatatagtttgtgaaggttacaatagttaaagttcatatatatgggtctcatctctatagactacttttgccatatacattgttgttgcccttagcatcctgtattatcaaagtaatattaacatacaaaccataaagtagcaaagcttttatccttccttcaaataacaaataaaatataaattgtaaattgtaaaaacatttaatgctaactctacgagttttactgtttagggaagtgtggatataaacaactccaagaaatacaatgggtgaaactgaaattcctaacaagcaagttaacaatgatgttatcctatatctatattcgtagagaatgaaaaaaaaaagaaccagagaatgcaaaacaatcagtactagtatatgtattttcttataattccccaaattcaaacagattatatgtaaatactttcaattcacaaaagtggcaaaagattccaaaaatacagttttctacattaaactaactaccaccttgaatgctttttaagcatatattactatcatactttcatttttttctcttcataattctacaaacatgaaactaagaacacactaaaacatacctttaaaagtatggtgtttataagaaattttatgagtatgtaactaactgctataaaaatgtaaattccaaaaaagatttaaatagcatatatataatctccaacaaataagataagacacatgcttaattagcgatcacgccaacaagcgcgcctatcttctagtacatctttctattattctatacacattcgtgagtatttctttctaattaatatattttgattttgaagatgtggaggctaacggtgaatttttgagctccactaaactctattaagatccgccatttggaccttcacatttcctaattgttatttccaattttttcgagtgccgggggtatatgttcgtaaataaataataacgtgtttctatatctgagtaagattgttcagaaaaaaacaaagactctgactcaccaccctcttccccgctgcccgccgaccttgccgctggtctgtcaccccggatctggacggcaccttctccgctgcctcggtgcacctgcccgctgtagtgtcctcgggggaaggaagggagctccgccgttgtgatccttgcggtcagctggcttgtcggtggcctgctcaagcagcggcgatgcggagaagaggagggaggtggcgggcgacgcgggcgcttggtcgccatctgatggggctggagcgagacacaggtagtcaggcagttcccttgaaaaaatatatatcataccaccgttcataaatataatcactttaggttgtttagcgaaatttgaagataagagaaaatattagttttcagtgattgatcaaattttaaatttggaattgttagtatccccctggtaggatcctcatagtctgaaaataatttgaatccccgtaaattgagatcagtatttcagaaatgcttatattgctgacataatttgaattctacaaatacttatatttgataacagagagagtagtacatatattttcctactgtgagcatttttcaaatttaatatattttgacgaatgattcaaatctactccctccgtccagatgtgatacatcctagtactacgaatccggatatacatgtctagatttatagtgctataatatgttacatcatgttctagatttgtttttaataggacggagtatagtatatccgaccgctcgaagaattagagacattcctgcttcatcttgtgatgtagccaacgaagtcatccaagcctttccgcgaggacccgccgtctgccacagacgcgcggacggcctcgccgagctcctttgcccgccgccgtattgtcatccctttctcaggcagcatcgcctcctcaatgacctcctggatggcctccgccgggaccacctcgctgtgcttctcccatggcctcacgaggaggccagccttgaggtatttgcacaccagctctgcgtcccatggctggtcggagtgcatgggccacgcaagaatcggcttcccgtaactcaggctctccatggtcgagttccagccgcagtggctcatgaacgccgccgtggcgccgtgcgcgaggatctccagctgcggcgcccacccggtgatcaccaaccccactccctcggtttctgcggtgaaccgggacagcagctccgcgtgccggctctcgccggagtcggcgaatatgttggcgcggtcggcatcgcgaagcacccagatgaacctctgcttgctgcccttcagcgccgcggcgagctccgcgacttgatcgccacggagggacgacgttgtgccgaatgacacgtagaggacggacgccagcggctgcttgtcgagccagtccatgcactcgtgccgcgtctggcctggcgtccgggcggtcgcgtcgagcagtgggttcagtggaccggccgcgaaaagcttcagctctttgaacatcgggtgcgtcgcgatctcgtcgatgaactcggcctcgagcgcccgggacgtgttcatgagtatgccggagctggccgcgttctcttcgtcctgctctgcccggctgatgagctccacgaattcctttgtcatgcaggcctccacggggtggaacttgaggccgtgctcgcgtacgagccggtgctcggggtccaaccacccgatgttgtacgacatggccacgcactgcagcccgaacgcctcgccgttcggcagacgcgccgcctgggcggcggcgaaggagttcaaccggtcgtacacgacgaccacgcgtcggtagctggccgacagcctctcgagcagcgcggcgagagggacgcgcgccgcgacggcgaagctctccagcatgggcatcaggtgggacgggaagggcggggcggtcgggtcggggggcggggactcgtaggcggggacgtcgaggtcgtggaagcggatggagcggagcgcgtcggggtcccagccgtgcaggcgcaaccgcgcctgccggaggtgcgccggcggcgccgcgtagtgcacgtccagcccccgcgacgcgagcagcagagacaggtgcatgagctggttcaggtggccctgcgccgggaagggcaccgcgacgacggccaccgattccaccgtgccaatcgccatcgagtgctcttgtcactggttgcttgtttatgcttgtctatttctaggatttttaatgccccgtagcctatacacttttacaggttatatatagagttataggcacacacgcacgaacagtcgaagacaaatatgtggggaaaaagttacatcagtagcttccaattcccattgctgatatcgcgcagatccagagcatcagagattcgagggctgacacggacgcacatctgttcccgccccctcgcgctcatccgcccttcctagaatgctcgtcagcaacaacggcgcttccagccgctggctcaatcattgtcagagactgcaggagcgtggcgcgctcgtcatcagtgacgactaacgacggcgtcggcgggccgatcgcttgtatcgcggcctctccaaaacggtacgtaccgccctgttgcggctctgcgatgatatcgttttgtataccattttggcatgtgctctgtatctcgattctcgaggcagagaagttgttggttggttccagggaatcttactgtttaaattgtactacgactaatgcactgttgtcatgtgatgttttagttcactaatagtatatgcacttttggtgcattagttaaacttgcagcaaattcatgtgtggaactgtggatcgacgaccagggcgtcgcacatcgcacatcaggctgattggatactacagtactactcccgtgcgatgaggctcttggaccagaccggcctccttcttcgttacgtacgttacgcgaagatgccatcgtccggcagtcggcagagtcccagagattactacatagccgttctcaccgtgtggtttgtttcttcctccctcgcgcgcatgcagcaaacgcgaagaatctaccgcacggtccgcaccgcgtttaattttctgcatggtcgtcgccgtccttgctgcggacccttgcctctgcgtcgttgtccaaattgggtgccacgaaaaaaaggcccaactggctgatcaccacttgccaattgtaggtcgagcgccggcaggcaagttgctcgactgctgcacttgccaacttgcatttattgtacttactcctatcctacaaaatgtatgtcgttatagcagtaggggtaaaacgattatataaaacgaaaaacgagataagttattaacggatgattagggttcaattcattttctaactgaagattattactggtacgtaaaatgagataagttattaatggatgattaattaaatataaactattataaattataaaaaaatatataaatatacctattgtttaaccgttcattaagaatgttaattgaaaataaggaaaagtcaaaacagagatgttgaaacgaactcaaccttacaaaatgtaacaaatgctgtactattttatgggggttgctatatgttttttcgattttttttttgcgctctccccatttgctggcgcgttttccttttctcgatcttttaatctttagcgagtgtttttttatttttaatgtattttacaatttagatattttatctcaactttcaaaacattctatttaaaactttcaacttaaaattcaaaacttaaataaatcttgagttgaaagtttttaaatcttaactcgaaagtttaaattttgagtcaaaaattttcaaaatttgacttgaaagttcaaattttgagttgaaagttttaaaaatttgagttgaaagttttaaaaatatgaaatgtaagtttatatacatgtatgtatgtatgtgtgtgtattagtagtgctatttgtagtatagtagtagtactactaccaccaccacctagcagcagcaacagcaatgctagtagttctagctgcgcgtggggcccactagtagcagcagaagcgctagtaggcgctagtaataacagtagtaatctcttcatgttgtaagactttcaagcattgtttatattcatttagaagttatgtgtctagatttattaacatctatatgaatatgggtaatgctagaaagtcttacagaggaagtagtagactggtactctagtagtagtactagtagactagtagtagtagtaggagcgaactgttcatgtgcccacaccctgcgcgaccagtcgcgcattagcccccccccggaaaacttgtctgtcggcctgtacacgggccacgtgtggaggggaggaaaggaataagttcaccagccgtcccttaagctttatgtcgagtttgtataacatccctaatccttaatactagaaattttcactcctaaactatataaaaccgtgcaatttatatcttatagcagtactgatctctagtttcacttacgtggcatcctagtaacaaaaaaaaaaattataggacccatatgtaagagagaagaagaaaatgtagggtccacatctcttattttttctcttttctcttttcttttctactctctcttatcttcttcagcgagcctgggaggccgtcggtggcaaaggggggagaggtggttcaacggttctgggagagagggggaggtgtccggtgagcccgtccgagctctgccaccgccttgagctccatgcgaagggaggagggaacggggtagatgtagagattgacgaaaatcttggcatggtagacgctggacagggtggcaggtgaggatgacatgtgggcccgcatattttgttttaattttttagtttctagttttgctcctaatgccacatcagccactgcggacttaccatgcatcgagggaccttgtttgaatgattttgaaagttgggggcctcgtttgcatgattcatggacgattttgaaactcaacgacaaagcgagagacctcgagtgaactttttcttttcaccatggtagagcaatgtgagcccattagaatatgctgggcctgttggcccgtccggcatacatctaagcacctgtaggtttttgtttagaaaaagaaaaagataagaccaaatatttcgtttcaatcaccttatatcaaattttaaattgttaaaatcccctcatagcacttgattgtctgaagatgatttgaatttccatacaatggaatcagtatttcagaaatggctactgcatacagaatttgaatccgggaaatgcttatttgagaatggagggagtggtacacatattttcctacttaggccattttttaaaatttgatatgtttcgacgtaagattaatatttatagcatatccgaccactcgaagaatcacaggatattcctgcttcatcttgtgatgtagccaacgaagtcatccaggtctttccgcgaggacccgccgtctgccacggacgcgcggacgacttcgccgagctccattgcccgccgccgtattgccatccctttctcaggcagcatcgcctcttcgatgacctcttggatggcctccgccgggaccacctcgctgtgcttctccaatggtctcacgagcagaccagccttgaggtatttgcacaccagctctgcgtcccatggctggtcggagtgcatgggccacgcaagaatcggcttcccatggctcaggctctccatcgtcgagttccagccacagtggctcatgaacgccgcagtggcgccgtgcgcgaggatctccagctgcggcgcccacccggtgatcaccagccccactccctcggtttctgcggtgaaccgggacagcagctccgcgtgccggctctcgccggagtcggcgaatatgtcggcgcggtcggcgtcgcgaagcacccagatgaacctctgcttgctgcccttcagcgccgcggcgagctccgcgacttgatcgccacggagggacgacgttgtgccgaatgacacgtagaggacggacgccgccggctgcttgtcgagccagtccatgcactcgtgccgcgtctggcctggcgtccgggcggtcgcgtcgagcagtgggttcagtggaccgaccgcgaaaagcttcatctctttgaacatcgggtgcgcggcgatctcgtcgatgaactcggcctcgatcgcccgggacgtgttcatgagcatgccggagctggtcgcgttctcttcgtcctgctcttcccggctgatgaactccacgaattcctttggcatgcaggcctccacggggtggaacttgaggccgtgctcgcgtacgagccggttctcggggtccaaccacccgatgttgtacgacatggccacgcactgcagcccgaacgcctcgccgttcggcagacgcgccgcctgggcggcggcgaaggagttcaaccggtcgtacacgacaaccacgcggctatagctggccgagatcctctcgagcagcgcggcgaacggggcgcgcgccgcgacggcgaagctctggatcatgggcatcatgtgggacgggaacggcggggcggtcgggtcgggcggcggggactcgtaggcggggacgtcgaggtcgtggaagcggatggagcggagcgcgtcggggtcccagccgtgcaggcgcgaccgcgcctgccggaggtgcgccggcggcgccgcgtagtgcacgtccagcccacgcgacgcgagcagcagggacaggtgcatgagctggttcaggtggccctgcgccgggaagggcaccgcgacaacggccacggattccaccgagccaatcgccattgagcgcttatgtcgtcactgatatatggttgtttatgcttgtctaccttccagaattctagtgcccagtagcctctagacttgcaggctttatataggcacacaataatgaggctgtgtttagttccacgctaaaattaaaagtttaaagaaattaaaacgatgtgacggaaaagttaaaagtttgtgtgtgtaggaaagttcgatgtgacgaaaaagttagaaatttgaagaaaaataggtgaatagttaatttagcccctcaagtttcagcgaaggctcaatttgatccttcacctattattttgtccacatagatacttcaaatatttgttttggcttgaaatcatccttggatccacttaatatgccatatggctatttctagtcaatatttctattagaaaatgtcctttttgcccccaatttatatacatctatatactagaaaagagaaagccaacataaataaacaacattacagatctacttcccattatttcaacatgtgcacatgaaacttaagcaattgctatcgtatacacttgctaatacatatttttttttcgttttacataatatactatgtattatctataaaaaaaattcaagcatgcaatttctctcttatatatgtgaatgatgaggggtataagtatcatttatgaagagagttgttggttaaggataagtttgaactaaaatgaaaacttgaaggactaatatggatagattgaaatatcaaggactaaactgagcctcagatgaaatttggaggaccactttgcctattcacccaataaaaaatattagaatctaaacagggcaagagttggagtataagagccccatcggtagaactaaaaatcaataagcaaaagtcaaaatttaaattttcaaacttaatttttaagtagcatattcttataccagatgtgacatattcttgtatcacaaatatgaatatatgtatgtatatattcgtagtgttagaatgtgtcatatctaacattatagtttggttttttatgctactgagggagtacaacagtagccgttctcagttctcaccgtggtttctttctccctgcgcgcatgaatggtgcaaaggcgaagagtcaccacgccgcgtttaactttctcattctcaccgtggtttcttcctccctgcgtgcatgaaccgcgaaaggcgaagagtcaccacgccgcgtttaactttctgcatggtcgccggacccttggctctgcgtcgttctccaaatcgggtgccacgaaagagaggctgagtggctggatcttgtagtattggctgactgttgctcgctggtttaatttgggagtttaggacggtagcggctggatgagatggagatagccggacagggaggtgataccggccggatatatgacactgccgggagatttcgacatttattttgtagaccttgcagttgtggataaacggaagtagcttgctgcaggctgcaccgtttgattgattggaagagtgtggcattcaccccatctcaatcgatccacaactgctatttattggctggagttacgtttctgatggagagatttaaataaatgtatcaattatgtcctgcacatcagcatcattgggtccatagctcagtggtagagcatttgactgcagatcaagaggtcaccggttcgaacccggttgggccctatttaacaatttcacatttttacttttgacggtgaagtttttttttttccacagtgattttgttgctgccctggcctatgtttgacggtgaagttttttttttccacagtgattttgttgctgccctggcctatttgagctccaaaaggagagatccatggagttttttttccacagtgattttgttgctgccctggcctatttgagctccaaaaggagatatccatggaattttccctacaatctctttgttgatgttctgatgaagccgcaaacgatttacatttgacggtgaagcttttttttttccacataagcccagttagggaggtgattttgttgctgccctggcctatttgagctgcaaaaggagagctccatggaattttaccaacaatctctttgctgatgttctgatgaagcggcaaacattttttcctacatttttgtcccgatgatgctacaaacaattgaataatagcccactagagaaactatattttctaaactttattttcattgtggctaaatttgtttcccattccagaaggagccacaaaagactaaataatagtccactagaaaagttatcttttatacaccttatttccctcgtggagctacggacgttgaataattttctttcctgatggagccacaaacgtttgaataatataagtgaaagtgatcattgaaaattattattattttcttcttcttcttctgagaagatcgctgcaatttttccgcacgtggtgcttttggcctgtaggagatcactaaaattgcttgtgcatggtttcgtacatcttttttttttaaggaatcaacatgagattgtactatttcattatttcattagatatagacgtaaaaaaaaacttcccctagaagtaaaaaagagctgtacaaaattacataagcgccgtagttaagttgggatgaattcttcaagtcgccttgcgcttaccattatccaggttcttgcctcttcctttatttttgccataaggttggagactgccgttttcttttgctcgaagatcttttgattcctttctttctagatttctcaggctatgagtaggattaaggatcataactctttcttggacactttttttttttgatagtaacctccaaaacagttctgaggaatgttgtgcacagtagcacggcaggtaataggaaccccaccctgagcatagtgccgtggtggcgccgtgcaaacaaagcttaaggcctattcgtttttgaagaatttcaaatgattcagattcttgaggattaattcctctgaacgctatttagttcataggaatgtagctatagaaaaaacaaagaaattttcctttcctacaagttgtaaagagaaggtatagtgaatttttcatccactcagaactcatggaaaagttcatatggatagaaatgtgtatgcattcatattccttcatttttcttttttctatgtgtcataattccttcaaaacagatctacccttaagggtccataatgtgatgaaaaactaggtattaagcattgaatgcactcttgctaccaggtggcaaccattgtaaaagtcataagcaactaataccttatcatagagctactaccggtacataagaaataaatatcatcatttgtacagtaaatgagtagtagaagtaaatctggcacatgcaagtaaaatattagtagaagaaaccatggagtcattgtttcgcaccgttcacaggaatcaacttttaagtggatcctaccagtagcgcaggtaaggggagtgccaaagggtgccaacacccccctatccaaacactaccaccactatacccctatgtttttactctatattaagttagctaagataagtatctatctagtttattttgtgtagcttgaaagtattatcagtttagttagttagcaagtctaaaaatattagcaagaaacatgatttacaaaactagtttgtgatttctcatatttttcaaagtaaaatagatgatacttatttgtgagattattttatagtttacattaaaagaatttagcaataaagactagttttaaacttccaatgatattattaaagagctaaaattcaagtttttcttaaagaactagtttacatattgcttgttattgacggtgactatttgatctcctttactatcaatattagttatttggtctcacggtttatctttatcccacaccccctaatctcaaatcctggcttcgcccctgatcctaccttacttctcactcacacaaataagcattgtgggtaacttcatatactactatcacctgtatcttgggcccacgttactactgagtctggcaagatacgttgctcatgccctaaaagaaacatatcgctgcaacaaagtgacagatgtaggatctggctagaaaaaacatcacaaccagttcagacatgagtaacatagaaaagttaagcccggccatcgtggccgccgcagccgccgccgccgtcgtggtggtggcaaccattgttatccttgaagtcaccatcgagcaccgccgccactggatccgtccccttcaccatcaccgccgccgcagcctccacctcctttgccaaagagatggaatatataagctagtatatcatattcttgcaaaaaaaaaagcattatcacaaattccaagaaagatataccatcccaacttcaattttagcaacaactaaaggcatgttcaaatcactgccaaaatgaataatgatatggtttagaaacatccatatatttattaattttatcaataatggtatgctttaaattggcatctatgtgaacggggccctaaatcactcggtccgtggagcgaccggtgagtcacgtgactcacgttgacgatcgttgccttctgcggacgcgctcccatccggcgccacctccgtagttgccacctccgcggaacgcttctcgccatcatcgttgcaccgtactgcgtcggagcacggctgctgcggcgcctgcgccggcggcgtcatcatcagccgttcttgctcagctgcagcagcggcttgagcctgatcgatacgtcgttggcggaagagctccttcacgagctgccaaagcacacgcctcgcgtgcatctcgggcgtctcctgcgcgggccgtggctggacgacggacggcgacggcggtcgtcgcatcaccagtgtccgatcaaaggagttgccggagttagtaggcgctgccgttgccgggcgaggacgcaatggcgtcggagggacgttgttgaatggccgcgcctgcggccgctgcacatgcgccgggcagttgcatgccgccggcgcccgttgcgccgacgacttcgtctctccgttttgttccacctccgccccctgcgctggcatcatcgcttgcggctgttgtgccgacgtcgtgtgtgccaccacctctctcccctgtagatgctgcgcctggaggttgtacgccattgccgcctgctgctgctgctgctgttgcagaagcatctggtgatactggtagttgttgtacgccgctgccattgccgcccgctgtcgttgtaccggcgacatctgtccgttgcttgccacctgcgatccctgaacaacaagcgcctgctggccgttgcacgccggcggcggccgttgcgaggacgaggcctgcccgttgtctgccaccaccatcccctgctggccattgcgtgccgccagctgttgcagaaacatcatttgccgtctgttgtttgcggccgtcgccatttgccgtcgcatcatcatctggtcgccgtataccacctgcccgttcggcattcgcatcgggccattgaccgtcgcgtgctgccgaggaggaggcgccgttgcgtggccggccggacgtgccatcgggtgcccggctcgattgtcgtgcacggccgttctcagcggcatttgcatgccgccggcgccgccgatgtacgacgcgggcggtggcggcggcgctcctcccatggtcagcttccgctgctgatgcggcctctgcgccacggcggcgtgctcctccgcaggcctcttattgcccgacgcctcttcgctggttcccattgccggcccgggctgcggcgaggagaattctccatcggaagaggcgatgctggcgattgcttggggcccgggctgcggcgaggggtgctcgacgagctcctccttcggctcgaaccggaacccgagggggaccttctccttcttgtctcctctgccaccggtgcccctcttctcctctccttctgccatatcggctattcaacctgcccaatcgaggttgcctggataatggctcaaataaatttttataatcacccgacgttaagtttgcaatttgagatgaactcaaactctatggatggcaggagcagctggagtccggaacaagacgggtttgattccaattcaattccaattcaaatcggtaaggaaacggtaagaacatgagcatatctatatttatacctataattaaaaaaatacgcaaggtttccgtaattttttttatttttcaccttttttctttttcttttatcatttcctttttttctccgtccttttttttctttctgtccgcttctttttttttcttttttatccgtcctttttttctttatttccgtccttctgaacctttttattttttttattttttttctgtttttttccatccattgtttttttcgtccgcctttttttcttcaccttttttctctttttttcatccacagtttttttacttttttctaggcctttttactgggttttttttcatactttttttctttgtttatgtttttttagttgcattttttcgcatgcggtaaggatttttttacgtgccatattttttttgtcgcccggtgttaacagtgaaatttggtaagtccggagtagtcatcggctttgaagttctgagattagccgatgagagttgtcaagtcgtcagttgtcggattcttgctatattcggttaaggagattgatctactaaatgaagcttatccagaaaagaccgagttcaaagagaatgcggcatggcaagttatctattaattagaaataatttgttagtttccttttatctttaggaaagtttctttcttgtccggcaagaacttgtatcaacacatgggtataaatatgtacacccggggtctatgtaatctatcttcacgatcaatacaattcggcgcatcgccaccttttaccttttctactttattttatcgtccggcggaacttggcacctgacgcggggctgcatcggtgttcgatctccggctaaggggtaagtccaatgtttcgctggcccgggcaattgtatcatttacgtcggcgtcgttcaaggctgcatcagtacattcgacctctttgattgctctggtttggatgatatatttgcctacctatttatcatatgtctatgttaatctagtcttagcatatcaatttagctctatcgactgcttctctttttagggtttctgccggtatcggctaaatcgcgttgttagattagattagcttagacatctaccaccctccaccctgaaaactcagtcaacggcttgattgcctagatattatgtttcttttcatacttagtgctgcatcaattaagtttgatctactaagtcgtgtttagaaccataatctctaggctgcttcttgattgccaataagggtttcatcgaggtttcagccaatgagttatctggatgttgcatcagctcataaggattgtatatacatataagctggatttagccgatgacaacaaaggtttcactgtttaatctaatcttgtggatttcatgacatcagacctccagccgatgtgtgctctaaccttcggatcgatgcttatttatcatatcattatttgccgattggtttatactggattatattgttattttatttcatcatcatcagccgattgcctttatatcattatctacattggacatatagccgatcgcttaaaccctatcgctatcggctggtatcggcatcggctattatcggctatcggctggaactactccatcggcttgtcagccgattggctgtttgatctactgtttgcatatcttgtcagttgcaggatcaaactgactggcatggctgcatctcatcaagatttggacctgcacaggagctaagcagatctcccaggccggtgtgttcaattttttcgtcaacacccggctaaacactagcgccaccacctcgtcgatctgccttcccatgcgttccctcctccaattgattgccaaaaatcaattccccgctactccctaaccattttactatgatttccccttttaactccgctttaattcactgaatttaatctccatttaaaattcaccctttttatcccgagttttgtcgcttcgattttaataaaaacggaaagaggatatctcccgagttttgtagctccgattttaataaaaacgaggggattgagtgtatcaaaaaccctcaatcaattttggaagatcgagaaagattcaaccggatttgatggggaggatttgatcggatttgatggggaggatcggttttggcatgtacgaacacgacattgtcttacggaggttgaagacaacagtcggctctgcgagctggacctacaactccagttgacaaggaaggaatgaaatgaacttttggtacaaaatcaaagagtaaaatgtatagcgatccaaaaatatttctacccgttgcaacgcacggatatttttctagttatataatagtgggcattttttctagtttatataatagttttaagaacctcagcatatatgtacttttatggcattggatttactatggataataattaaagtttgattctgaatactatgccaagtcaaaccacgcgttataatttgagacatggcatagggagtactgtatcattatatatgcaggggtgaaaacggtagggataaatatcataaattccggccacagatcgcttccacattccaccagccaattcaatcagccatttcattaattgtctaaaacattgttgattactacaccggtgtatgaaaaaatgaatttaaacagggagaagcgacagttgactctggcatctttaggacctgactaacaaaacaaatcagctgcacctgcatgaggagaatttcatgtacaatattgtggtaccttgggcctagtttgaaattattttttccaaaacttgagttgaatcttgaaagcttgtaagcaatcccttatttagggtgatttctgttttcctgcaactgataatcgtctggaaggaccatacattggagttttcagcagcacacactgaagagcacttcggacgccgtccactgccagggtttgagcaagattgacaaatataagcgacaatatgaaatcagatacttccttgtaagttgccaaaaaaaaaacaaaaaacaaaggaaggaaaagtagtcggacacttctaacttgttaagcaagagcatacatcactatatcagcgttgccatgcgcttacattacttgatttttccatttctgaacagaaaaacatagcaagagcgcttggctcatacagtttactacaagaaaaacatgatatctagtggtgattgatcctgtagggagcgatcaaaagcattcaaaagttgctttctattgatactaccatgccttaccatgtcatatatatcattctgaggtgtcatccgctgctcaataatatcggatcggctaccagcaaataattgtgctattgtcccaggaatatctgaaagtacggtattagtttgactgcctttacttgttagattgctggggggtaggatcatggcatttcattttgcagattgacgtgccaaccactctgatctggttaaaccacagtaccttgtgctacttccaggccacataaggaaattccagccaatgggagatccaccgacaatataagatccttgcaaacattgtcctgatttctttgtagaatctgttacactcggtttggcatcatgcttaatgtccacaggattgagtggtaccttctcaccagaactatgcataaaggatgcagcctggtctgctggacgaacttgattcttctctccgggtgggattttccctgcaggcatatttctggcatctcttgatgtaggctcatccatcagttttacaggcccagctgcagttgggagatcaagtcgcatttccttggataattccatgagaacttttatctctgcatagtgtgaaccaagggaagattgcttaaacttatcatcaataaacacatccagatataacattaagctccaggtgctcaacagattttgtaggccaaacaacagggatccactttggttgaccttttaactttacagataacatgtacattttcaaattgctaattatgattgggctaatgcaggatattatgaataagtacatcagtagccttttttacactaacagaatgaccgactaatgcactatatttcacttacttactaatgtagggtactaggcatcttattattggagtatgtaaccgatagttatgcttgcattaagaagcctaatacaatacatcatgtgacaatataagtaggaatttgtaaaagtgtataatgactataaacaacatgtttacaagttatagaaatgtaacaactgatgaaaaattgcaagtgtccaatcacaagggttttagatatcttaacagcacgaagtgactatggactacatctacagagaggcaatgactgtcaaatcacctgaggtaatcttagtgtgcaaaatatcaagagagaagtgtgcttttatgaaagaaggtgaaagtaaaattgttcgagtgatcaacataatctcctataccatactgatttctgtacttgcgagcatgatgataaaaaatagtcaaaaactcaaaatgtaatcaggacgttccgcatgtctgttcaaaaacaatataaattaggatttacctttcaggatctcaagagcggcatctttcttttgggtatcagtgcctttgcataacttcaaaacaacaaggaaaaagtaaacattttagagcggattcatgttcttcccagaacaaactgcatttacaattgtcaaaccaacagcaagcagggatatcaatttggtgtaagttatgatacaataatatgatttttctctggtccttgggaggtagagaggtatttttagtgttaatcgggaagtatagtctctactgagagcgaggtatacctcttgattaacaatatggggtaaaactctcaatacctcccaaagccacacatcagccatgaaaatgttcatttgcatagtaggacaatggtggcattaacaactcagttcagaatcatcacaccataaatttcagctagaaagagattacgcgcctaattgtattgagacttggcccaaaattcaacttcaactttaatttaaattctcccagagtttcaccagcaagcacagcacggagcaaatagcttcgagctctcgaactcgaaccattgatcacacttatccacgtcaagcaaaatcatcccatacacgttgcgctagaacacgggaacatgacctgttcagttgattgtgctgctgctgctgctgctgccatggcagagcagagaaatgccactcaacaaatatcttagggttcgaggtgggggagacctgaatgaagcggccgcggaggttggcgacggctgctctgatgttgtagtagggtgagtgatgaaaccccacctcctccagcttccgcttcttcggtgccgcggtcgaagacgtcggcggcggaggcgggggctttgggtcgctggtaggcgtggactctgacggcggcggcggaggaggaggcggggtggtggtcgtcggagcgaccatcgcggtagcggcggagcgtggggtttttctgcaaccttccctgcctactttggaacaaaggaatttttatcccctctatctcaagaggagtgtcagagcattagcggtatatagatatatagaacaccattaatattaaataaaatttaaataatatggataagaaaacatagagattcgtctgatgatttttatacaatatataggatgcatgtaactctatagagcccaagtccaataagtgttaaggtggatgtttgtaaaaaatatcaattttttatttgagatatcaggtctaagcaaagagcccatttgctccatttggtgcttaagatctacatttacaatatactgataagattcccttaggatatcccaataacatggttcatagataatataatattacatcagtcatacagtaacattgtacaataaatcaatacgaagaaaataatgaaagatatccattgggctattcggcaagcggacaacatcggctgtggctatgctaccgctgcgtgtgtgcggcattgttggtgcagctacagcgcaaccataaatctagtagccaaacaaaccctatatgcatatggactacccatataaaataaacaatactcctattatctatctctcctaatgttatctcgtgtatattactatatttaaagtccatgtatgtgagtcccatatatattaatcactttttgctatatacattgctgatgctgtgattactcttattcccacattgtagatactgctatactccctccgttccataatataaaggattatgaccttttacttgtactgtttgaccactcgtcttattaaaaaaaattatgcaaatataaaaaatgaaaagttgcgtttaaagtactttggataataaagccagtcacaaataaaataaataataattctaaattatttttgaataatataaaatcctaaaatataacactttttagttatgcatataaacaagcaatcacttattcatatttcttaccgcagaagcttatatttaaaatctgctttgaggctttttttggaacaacatattattgaaagaatttaagaggtttgcattcctctagaaattttccgtatagacttgtttgagacaaaggaaagatgttgaattaataaatgcatcaagaaaaaaaaaatctcacagctctttaactgtatggcgcaaaataatcgttggacagctgactatggcaaaataaccggaactggttcgacacaacttttcatgggcctctgggcgcaccgctcacacatgccgatacaacttcccatggcccatcgagaaccgcgagcgcctcaacttcccctgggcctccccgccgtttcgtttccgttctgctctcactgacaaagtggcccacaccgcagcaggccccacctgccattgtcgtgcggagaccgtgtccgggacgaactggagaggcagccgcccacacggccacacgtctgtcggcttatccgggtggggaagccatggccattggccaccaccacccaaggggagcgcaagcgcagaggacaagagcgcctcctcgtctggtctgcttcggccccccgctcgctcctcctgccgaagcactcactcttcggctgctcatcctcctcctcctcctcaggtcagcaagattcatccggtttcacttggattgtctgggatttggtagttgaagcatttggctattcttgttttgcgcatgctcctagttcgtctgcgtgggagaaaatactgaaaagggggtagttcgtgtgtgtgtgtgagcatgccccattgtttggcattttgttggagctgtatatatgtgtcattggctagaactttgcaatgtcactacctgcttaagctcagcaattgtgcttcagttcgtgcaaccttttgtactaagctgaacttttattttttcctctcctggtacctacaataaccttgtctcagatgcaaaaggatctctttagtaaaaggcactttgcttcatgtagtattattgctgtcagatgctggcaaacattattggggctcggcattcttttctttctcgaactcaaattagcagtttggaagagtgcgtcctacaagtagcaatcgtataccgcaatagtgtgaagtaagttgcaaatcaaatgcatatggcaatctagtatattgacaacttttgccgctatgcaagttttttgggagaacttaagctccccaaatataagttgcacgttttgcggaacttgcattgtccaggagaacccccaacctcccacaaaaactttgagtgacttaacttaagattgatgatttatagggccttctgttccctctaatatagttgcgcatttttgtacttgtactgatttctttgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattggaagctaagaaaaactcccaatctgtatctcttttaccaatgtaatatataatttatatagattattatgccttgtattttgttccactccaacttttgtgcagaaatgaatggagaagatctaagagcaatactggtaagctctaaataattttctatctaaaaaaactctagataactgaaaagagttcagctgttgtatttgcgacttcaatgtttccttagaataaaaacaataatttctaattctgtaaaactagtctttgcaggatcacaaaacattaggtcaccattcattgttgtgcaggattatcttaagcaaagttacatgtggtattcctctattttcttccttcccaccagcatctataattctgagtttctataacgtttatttttccttagcaatcaggttgagcaaaactcaacaaacttcagaacatgctgagcttactaatataatgtttatttttaacacacatcatccatgatcaactttactcacatttacgccaactgccactcatgacaaacggaagaacttccgaagaagaagtaagtatgtgggattgcttgtatgcatacaaaccaattagtttgtagagagtacctttgtacgaataaattcagagaaagcatatggtggaggcaatgcagtgcccaagttcacgtgtagagcttttctcagaatcacatttcagcagatctcatgccgtcatgcagtgcttaaaaaaaatgtcgacaaggccgcatacaatgaataggtgccacattcctgtacactttaagtgactgatcatatcgcataatcgctataaggtggggtgatgaccgcataaaactgcttacactttaagtgaccgattatatcgcataaacattataggtgggtgaccgcacaaaactgattaccgatttgatacttttttggaacattgaattctcatgtgagacagtaagcgtttcttgttcttttgtatctgcacaaacgatgaaataagatgcaaacaatctactacagatttgacagccgtgctgattttgtttcacatatgtactgtcataataattaaactcacaatagtcaactgtgtaaaatgtttggacttgtttctttttttttctttccttttttttaaaagaaaaacgtcaaacttcattgctaactggaaacacatcagacatcagagtctccccagtagaaggacgggtttcagaaaaaccaagtgttgaaacttgtcgatagcccctggtttgcactttgttattaacatgctaagcgtgtctatgatattttgccttggatctgatacctttgtcttcagttgatatgcctatttggatgttgaactgcataatttgggaaatgtatcttgtacacgcaagttttcacgtgtatacaccatacacagtaactaatacataggaatagaaatcaactaattttttttagataatggattataaaaaacccggcctctacaccttgtgagggtgtacacagcctaaaagtcacaaacacgagtacataagactctcccgttacatgggtaaaacataaataagttttaaagatggataacaagtaagaggaattaaaagctaagcttcaatccttttctaaagttccacctaaaagtagagaagagctccatcatacgcttctctaaaagcttggacttcgcgattacttcaatgacttcgtcttccttaagaagcaaagaccgaagccttgacaactgagttgctttgaaaattacctgagagagggtcgagattcatccacgccttcctggacttagccttttcaagtgaatgtctcccgctgctgcccatcaacctctcgctagccctttttggtgtcatcgacacctctccaacattagccagctgaacaatcttttcctgctgcacccctgcctcattttcctccaattcctccctctctaccctttcatacacctcttccaacacatcttggacagccacatccaagatattttcagccatcatagaaaaatccatttctttcgctaaatcagcaccttcctgtgcctctttactcccttcacccctatcatgattgtcatcggttaccatatcatcaacctttgacatttttggtcccttctcccttccttcattgtcttctccactttcctctccctctacattaccatcctcctcatctccatcccaatcctccaaattaaactccacttcttccccattctcatcgactcctttcttctccacctcaaattttaactcaaaataatgatccccaattaccacatcaagcaccttaggaatcaattttgggttaaggatagccacaaacaatatcccaaaaacattctttttagtagttttcatatcaaccaattatgttgcccctaaaagagagcctactgcccataaagttaaatattcccttagtttcttccttagtccaaaaaccttaacccataccttaggtagaagaaaaccctcttcttccacaaaccactcttcaaactccaccctcactcccatggctacccctccttccttcacatctgcacccccaaagttgatggcccattgcaattcgccctttgaagggaaaagaacaacaaaagcgtccttcccgtgcggcaccggctcccacttccatttagttggacacaacttgtggagaagagtgaccaacctttccaccgaaagagcaccaccaaccacacgcacaagagccttcttcgtgtttttcttgttcctttgaagcggttgatgtgggatgtgctgaaaccctaggccttcaaccgcatacccaaccgcctgcaccaccggctttggaagctttaggactggacatttgtggttgacatgctcgctacagtcgcagatatcgcaataaacatccaccttacaatcagcaacaccatgtcccttttgagtgcacctagagcaaactttcacccgtgcaccacccttttgatcatcccctttcttgtcgctaatcacccgcggctccttatcgaattccaacaaatcatcttcatcatcatcaaactcagaaacataattctttcctttcttgacttctgaatttaccgagacaaccacatctcctaccttgatctgacccggtttcttgcttcctcctccaccttttgcctcctccttcgtctgcgtcatctcaccggtccccctgctgccgccgccctccttcattagaaatcaactaataggaatagaaattgacatcccaagatcatattacagcccttctggaaatccaatgttccagtggaggagtgatatctgggtgagcgtcaagtataaatcttttctatttaagtcgacaatcgttgatttaatcgtggaaaagggctaattattttcttgagtttttgccggttgggctagaagaatagctatggtgcagagccaaaacaaccatcctatttaaactagcgataatgatgactcaagcttcttttcctatggagaagaaggacctgggactgggagaggcagcggatgatgtcaagggagaggataggggtggggaaatagaagtggatagtgatgccaacagtgatgatcgggtcaagcaagagaagagccgagaaggaattgatcctggatgctaatgaaaacacatcttctccgtttatataacttgtttaaaaaacatttataaaacttgcccattaaaacattatacaggctggaccattgatatttcctaatggttggcctattacgctgctttgttgcgtttcttttctagtaccttatgaatatgggtaaagtgggtattattatctctatacccaaaacttaaatggatgattcatctttactcataacctcccaaaacaatatagatatgggcaacaaatacctagttgcagccacagcagaccactttgtgatgcagcaatgttctctctatgttactattcactcaatctcgttcgagagataattgaacttgtgtgcaatacacaagtcaatgagcgttagaaatgtatttcgactagggtttaggcccatgggccaagctaagcactaggattcccggttccatggctagtggtccctgagcatcttctaggaatattgggattattctttccttcgtgaagagcgttgtctaagttttagcttgaatttcctttggcaattgtatgctcttcgaattacttgagagcttcgcgcgctttatccctcaagtgtattattgaagagttttcgatcctttgaggactcgactttaggccatcgtatttgatatgcagaaatccaatggtcttcaataaaccaccaatatggtcccttgtatccttggtggctttctttagcggatggggtaattgatggggatctctactccaacacttattacttatcagctactataaaagaggagtttcatccgttcgcctttcctacctccatagcttgcatggcatatacttctcctctcctgtaacaaaactgaataacaagtaggggtgggcagaaataaaccgtggaccgaacaccgaatcgaatcgagccgaactagtggtttctccagttttcgggagaaggctcaatttttactttgcgctgcttcggtcctcggtttagagatcagttttatcacgcatgaaccgaactcccaataaaaccgaagtagtcgtcctcagcggctggagcgcgcactatatcccgtcccgtcgtgagttctgggaaatgttgctccatttgaaggatgcataagccctcataggcccattgtgtacataatgttcttgtggggtctgagcaaacaatggcccaaccagaccactagtacgactgcacctccatgggtagagacagagcgcttggttggcttgatcggtagaaaccgacaccgtacttgtcaacgagtgatactcgcggactggatgaatagagtattaaggtacgttggagcaggggtctacgtagtacgacatcaaaacagacaaaagacaagaattatactggttcaggccccttatcaagtaataaccctagtccagtttatatgtgattgatgatgatgagaacagattacaaagagagtaactgaaacaagtgataccgatgagatcgtagtcgagggattcgacgagatctcccggcgagttggttcccgtggactctggcttcgtaaactttggtgagtgtgttggtgatgagatgcgatgccctttgcctctccctaggggtcccttttataccgtggaataccttaacccccaagtaaaacttggagatatgtaaaccgacacgatatactagagattttaccctttccgagtaggacttcggaaattcctaaacttatagatatattttccataacttgagataaattcctaaagcgtatacggaaacaacccgtatacgtgaatgtataccttatcggtatattccataagtcatatgatagagggtatgccttatccgtaaccctgacagtaccgaagttattcgatttatctgggctcattttttaaaaaaattttctgatgaaatcggttggtatttttcaaaaaacgaacatccacaaaaccgtacaaaccgaactgggaaccccgaataaagcgaacgcccacccctaatgacaagctgaaaaaaaggccagaaccactcaaccaatcttatgtatagctaatataattttcaaaaaaaaataaaaaagataggaaaataaattatatgtttacttgatctattttgttgttccataatagtgcacgggtaataattaaccagttgtttaaataaatattatcatcaacgaccttctgactgtttttaaccgaattaaaaaaaaataaatactatagcacggtggatcgttggagcgaaaggtttatattaacatcaacatggtagtacatacatagcacataaagtatttcgttggaccattagtatagctagcgttgcggtcctcctgcgaaactagcttggcgaagacactagcgacagtgccaccccgtgccaaggcccaatggtcgacacatatagtatggtctacgactctactctactgcaggccaacgaagtgtttagttgtttacctaattttttttgacatatacggatacatatttaaagtattaaacgtagactaataacaaaacaaaagcaaaattggttatatagcatcgaaagttcacgtttttggttttatagcaccgaaagttaccggttcactttaatagcatccaaagttcaccctgttcctatttttagcacttccgtcaatttttccgtatgtcttgatcgttattgatccagccacacacatgatatgatatttctacccctcattgacatgcattatacttgtacttgtgaggggtagaaacgtcatatcgtgtgtgtggctggatcaagacggacggaaaacaatcgagaattgacggaagtgttaaaaatggaaacatggtgaactttgagtgctactaaagtgaaccggtagtattcggtgctataaaaccaaaaacgtgaactttcgatgctatataaccaattttgctaacaaaacaaattatagattttgcctgtaaactacaagacgaatctattaagtctaattaattcatcattaacaaatgtttgctgtagcaccatattgtcaaatcatgatgtaattaggtttaaaagatttgtctcgtaattcacatacaaactgtataattggtttttttttgtccacatttaatactctacgtatgtatgtagatatgacggaatttttgaaagttggaagggaactagacactgccgtgatctgacagagttacacagaagcatgtcaatgtcgtcgccatttatcgccactgatcagagaggcttcaatttatcgctgacacggatgtggctaaaaaaaaaaactgatagcaatccactgcggtagtcaaccaacgaagggtcggggaatcggtgatcggggatcggtcacggtcacaccctccagcttctgcgctggaggaaaccaacaaataaacggatgaaccaccccgtgtctcctctccgcgccgcaagcgggacaaccggcggcgacggagccaaccaggcaaaaccacacacaactagccggatttacaaaaatatactgtttgtggatttgttttgtaaaaatataccggatgaagaatgatttgcacaaatatactatcagtatcgtggcttgaaagagcgataccgagtttcgcgacaacaaatgcgataccgccactatcaactcgtgagggtgcatttgagctggcggtgtcacttgtagaaacaacgagaccgccacatgaaggaaccgacccgttgttgcgtcggtatcgtggtgtgcaagcgcgagagcgaaatcggtctcgtaatcccaacgcgcgagaccgagcacgtcgtgggacccacattggcgaaacgaccgggcacgagtggaccgccggtctcgcacacgcaaagatatcggtctcgctgtcccaatgcacgagaccgacacgcggtatcgctctagcaaagcgagagagcgctttgttatcgctcaatcaaaaatcgataccggctataccggcgaatacgtgcatatcgttagtgaatacggccgctgaatcgtgtccatgcaggccacaagtgaacatgccgtatatacgaatatgcatacacatatatatagccctcaaagatcatcttcttgttggctcatgcatgtatacgcatatacattagccaagcatgcatgtatatatggctgaacacacatatagatggacatatgccagtacgtgtatggctcatgcattccattagcaggtgggacgcgctctcgcgctgtcaaagagactgcttggggccctgccggtctgggttcgcgtcagacggccgcgaaattgctctacgatcgtgcgagaccgagtcgttctcgagcttttggaatgcgagactgatgcattagcgctcccgcggtttcaattagcaatagcgttggcgccttcgctaatccatgatgcgatatcgcgctctcgcttaatcaaagtgcgacgacggtatattttcgcaaatcttcccctatttagtatattcttgcaatttcggtaaaaaaattgtatattttcaatttttttctctactagcaatgatgtccatgcgttgcaacgagtaaaggtagttttaatcatgtatactggtgggaaaaaaatataaaggaataataataataataataataataataataataataataataataataataataataataataataataataataataataataataataataataataataataataatgaaataaaattgcagtgacctttggtcaatcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgtgggtgtgtgtggggtatatatctctcacttatatgtcgtggtctttttttgacatagaaaaaatacccgtgcgttgcgacgggtaattaaaattataacaaatataaaaatattatatgattaaggtttagttttacatgttatgagctctttaagaaaatatatttataatgaaataaaaaagttcagctgaagtgacataaagtgaacttgttccgtacggagggtacacatggtcaataaggcggcccaatagcgtgggcggcctaggaatagaatcggggaggaacaacttaagcgacctaaagtgaacttattccgtgtgggcggcctggaaatggcgttcggcctgacgcgggagaagccagagccgtccgatctgatagacggtcattccgacttatataaaagttcaacagcccaaaccctaaccctaaaatcatttcccctcctcccctctctctcaaaacaatgtggcagcggcccgacataccgacatccctgcgacggcggtggcggttcagaagcgacggcgacaccctccccttccggcgtcggcgttttcttagtgttcttgaatcttatctagtattcttgtagtagtgttttctttagaatttaggtccaaatttgatgcggtctctcattttttttctttcctttctttttttatcttttgccatcggaggggtattaaagcgggatcgatcgcacgtgcgatggcatttctataacccataagccatacaaattttcttaattaggtatatatagatattgaatcggactttccttttttttctttttttcgccattttttcattactacggatgtcagaaacatctttaattttttttaccacgtcacatataatcagattcgatttttttcgccgatttcttttttacgcttttttttgcggatggacgacggaaacactttttaatttttaagtagtagacatagagatagagatagagaaagagaaacggaaaacttttttcgcaactttttttttttggaatcggacagaaaaaaattttacgcttgttttttaccgcgtcgatggaatcggattcgatttgtttttttttaccacgccgtgtcacatataataggattcgattttctttggaatcggacatatactttttttctttttgcccttttctttaccgcgtcgacagagtcggattcgtttaattttttttccttttttcgcccttttttaccgtgtagaccgagtcagattagtttcttttttttctttatttcgcccctacttttttggatcggacttatttttttctttttttcctgtttttttccccttttttcgcccgtttgatcggactttgtttttttttacacggtttttttcgtccgcggatttttttttccgtccgtttttttatcggacatagttttttttgcacggtttttttcccacggtttttttacggacgatggaccatcatctcttatttttattttttattatataagtagtagagacgtacgtgtgccaacgactgcgagcgcgtcaagccgtcgtcaagcacggctgcgtgagcgcgcggccacaaacgcgatggccgagggacgtgtgcactgcagtgcgctgccccgggtgtacaggtgcgtgtggacggtttatatatagattatgtaaaattttaaccatgccattatatacgtcttcaatacagttagaccacatagtggtaatgaaaaggattaaaatcaaatgcagtttgctattgtaactgtctaatagcaactgcacataagtttaggctatctgttttttatccaacagttagagtgagtgctacagtaccaatataatagtaaatctctgttacagtatttttgttataataccgctatgtaccctagcctttattttattctagatcaagatgcacatatataactgcttaagttgcagttctaatatataacaaccactgcacaatatcctgatccaaatgaaagcgatacagatatcatacgtacggtacctcatcaacaccgtacagtatactaagaactaacaccttcatattttaatgtataacaccgttgacttttttccaacatttgacccttcgtcttattcaaaaaatttatgtaattattatttattttactgtaacttgatttatcgtcaaatgttctttaagcatgacataaatatttttatatttgtataaaaaatttgaataaaacgaatggtcaaacgttggtcgaaaagtcaacggcgtcatacattaaaatacggagggagtagtatgcatgaacatgaggatgtgattgaagctatcttccgaaacaaatatttttctggaccagcgagcatataataaataaaatttcacgaggatcgtattgtagttctgcacttctgcttctgcttcttgcatttcaaattcatctaacgtacgtgtgccgctctcgacgctagccaccgatagctttctggagagcttcgctgatcatcccaggtgccactgaaccagaacaagcaaactgcaacaacatacgaacagatcaccataactccatacggcaaaaaaacatataagcatcgttcagtactgcaattctacggcgcgatagaccttaccttagcttgtatcttcagtccaagaagaccatccggtgccgacgcctgcacggagagaacgtcaagacagaggctcttgatcgcgtcgaacactcgtgtcatcaccaactccttccatcggcactgcacctccaggagaaccaccttgtccgtgacggtgacattcacgtggtggtgttctctccctgcatcgccgccgccgctgacaccgatctcagagaccagctccttcccggtgatctcacagcgcctttgctgtcctgtttcggttgcgcgctgatgtgatggctcgctgctggactccaactctttcacccttttctccaacactttgaggtaggcaatcgtttcttcaaggatggatgctttgtccacctgtagtgacaaatcatctcgatgaataattcatataactttcagtataatatagaaccgttggaacactagattaattaattaaccttgtggatggaggggactattgacttcagaatcaggaacatctcattgagcttctctcggcgccttctctctgatatgacatggttcttgatgccactctcttgagttagcgctgctctactaccacgaccagtgctcatccgtgcaccacagtccacaactttcttcagcaacttctgtgactctataccggtgacgaccggcacagccatctcgtttgacttcgcgctcttccaagccatgaagcacgacacttgagaattcgcaacaccgtcgacatcattagccgccgccgccgccgccaccgcctccgttgacgacgccgggaccagttgaaaagagctggggttcacaggccagccattatcctcgagaaagcgcacggtgtccaggtccaggtccatgtccaggtccaggtcctcgtagatgctgtagagctcgtcgatctccatggtgattggatcgcggttggcgttggacacgcactcatcagagacaaccatctgcccctcttcgatggcgttgtgagtgatgaggccttcggacacgatgtcggcatcttccgtttcgttcggagaagggctagtgctcattagtacctctaagcatatcggaaactgaagctcctggaaatatgcaacgattcggtttaccaactttgggtcctccaaaacctgggaattcaatagcactccacatataattagttgtgaagagctgacttatactgagtggaacagcaaaaactacatcttcgaatgttgcaccctctagttttcataaacataacatttagtggaatatgtctacctttgcttgtagctcaaatgagaaactattctaaactatcgaggggacatcctctcattattttcatattattaaaatggttatagaaaaaattaaaaattttaaaaatagattaatatgtgataaatcacttcataaacatgtaatgttaaatacaacttctacatgttgcaatgagaaaaacaaatttaacagtgaatatacgttaactagccatagtttaatttgttctttttgcaactcacagaaattgaattagtttacatgtttatggagtgatctatgacatattaatatatcttgttgttttttttaaaaaaatctcataaccattttgatgacatgcaaataacaagaggatgtcccctcgagaatttagaatcccctcctgtagctcaatagtttgcaaaatgttattctgttcattaaaggtatgttctcttgtcttacatgtagtggtaaagcaagtatctaattattatggagaccaacctgacaagtgatgtcaatcataaaaaatacagtgtaacaaatatacacaaatttcaacatttcccacaggtaatttatcgtatgaacttaaaaaatcacatatagtagaaaaagaaaggcatcataagcggtggtaatatcatagagctaaaactgtaaattaccaggcaaacaatacgggaaaaaaacctatatcttagcaaaataagcaacaaactattatcttctgcaagtattaattagctaatattttaggaatataaattaaaatggagaggtaaattatgttagctacctacctaattgtaacatttcagggagagaacgcgggggaggggggggggtggtttgttgttattgggctattggaaaagagaaattttacagtccttaaaaggctaaaaaattctagtgcaaattttcatacctcctaatactgagagtaccaaattttacactacaaaatatggacctccagtacctttttaaaaattgtaaaatcattcattgagaaaggccaggaccccttcagccctaatagctgcgctttcttacatgttattgaaatagttataaacaaattgtgaaaaacaaatatgataataagggtatatctgtatatgcacttgcattataaattgtctttcctacctgttccatgttgtggcaggcatatgctataatgaaagtctaaaacatgatgtaacataccgagagactaccgctcggacgtccgatgcaacgcaaaatatcggacgctatcagagtactatatcagcaagctgaccacataactgctacctgatgatactatatgcatgtattgattaacatatattagtaacctttgagatgatttattttccaaaccatttatcttattgtcattttgatcatatggttgtattccttataattaaacctttacaacaagatctcatacggttatattttgattgaaaaattatatatgtttcaatcattaagatttaatgtttcacgtgttagaaataaatgtttcatatataatttgattatgttgcacattttaagctttttatccgaatgatgttttaccgttgtacacgggatcaataaatatattatgatgtttcattacttatttgtgaatgttgcacatcatattatttgaatgtttcatcaagtatattattatgtgcaactgtcataaagaaatagtaaacataagaaaatatctattaaaacatctaaataatactatgagcaacattttgttgcaacagtaaacttaaaatttattacaaagtgaaattccagttgaaacactatttctcacacatgaaaaatccatttacacctaatgaaaaacacacatatatattttttcattagaaatataatcatatgagatcttattacagtgatcttgctagaacatggaaaaacaccaagtgcaacattacaaataactatgtgaaacatcaaccaatatttattgaaacattccattaacactgtgcaacactaaaaagagtcagaaaaaaagtcatcggaatacaatgatgtgagatcttgttccgaagatttaattataatgaatcaaattatataatttattcatagtttggataaatagttggaggaaaaaaaacgtttgaattctcaatcattatgaatagttttcctaaatctgactgtatgcacctatcccaagtgatgtgaacgtccgatttttgccttccgcccggacggctgatttgaagcattttccatggaatctcgggtgttacggaatagtgctttactgtgctagactcaaaatgtgagatggtaataacataaaaagaatgtgggatataaaaagaagcttagcatcaataatatttaggaaagacgcaactatatcatatttataattttaggaaatggtgacttggtgagtacgaagaatcacaccctgccgcccaatggctttgtcgctccttgccagttgagcaaaacgaaccccggacatgctataacatattgagcacgtgatattctctcatatatacaccttagtttattaatatataggatattgttgatttttaaaataatatttgatcatttatcttatttaaaagattaatgtaaatatgcttaaagtatatatcatacttaaaaattctttaatgattaaacatgttatagcaaaaataaataatcgttatataatttttttataagatgaataatcaaatggagtaatacatacttcctctatcctagaaaaaatatcgtaaacgcattccagaaaaaatgcccttctaaggatgaattctaaggatgaatatggataagtgtttgttaagatatatatattatatatatttttaaaatgtgttaagattcattctcaaaagtgttttttagatggaggaattatgttgttctatatcactggacgattgagctagctatagctccatgcatagttgttcgtgctgaacaatcgatgagcttaccggatcagtggtccccagctcaagcacgccactcgtgaaggggatgcagatgattgtctgtaagatgtatagatatttagatggagtcagagatatcgatcgacgtacacgtacatatcaatttgaaagctaaaatacttcctccttctaaaagtttaaatcctatttctttttcattaagactaatgtatagttaactctttcactatgtgataaaactaataaatatgcaaccaataagtactaaaatgattttttgggtttcgataaaaaaattaatatagcacatagtgactacaaatagaacttagacttttaaaaaaaaccaaagaatgaaatatgacttagacttttggaaggagggagtactatgtacaactctacctacatatatacctgaatagacgcgctctgcagcattcgacgacattatattggtgcatgcatggagagcgtgcgatcgagtcagatcatgacattatatatggagtaaataattaaatatgatgattatatggaggatatataatgcatgaacattatctttgtttgaaggcatcatggttgacatgccatgatcgagcagcacagcatggaaatatataggtaccttagctaatagcgagcgtagaaatgttttgctatctgcagactgagcattgcgcagccaaacagatgcattgcttgcatagcttttgcctggcagcctgcagacagaatgtaccccagcagatcaataacaacactacagtacagcaatgtatatcttgttattaagatgtcatgagagacatttccaggctggtttacccagcttttgttttctcctattattggagttgctatcaagctagcagatcaaccgacaagtttgatcagtcatgtgtataggcacagatcgatcaacagatcatctcgtatgtgtgtattggcatcaagctagcagatgaaatactcacccttggccgggttggaaggagtaggtcatgcagacgacgtagtaccattctgtgtctgcgagatcttccggcgatagcgcggcaatgggcctcctcgcccggtggtcgcactcgccggacaggagagagtagtaaagctccctcagttgctcgcttctctgcacgacgagctgaccagccgtgaggtctgctgagttggatatcttcctcgtctttaccacgccgttgtagaacccatcattccaagtcaaaactctacaggtaatattttttaggtattatataatttagtatataaatactgggagataatatctaacggaacgtatattatgtaagtaagggaatatcaggtaaataaaatcaaataagtgaaaaaagggtaaaaatcggattaaaagttttctaaattcataaaacaaattacttaaaaattcagtggcaattaatatagttcatgcctacatccgtctctatttttttagatgaatttagaaagctcataggtccagtttttatcggtttttatttatttgatggttttcattggatatttccccatataggtaatagattaagtccttgatgagctggctagtgcacaatggtttactaagcttgatcccaggtatggttatcaccagatcaggttgttaaaccaagatgagcacaaaacaacttttaaaagacgccaaggcctttatgaatttagggtgaagccatttggcctgactaatgcttcaaccactttgcagggcctcatgaatactatctttactaccctaataggaaaatgtgtgcttctatctatttgtggatgacatattcaattacagcgaaaaccttgaggagcacgtgcaacacctaaaggaagtttttgctatcttatagcagtacaaactgtttaacaaggcatataattggtgtcaatgcagtggctatagatccatagaaaatcaaggttgtgcaaaattcgtcagtgccaacaacctcaaacaactaagtggattctaagggttggttgcttactacataaagttcatgaaaaactacggagtggtcatcaaacccttgacagagttggtcaaaaaagatgttaagtataaatggattgaatcattgcaacaaacttttaattacgttaagttggctttggtacaagcaccaattctaggattgccagatttctttcatgagtccattgtgaagacagatgcctatgataaggtattgttgttatgttgctttagaatgagcatccacttccatacattagcatgcaaggctctgggtgttaaggctctagcaccacccatttattacaaggaacatttggccatttagctagcagtaaacaaatgaaggaacagtaatggactagaggggggagcgtcacgcaaggggaggggcgcatgcctagtcaccgattagggtcccctgttgggcagtgccagccagggaggcaaagtgctgacaaggcatgcaggttgtagattggaccatcggaggcaggcggacttcagttgaaggttgggtgcttcttgtaaaatcaaaaacacggcggtcagatcggcggcatcgcggcggtcataccggtgggcacacgacggtcaaaccagcgtcggcaacaggaggcagcgacaagttttggcggttagaccggaatatcaacactggtcagaccggcggctacgcttcggtcagactggctagtctactccggtcagaccgatcggttttcggtttttgggtataccaatcattcacccccctctggttggcttagttgttgtgattcgatcctacacttctctcatttgtaattgtgaatttgtgatcctttgccgttttttatttcgagatttgataactgagaagctgatagaagaggaaagggaaaggctcaaggacattgggaattttgtcgatttagcatcaaattgaataattgatcaacattcgtcattgcttcctgttttgttgaattattttttcattcgtacttttatgtgcttttgccaatgaatcgtggttgttgccctgtcgaattttgaccttcttgtgttccaataatatcatgcaattgagaatatgttgtttttctctttgttcttcttgagtaatcactctagcacttgtctatggtccgtactttttttctccttacctgcgccactggtctacaactagttactaccttccttcataaatataagggattataatatttttaagtaaagaattaaggaaataacaaaatgtcacgtcatagtggtatacgggagaataaagtagtactccttccatcccagcttaaaatttttgaggtcttcccaaaatgatcatcatctaacaagtgtcttttcgtttatttatgcaaatagttttttatgaaatgaacttatgcaaacagtaaatgcacatcattaaatgtgttgtatgcaaccaaccaagattaatttatattggtgcaatgacatgtaatatttaaaacatgggaatccacgggacatgaagcgatgaaacaccttaactgtaattaactgtaatgattaatttgagaatgatgcatattttgatgtccttagttttggtgctttttgcttagggaatgattaaattgggattgagggagtacatataaactatggtaggtgaggaacaaattagtacaaaagttgataggtatgaaataaaatagtacaaaattatgtctcaggataacaaatcttttatatttatggataaattaaaataccataatcttttatatttgtgaacaatatcaccaagcaactgcattcgtattgaactaattattaccctgggcaactggttgaaatggaccaaaagatcgcataactccaactgatgctcctcacagcagcagcaagcaggctcctgaagtggttcgtccctggctgtaggggttcttcctgaactggaggagcagatgccatcaccacacaagtctagaaacctatctagctgtttaatttcctgcataggtgtgcgcaaaatcaaggaaagaatcagacaagcagataaagctgacaagcatatggtaatgacactgtcatcagtacggaggggcgaatgcaggcctagggcacagccatcaccacactagaagtagaaacttatagtagctgtttaatgtcctgtatataatgcatctgtcccaaaataagtgtttatacatatacttatcaattaaaatttgaattttcaaccttaaatttagagttaatttcaggatttttcatatcgaagtttatttttcagcctttgcttttaggctaagaatacgtatataaaaatttattcacaaattatttttcgtttgtgagatgggcgtatgtatgtgcaaaataaggaaagaagatgacaaacatatggtgatgatactgtcatgtacgcaggggcttatgcaggtctaaagtagtcttatctctaaaattaagtttatatctctttaaatcataatgtaaattttagataaaatctaacaacccatcaattgagatatagtttagctctaaccttcagtaaattttggctctgccactgtcagtacgtacaagcaaaagaagcgtagaatgaaggaggttacgaattaattcacaagttacagtcatatatatcaagcgtagtatatggttatccctaattgtttcgtatagctagctagctagcttaggctagcggtaagctctacatgtaattaattaatcaagtaccttataatctgtagttttgcactaaagctgatctacaaaacatggcgagaccgcgagatagcctgtaagttagctggtagactgctatgctagcttgctgttcgatctcttgttgatcacgaagaacaagaacaagctgctgaaggtactggaatggacaaattaaagaaataacctgcaatttaagataacccatgcatatagacggagaaaaacaaagggaaaattaacgctagcttactctttccagtctgcccaccaatgcaagaaggactccagctagctagctggctgctctagctgccaactatccaagttcactcttctgcaacccgccgttcttccagagggaggagctatatataatcgaaatatatagtttatatatatgctgtttatatataatagttcctttttcttttctcttttgcgatcacacacggaggagggcgtacgcatatatgcacaagccactacatgcacccctgaatatgtacacctatagagaagggatgcactaaaatcatatattgacagtgcaccatgtatatgcttatgtgcactaaaatttactgtaaatctttggtggatagaatcatatatatacactacgaattcgttaccgtactacgcattacttgttggtaacacatgcattcgtaattaacaaaaagttgtattagggtaataagtattttttttatttttagttttatatttttagatttacagcattattaattttataattttaaattttagaacagtacgtgcgttaattcatgcaaaaagtaatctttttcccacgagtacacaacacaacacacggtgtaaaaatccttccacccccaccccatcatactgaggcgttattgactgtatacaacaccttatgcgtgttctaatagttctaattttttaaattaacaaatataagtttttatgttttttaaagaatgttttaccgttctagacactcattctaatcagtattctctctatcccaaaatttaagctgcattttattttaacactctctttaacgtatactttaagtattaatttcttttgtactatattattagcaactactcatatgaaagtatttttaagagtaaattttataaaaccacatgtactatggtccaagttaattatataaaattacagggcttttagcacgtgatacataaccctatgtagtatcatgttgaaatagttctataaagggaagtgcttcaatgctcatcgaatagaaacctgcacagaaattaaagcgcatcaatggtgggataaaagtggactaagagcatgccaacaaatacccaaaaatctattctaaaattatgtttttgaaattcctaattaaaatttaaggtgtaaataaatttttgtcttcaagagatactttaaatcaacttccaataataaaaggtggacccactggccgtaactaccaactgatacatgaacataaattgttttaccccatccctccccatgcgtgagctctcctcacgtatcgccttctagaaattgggagcgagaaagcgtctcccaacttgtgaagagcaagaaaggaggataagggaattctaatttttagatacaattttagagaaactgttggagcaagtttttcacaaaagaaaccctaattttaaaattgggtttcatttagggatatatacgttggccattctccaacagagtaatatccaattccccattagccaggggcattttcaaccataaaaacttgaacccttacgattcaaggcagcagaccgacaattcgctcgcagcgccacccccttcctctgatgagcagcgccactgccccttactccagtctccacctagccccttccgcctctctgctgcccaaactcgttctgcttgccagctaccgagtgtctccgcgttcgaggcggcatggtagacgggccagatggtggtggtcgtccatgatgatggaacaacaatcggccgagtacccgtattgtacatggcaacctaatttcatctagagatcccaacagttgttttatgtgatcaccaattaaccaccactttacgtcctttcagacctaaattttaacaaatattaatttgcataaggtagataggggagctttggattgatcgatgggttttgggttgctatacacactgatatagaaccgggaatcgtgaatggctcaacagtgacaacggctaacgacctggtacataggcactaagatatgacatgaaaaaaaaatccccattgaagattgggtctcacggtcaaacccatcactgatgatccctcatctttgatgagtaatctacatcgccgtcactgtataaactttttttcacccattatctacaattggtgacggaatgggacctgacccatatgagattttcacatcactgacgactcattcatgacgaggcacccatccttgatcagacgtctatttattacaaatgagtgttacaactcgttacgaatgaccttcatagtagtgaaaagaatgtactccgtaagatgtaactctcaagttcaatatactccctctatcctataaaaaaataatctatgagggaatgtgacacaacctagtacaatataaatctagataattctccctttagatttgttatactagttatgtcacattctttgttaggctgagtttagtttcaaaatttttcttcaaatttttaacttttccatcatatcaaaacattcctacacacacaaacttttaacttttccatcacatcattcaaatttcaattaaaattttaattttgatgtgaaaaacacaccctagtctaatattattgggatggagggggcagttattgcggtttggttgttatttcagatttactagcatgtgctattctgctgtccagcagtgccttaaggttgtactcctaggtttggagcatacggagtacgagtagtacatagctaattgatagctgtactgactctgcatcgagaggaggccacggcctggtgcctaactgactaactgcctactcctactgcctcagaagaagctacaggaaccggactcgtggtgccatcaactagaagctaggaagcttaacgcttccttatatctttaaccgtgtaaaccatactccgtcggtggttgctgatttcacctaggggtggataacgagccagtcggctcgttaaggctcaacacgtttcagatcgtttttttaacactcgtttcattaatcttaattagttaaagcctagcttaactcagcttacgagctggctcgttaatataaatttattccaccttcatatattttttttcggggaccaccctcataattttaaatttactattttatcatatactacctttgtttcaggttataagactttctagcattacccacattcatatagatgttatctagctgggtggcccgcgcaattgtgcggctagcatccaaacaaaatcatatatatttttaggatttttttacttaaaatttattaaatagctatctcattgtctttaagacttcgaaagaccaaatcttatcatccccgtgtttctaattatatagttttttaaagtcacaccagttgctaccccttatgtcatctccttctttatttacttggtcgatctaccactatttctcttcattcttcttgtaacctttaaaaattggatcttaaagttttatagtttatcgttatgttgggtttcgtttttataatttctagatgtcccgtcaaacattgtcattatattcctctatgacccgtccactgtctcttctctttattgacattgcgattttaaaaatctaatataattatcgtttgggttcattttttacattctagaagtcccgccaaaccgtcagcggctttaccattgcacttctctacggctcgcctgctgcctcccttctttattgtcattgagattttaaaattgaacatgattatcattgttttttttacttttagaagttccgaacctttaaaaattagaccctatagtttttaaagtttattgtcttgtttgggttttattttttatgatttttagaagtctcgtccaacgatgccactatgctccttcatggcccgtccgccgtctactctttattgtcattgtgattctaaaaatcgaacataactatcgttggaattttttttttgtctagaagtcccgtcaaccgttggcggctctataactatactcctatacaccccgtccgctgcttctcctttttattgttatttagattttaaaaatcgaatataattatcaatggttttttttactttctagaagtcccggcactgccttgctcgtttgcttcatggtctgcctgtcatccctcattttaatcgtcattaggattctatttggtgttttattaacagtttttatacgtcgtatcaacctccaccactttactccttttataggtctattacttaatttatctcgtcatgtgttttagatggtattttctttcaatagtctttatttttatcccaattttagttatttataaattgtattcctaattgaaatcttattttttttctaatttcagaatttttatttcaaatttaattaatatcgtattgtgttcttttaatatttttattttttattttcaattttagttgtttaagaattatattcctacttgaactctcttttaatttttctaattttggatattattttatttttttttctaaattttaattaatctcgtattgggttcttatatggatacttatttcaatattgcttatttttaatttcgaatttcagctaattttaaattgtattcctacttgaactcttcttttatttgttttgctaatttcgaattttatttttatttttattctaaattttaattaatctcgtattgggttcttatatggactcctcttttaatattccttatttttaactccaaatttcagctatttttaaattgtatttttttggattttattttattttatttcgaattttgattaatctcgtattgggttattaatgtatacttctttcaatattgcttatttttaattccgaattttaaatatttttaaattgtatttatacttggactctccttttttttttctattttggattttattttatttttattttgaattttgattaatctcgtattgggttcttgtcactcccaatccggcaccgccgtacaacggcacctgacaggagcgtgtcgtaggaaaaacggcgcgaaccgcttcctacgaaaccgcgatcacagtaccagtcccaggacatagtgttggtacccacggtgacaaatatgaatcattgcaatccttaaaataaatagaggacttatttaccttaacttaggttgcagctcagaacagcccgagaatgcaaccgacgacacggacgaggaaacaccaacaacagcagcagtagcggaaccaacggactaacacccaacaccacaggcgacggctgggaaccaggacgaaaccatattcttcactccacttcatcttctctttaaggcggaggaactatatatatttatatagagcaagggtgagtactttcgtactcagcaagtcacgggaattttaggtgtttaatgcaagcttggaagagaggcaaggttgttttgtaaatcttttgttttgaaatcatttttgaaatcactaagtggtttacttctttctaagtttgggccgaaaagagacttgcgtctcgattcgacttttaagagatgtttttcaacaactcaattggtaatgtaccgacctcccgggtcagatcattacttctcggctcccagagccatttcacttgattagtcggctcccagagccttttcattttctcggattcccagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacagcacaacaacttttcacaaagcataggcaaacaaatctatgctacaggaaacacctcacatccacccatgaccgtgggcacgactgttcgaacagttagttaacctctgcagagggggtacactttacccacacgacattactaacccggatcacccagtccgtgagatcagccacgtcgggagaccttaaggctttcatgacaaggcatttcgagagccgacacaggtttaccatatgccgacgagaggggtcccagaccaacaacaggtttggtcccagaccatactgtgccaggaagcccaggggtcctacccgacaccaccctggagaatccacttctcttggcatcaaggctcccctaattagctaattactcagccaggggtgtcccattgcacccgtgtggtcgcacttgttatatgctcggatgaatttcccacagtaatcggtccttatatgcaaatatgggacagtgccacataggcacaacccccgcatcgcaagttttcacattttattttattttcaaacacgccgacaccacatgacgggttttaaaggcttctcaaacccatttcccaagtttttacaaacaacggtgtatgtgggatatttggtatacgcgctcagagagcacagataccgaggtaccacaaaggtggggcgacaaggaatcagggtagtacagcctacaggaataagtgcgactactgggtaggtccgtcggtttggcacgcaaactgaggccaagcaagttgagtgtgtgattctaataatgcaagttggaaacaaaataataatgattttccaattataggagcaattggtcaaagggtgacttgccttgctcaaggtcttcacgaagcttcacgtatcttcgagaattcccacgattgacgaaaatccggtaaccgcaactatacacaaacaattaaaaacctacacaagacccaaaagaaagatcctatttagcctaattaatagtgccattaaatagatctcaattttagagaaaaactggaagtggaacggagtcaatcggaattacgcgagatatgaattttggaagattaattggaatttctggacaagggaagatattttgtggaacaaggggaaattgatttttgaaatttatagaaataatattctcaagaatattattgacagtcattgacatgcgggaccaaggaaaatgattcatggaattttggaatataggaaaatgatttatggaacaagggtggaaaggaaatcaaggagggatatatattagacttgtttcgggtggcattggtgtggcccaaaggagattggcccattagagcccgggtggggagagagaggcggtccggtggaccaagttcacttcgcggggtcccgagtggggcccgcttgtcggtgagacggtccacggaagaatgggcgcacgcgggacgcg

SEQ ID NO: 74915 - DNA, 49470 bp, Oryza sativa
catgtcatgcccctcgggccctcgtgctgccttgccccgaggcctcgcccaactgcatgtggcagggggagcgagcggagaggggacccaggctaaacgctatcaatgcgaggcgccccaactgcccctcaccgcatttaatgcggtaggggcagacgtgcggtgccgcccgactgacgcacgttagtcaggactgaccaagtctgtgacgggcccatcgccggtcaagaccgattggacaagcggccgtgcccccacgtcgcctctgtatccggcggagtggagataggtatgacccgtcccatcggagcgtcattcggagctccctccacgagaggaggaccaccacaagtcttcacccatttataaggggatgacagggttgtcccccgtgtcaggcggggggcggcgctgggtcgcgctcaaggacgggctgctgcttagcttccgggcgaaggcacggatcgtggcccggacaaggtgaagtgggtccccctcccatgaaaagttaggtagaggcggtgcatgtggtatccccttgagctataaaaggaggaccttgcccaccgagaaaagggacgactctcagcaagcctggactctaggaaaagaagagcgagagccctctccagagtttaggagcccttgtaacactcaaccttagtcccacacacaggagtagggtattacgctccatagcatcccgaacctgtataatctcgtcacccatatgtgacttagtagcattcagggcggatacacgatctctggaggcgagctctttcccccagccgaactcacaaaaaggggatctcacgatttcccgctagagaggatcactcctcgacagggacggagggagtatatggaattatatcaacagtagatatatatgaaccagtaatatcaaccggtgttagaagaagaatgttgtattgcatagtgcatacatgatcccgctgaccatcttagatacttcctccatttcacaatgtaagtcattctaacattttccacattcatattgatgttaataaatctagatagatatatatgtttagattcattaacattaatataacagaaaacctacaccacggcatcccgtggagacgggatcccctcctcctacctcactcctcttcccccaaatcatccggatcccctcctcctacctcactctcctcccccaaatcacacgacactgcagccctccccgtcacctcctcctacctcactctcctcccccaaatcaggcggcactgcagccctccccgtcgccgtcacccaccgctcgccggagccggcggccgccgccgcggggaaggtggcgatggcgaggagctcggcggcgggagcggggcgcggtggagccggaacggggtgcggttgcggcggcatcctccatggccggcaacaagtggatctgctacagcatcggtgatgaagaccttcatggccggcggcaggggtgcgccgagcacgtcgtcgtccacagccggttgaggaggctgtggaggcatggtacaaggtaggcaccagatctgtcgccttctcatcctcggcagcggcccccaggcgacgagctcgtcccgctgctcgacctcccggactccgcaactgctcctcctcctctctcttggggtatcacgctgttatcatgtaccaaggtttgatatctagataccagctcgatacctagggtaccagttgtcaaagtatagcccgtaccagggtaccaggtactgttacctaccgataccagggtacaggtacaaggtactagcccagtgtaccaggtaccatgtattacccggtactagggtaccaggtattggtacctgccagtaccagggtactaggtactaggtaccagtcgctacccaaggtaccaggtaccaggtactagcccagtaaccaaggtaccaggtaccgggtattagccggtactagggtactaggtacttgtacttgtcggtactagggtatcaggtatcaagtactagtcactacccaaggtaccaggtaccagcccggtaaccaaggtacaagtattaggaaagagtcattgaaattatcccgttgcaacgggatcccattgtatagcagacctcttaatataaatgtgggaaatgctagaatgacttacattgtgaaacggagggagtatctttcagtttattatcacatttttcctctatgtagatcgaatatatgaccaaaatgccaaaagcacgcacgtagtatttcagttgagaacgacaaaaaaaactcttttctccattgctataaaagttttttcttaaaaaataccgtttaccaattcggaaaatgtgtgtataaaaaagaagagagtagaagctaggaacctatagttctcagcttcaaccattccagcgtcaatctagcccgtatgcattgtcttcctctcagcgatccatcactcaacatcatgcacatcatgtactcagggtgtgcttagttcctgaaaaaagttaaaagtttaaagaaagttaagagcttaaaaaaagttaaaaatttatatgtgtaggaaagtttttaatgtgatatgatatgatggaaagttgggaatagagggaaactaaacatggcctcaaggaggtggatctagcgtggatgctgggggaactcaagtccccttatcctactgagggggtggatctagcgtaggtgttgagggaactcaagtccccctatcccactgatcacttttgatagaaggagagaaggaaagagaaaggagaggggaagatggaacaatatggaggttgaatgtgggagaagaaaatgagtcttctctttaatcccattctgggatctgtccctgtatgtactggacacgcacaccataaatcggcacgacggatacagagaaaatctagtatcgcacaatgcctgctagtaatagatcatttctccaccgagtcactcatctcctaaaacgtgtgcattgccgacagcccaggaaaggggcactgggcacaatgtacacgccagcaagtaccagcaaggcagaaagctaccctgtgctgcaagcaaaaacaacatatgagatggagtaaagttctgttcgagcatcagcatattgtatccaatcatccatggttgagctcacgactactccctccgtctcaaaaaaaaagacaaacactgtatccaactttaactatccgttttatatgaattttttttataatttatattttcattgttgttagatgataaaatatgattaatattttataagtgacttgtctttttaattttttttataattttttcaaataagacggacggttaaacgttggacacggaaatcaagatttgtttttttatacggacggagtacatgactgcatgaggatcgaggaacaagattctacagtgaccagcaggtccctgccatagccggagcgatcataatatgttcgagagtttagactaaccgtcccgtgcgcccgcagagctcgcgtccctactgctgccatgcacgcacgcacgcagagcggctctccaaccgggctacctgtcctgacctgcatctacgctactctgtgtcacgctgcatgcagccatcgagtgcaaaaggccacttggaattgaacttgagtatgattgagccgagagaacaggcgcaagaccggatgaccaacccatcccaatccaaccgccggaacaagatgacaagcgcgcaaatcatgttcggaattgggtcgtttactcgtttcgtgcggtccttggccccgtccatccgaactgccgcgcagcgccggcctccctcctttccccccgaaaagccacggtcccctgcacctccccctgcacctccccccgcacagctgcaccgcgcccggcaatttcactgtttcaccgggcgagaggacggcacacggcacatttgccggggttgacgggtggattgatcggcgatgaccgacgatgagtcgagacgagttgcattgaagcggtgggaggtgacaggtgaggcgaggtgaagccgcgctgtgcctgtgcctgtgcgtgcgcaacagtggcgcgcagatgtggtggtccctgtcacgctttgggtttggagtttggacccccacacattgcgggggccggggaggggaggcgcccgagaccccgagtgtggtgtggtgcacgactcggcgtcgcatgctgcgccgtgtggccgatccccgggtgtagcggaagcgcgttggttgatgaatctgacggtcattacaacactgcatctgttactctgatcgtgcaatcccgtttttggtgcctggtgccgctccggaagcgagaatttttcgtgcctctcgcggaaattgaatagtttgttgtgaaagaaaagacattacgatgtttagggaggttaataggcactacattgacctgatatgtttagggaggttaataggcactacattgacctgatagcttactcctacgttttgttcagagaggtaaacaagcgatttcaaaagcacttgtcgaactgttaccatcaacctcttgtgctgctgctgttgtttgctgctcctgctgctgactcgcgttcagaggaggacggacagcttgtccggttacttacctccggtgcaccccctcatatcagcatcaggccagttgtgcagagcgagagctttaaaagaataagcacaagtgttggtcagtacataaccccctggcttaagaaaagtcagcagcaataggaaggcaactttaacccctacggaccccagctttggtgtcctgcaggctgcagcagccagcagggcagcgaggagaggttgatccgttgatgcaaatgcagtactagtagtacacatgcaaacaaggtgcaaaagcattggcagggaaaggtacatggcagcataaacaaatacagtacgggctacacgagagacttgccatcgcttgcgtcgatcgcttaagaaaagggagctgtcagtctcatgatcggatagcacgttctcatgcagtttgtttagtgtcgtagcttaaagaaattcgtaagcagacatggaactaactcatccatcaggccatcacacctgtaacactttttcaaatccaagatttgtttgcaagcttcaagagaaacaaccggcttctgagttgtttaagctggcgctcaaagcgttcccttttttttttctaagcagaaaggggccaatcaagggacaggagatcatgaaggcaaagaatgcccaaatagggctttgcagcacgctggagggggacacaggccaagtgagaggtcaagggattaaataagccctggaaataaaggaccgttgtactgtgtctgtccaccattgatcaattttactaatcaacaactggcctctgtacttacgttgcaaatgaaaagcatggatatggatgaacactgagggaccacacgcaatgggtggtgggggtggtcgacgggcgaccggtggccgtgcatcagccactcgatctccgatgttcggttgcggtgccactgtcccaaatggtccacaagtcaggtctgtagatttgcaaatagtatagcagacactacagctgaacgagcacgattaataaggaaacagcacgagtggggcatgcatagcacatgagatgggtcagaagtacatttggtgcatatgaaacggatgagagcaaacaacatcaagtctctattgcgcgggtgacgagcaattttaaaggtgattaccagctgtgcctacacgcagcgatgatgaaatttgggtaatcgatgacaaggcaaaaacactttactactatgtactattccctccgtcccataatataaggaattttgagtttttacttgcaacgtttgaccactcgtcttatttaaaaaaaattagaattattatttattttatttgtgacttactttattatctaccgtattttaagtacaacttttcgctttttatatttgcaaaaaaaatttaaataagacgagtagtcaaacgtggcaaacaaaaacaaattacttatatcgtgggacggagagattagtactctagtaggacaggaagagtactaaatactgtagtagtactaatagatttgtgttctgagcaaaagcagaatacagtaaccatatgcaaccaaggaaattcgcacgttgctttcgacattagtctgagctgtgtagtaatggtagctgaatgaaaagtctgagctgctgtgcaattctgctgctctctagtgtgactgtgaggacatgtttagagctatattttttcaaaagcaaactatagagataatccagatggccgtttttatctccaaggtttcggatgaacaaaaagaaacagccaggaatttcaaactacactggcaaaagcacagatgaatcacaaaaatcgccaattttgagctattcaagaccaaaatacaaatccctatatacaattagcagaacacaaatatgtgcatcgtctgcatttgcaaactctgaggaatatgaagtctatgaagtattagtgagtataggccttaaaaacataaaagtataacataatcttttttttttgcgaggaaaagtataacataatctccgccgtagaatcagtgtatacatcgattccttgtcctccaattgcaggcaactattcttgaatcttcaacaaaagctagcaagtataaaaggaccaaaataaaatctgattctatccgattcacctcttcttgtcacaactacttatcatccatgccctccttttattttcagtagtataaaccattcaaacatacacttcactgattagaacttaaaacaaattaattcatcatgctatatattactaatgttgcatacctcagatgtacacaggaattttccaatttggtctattgtacacaggaattgctaatgctgcaaacctcagatgtttagcagaacaaactaaccattgcacccatccctggacaccctaaccattctttgtttccactaaacagaaaacctttacaccggcgtgcattttgtttcaaaatcatggcatatacctttttttcagcaaaatcgtctagtgtgacaataatcaataatatcccaagctatattatttgtgtaaaacaataaaatttgctattgtaatattcagttatggttattccagcatgtaagtgtaatgcatatttgagtttagacagatccatacatcaaattagcaatcattggatcaagcaatttgataatgcactccgtttggatattatgacagcctagcccctcctactattaaaatgacaggctaagctatgcaatgcctcgtgcgtgtagatatcagaggctgagtgaatcaacaactaatctaccaaacatcaccaaaagaactaaaaacagcaccgtatacacactaatgcttgtcataaggacattcaacatgccaaattatcttatctattcacaacgaaatgtttccaagaacatgaagtggccaattgagcggagagcaacaacatagtggtaagaccctagaggccatagccactggtcacacactacagagacactcataccaagattgccaaatccattaggcctacctaataaacaacagagtgtgcaacaaccatgataataatttctttgcaatgtttaaattgcaagacaaaattcatattactggagttaaacatgcctgcaaatggtgtaggaatcatgatggtcgaggcaggtgtgatcagcatcgccatgctgagacggatacaagctcgccacgctgccaatagagtgcaaggcctgctccacgcttctccacatggaagcctcggacctgcacccgcttcaagaggcagtcagcctgtgcctccgcaaggttgctgagtggttgaggtgcaaaccctgctgatgttagcactgtccgccaagcgatcgctttgtcagctctacgccgcccaagaactgcatcctccactctgggctgaatcagaaacctctcgatcttactgacagcatccgcatcagtgccagcagcatcaagtgattcaagaagacatagacaagactgtaagcaattcaagaagtgttgggaaaatgggaggtcgctccgatcactgccatagtcaatagcaaccacaatcttaggagcaagctgtttcaccaactgaagcatagctgggagtggagtgcgtgctgagcaaccaactgggaggcttactgcaacaacctcatcagctgtaggagcaatgagttccataggatcaaatgcgtcgagattaatagcattgaactcaaatggaataccaagatcagcagcaaactgtgagaggttatcctgagtaagatgcagctcaagcgggtggtgggaggcggctgagacgaaggctgtgagcttcaacatcggcaaggacacaccgccagagccacagcggtgagcaagctcctgcaagaacgaagcccactggccgccgacaccgaggtcgaaatcaatgacgcggatacaagacgcggttgtgctggcgatctcatccagaagcgcctgagttaccgtgaagttggcaaactggagcacgggggagaggtcggagaaggatttgtaagcggtgagcttcagggcgacgtcgagcggagacgtgagacgggtggcggcgtggtggccgtcggcgagcgcgaggaggagggcgtcctttaggtaggaggcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaggaggggaacggcatgaacaaggtggaggccggcgtcggctgatgctggttgaggagtagtgtgggtgatggcaagccaaggagagggggcttcatgtcagcgccgttgtggaaaggcgcagtagtcgccggcggcggctggagcgccgcttcgggcgacaggaggccgaaagcggaggtggccttgctattgctgccgctgctgcttgtgagcgacctcccgccggaggacgacaggtcggaggcgagggcggctggcgaggagacgccaccggggtgatgctgcagcgggaacccgaacccggcggcattggcgagagctgctgctgcgagagccccggcgcctggggttccatgtcgccgggggcagccatgatccagttcaaaaatgtctgctcctggcctgccgccgccgcggcgtcgccgagcatggcgtcccagctctcctccgcgacgaagcccacatccagggcccccggtatgggcggcagctcaccgccaccgccgccgccgtgttcgccgggggccgcccatctggtggcttcggcggcggctgcgctgctctccgaaaccgccgccacgccggtagatatagaatccgccgcgccgctaccatgggacgaagacagcgtcgatgtggagttgggcgggctcgggctccccctgcagtccagcaccgacctcggctccaccagcaacgacccccccgcgcccccgccgccgccgcctttgtcctccggccaaagcagcgccgctatgctccccgcgagctccgccgccccgttcccgtcggcactgaagggtgccgccctcatctaccaacctactcgcgcatgctcccgccgcgcgccgccgcccgccgcccgcccccctctcgatcggcgcgagagagatatggagggaaggggatcaagaaaaacaataaaacagatgaggccgcttgcttgtgtgcgtgggtgtggactgtggaacagcgaagatggagagaagaaagccttgtgcgctctcggtctcgtcctcttgcccgtgcggccgtgctactaccagtatagttatgggttgccgtggtgggtgcctgccttggatttctctctctctctaacggtgccatggtccataggagtaggagtagatgcgtgcaacataaaaaaggttggaaagtgtactcccctctccctatctctctttccccatctctgcctatagcttttgtttttcttctctttggtttctcatcgttattattactccctgataccttatctgggttttatttttttgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataaattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagattctctattaatagtatttctagacgatatgattagtctcttcctttatctttggtttttctctcttccctaagtctcttcctttatcctttgtttttctctcttttctgctataaatcggtctgactgatttgcattgtgtaaataaatactcttttcttctaatacactattcacgtattattattttacgtgttcgttaaaaaaatagtaggtgcaagtgtaacctgatgataatgtagctgtagccctgcgtctgcatgcgagcctgctaaggattgtggtgatagtgtggtgacacggccacaaggacgtttcttcattgcttgcacatgaatctggcctatcttctgtctcaatagccactttgctagggaaaatcagtcaaggtcgcaaaggacgctggtaaactttttttcctttcaatgccctgtcgtgttgacacttgacacaatgaaaaccctccaggacgagttgccacgggggtaggcgagagctgcagcacaaggaccgtgcgcaaatgtatgcatatgagatgtgatatgatatgacctgaccaaactcctggtcctgctttactgggacaacatctacagcaccgtaataagttctcattgctccaacgcagacagtactgggatatcagattggaccaaagaacagtaggcacaaggtcttccacaaattcaaccgctgtcacggtgtcacctaccacaacttgcaatattcagaccaaatcaccaaagtttttttttcctactttacacagggacgaggatgatttttttttttcaaattgtttgatgatctgacgttgcttggctgttttttcaggttttatctctccggggaatctccttatcatccttgtcatcaaataatgtgggaggttgaaattagttcgaatgttacatttcattccaatgccaatctgcctaacagccccaaagctgatgcatctgcccacttacttcggagcagtggagcacgcaattacacaaagctgcgttctggattccaaatgattacttcctctttatccatgatcatgtttttcaaactattacgtcccatgtaaaacctgtttgtatgaaagttttcgtaaaaaaatatatttttttcaaattcataataattaatcctatattatttttacttatagcttatcttgtttcacgcgcaacagaaaagacgaggaagagcagcataatctaaggtgactagttttcacttttcagaaaaccgtagaatctctcacacaacggttggtaccaattagggaaggacgtaatatcaaataaatataaggggtgagacttcgaacttagacaggctagctcaccaccttgtagagctaaccaaaatacctctgggcatttttcattgcagactagaagaaaccatggacattgaaatggtcagatcttaggaggattacgtagaaactaaatttctgaattaaaataggaaccataaaacattctgcatttatgcagtcgtgcataaataagcagagacgcgaaagggcacatagtcaagtaagtaattgtagtgacttgagtagcactacaaggttcttaattcaaatattcatagaagcaaatttcagattgaattatttaggggactaacttcctaatttaaaaacgttgcatatatccgatttgatgtaaagactgaataaaaaatatccttctctaaaaataaatgtaaagaataaataaatgagcagagacgagaaaatttcccgatcaccttcgcaacaggccgtgaagaagacaatcttaattggcaaaccgagacgagactacagcctggtctaggaataagttcattttgactcttttaactagtgaccgaatttgatgcgtatcctgaaccacagtaccggatatctcgacccccaactatttaaaccggtgcaatttaaatttcttggtggttttggagggcggtttcgctgacatgacgcatacgcgacggtgttgacctgatctttatcctacatggcattgacatgacgtttatgtggcactagaattaacaaatatacgtgggactcattgtcatttacacaaaaaaaaatatttgtggaccccacatgtcatcatctctccgctttcccttccccttcttcctcctccctctctctctcccttatctatttctctttctctcccctttttccaacttcggccggccgcggggagtggggctggagcaacggtgacatcagcgggcgaggtcggccgggtgtgcaaggttgggagtggcaggggcggtgggcgggggcgcaaggttgggaggagctccctacccagcgggaggctaccggcctccggttgaggcggaggataaatgggtgaatgacaaatggatcccacatatatgttttcacctaagcaccacatcaatgctgcagactgatcaacagtgctacgtagacgccacgttagtaaaatcgccatccaaaaccgctaaaggagtctaattacatcgttttaatagttggaatgtagatatccggtattgcggtttaaggatacgaattacattcagtcactacttaagggagtcaatgtgaacttattccgcctggtctaacccattttctgggcctctcctgaaacttagcctatccaacaatttctaccccctacggccctaccggcccatcgagttcctcacgtaacaaaccgatccaagtatatcgatctgcagatacgcgtgcatggtacgcataaggtgggtatactatacattcgcgtagccggtagcaatgggcacccgtacgtatgtacgcccgccgtggggacaacggagacggggggaaacggggcgcgcgctccgctgcggcagctttatccgacatctctcacgatcaccactccgccatacaaaaaaaaacctcccttgccaaacgcaaatccccacggcaactcgtcgtttttcacctccacggatcgcatggcattgcgccccaggcgaagtggtggtactaccagtctaccacacaatcactagtgtgtggtataaactggtagtacgtgctcctctgctccgattctttcacgcaccgattcccactcgtttactgtgtgtgggatgctcgtacaaaaaatgtagcataagcataacgccagtatggagtatgcagcatttcagttcaaacttgcatccgtgatagtggactaactgaagattagtttctgaaggaaggaaacatggatcagcgttgatgtgttcagcggctcatgtaattaaccgagggggtaattgaatttgaaacgatactcaatccgcgtgacgacgcttcctacttaagtattccagtacttccagaacagatggcggtaaaagtgatccaacttttcagctatcattagcgggctggatttacatttgcttaatgtcttggccttcagatcgtgcactaatccccacttaaccaaagagaaaatcacagctcttgtccagttctgggacacagtacatttaggtcttctcggccttctcaccgctcctatacaaaaaaacaaagacaatgtacatagcacatagctaactgtgtcatagaacttgggaaacaaatactactactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaagatgcagcttaagctcactgccgctgtcgccgctctcctcgtcgtcgtcttctttgcgctcttcgtcggctcatgcgaggcgcgccgccttcgtgcccttggcagggtcagctcgctaaaaccatcgtcgtcacctcctacgccgtacaaggttggtgcagttgaaggaataacttggtatatatcggaatataaagtgttccttttttttggctgttctaatttttccatgcttctcccttgtgcaggatgcggcaagcatgaagcttcatggttctgatccaacgaaccagaagaaggatttatcaagtactagtatggatcatcacatggctagcggggacgatgcgaaggcgaaggacggagtggcaatggcatcaccaggtgcagttcagactacgattgtcgttagggtttcgaaccggctctctcatcaggagcgaagggtggacacagcgtttcatctggactacgctggccctagaacccatcccccctctcacaactgatgagtatgtcgttctgtggcattctctgactctgtctgatgatcttaattactaatatgcaacttaagtgatttatgtatatgagtgttcaatctctaattctggtgcatattcttgcttgtttgctcttatatatgctcaatttgctaataaattaatattatcggtataaatagatcgtagaatgtgtagttttgtagaaagctcgccggctagatattttgcttgcttgaaatatgaattgaagttcacacacatgtttatacatgtaagtttgatagccgtgtgagaactatatgttgacatctatatgttgactatatacaaaacttgatagaaacatgaatcgtaaatatgcattctacacgtcgataagataagataactttatgtgccaactactcaagtaagtaataacagatcgatcttcaacatttgtcagcctattattatatatatatatacccagctacaattctacatacactaattattatagccttattcaaacagcggatgatcacatatatatgcaattagacaatcattttatgaattgcaatattcttatctcttgtttaattccggccgccatgatcgttaggtccgttccagcattcattaggagctccatctcatgggcacttgtttctttgggaaaatatatcgatcacctattttgctaatttatggtcttttatcgtcatgtatcaatcagtctaaattttaatttttaattttggagtccttttatatattctttaatcgtactctatttgctagcattagatttcagaccataactaatataaatataaaagttataatggtaaactatctttaattaatccttttttattgcttatcagtcatggctcaaatggtcatagcaatattttaatttgtgtgcaaacatgcattcttgggcctagtaatatgtaaaaaattttagcctataaatcctaagggttggactgaattttgtatacgtgtttgagaaaaaaaaagaaaagaaacaactaagttggactgtaaaaagaaaaaagaaatcgtgggctgtagcccattaacgctcctaattatactagctagcacgatactaggtagggtaattggagtgggacatccggacaagtgaattcatgcccgacgtatgggcgcgatcaatgatgtgatgatggtgttgttattacgtacctgtgtgtagcatgcatgcaagattgcaagtaggggccaaggcggcaacataaatcgcgcccatccggaatttagaaatcacgtgttctactaccatctgtacactgctggtgctggccatcaatattgcagctatcagttacgcatcggttctactagttcttgctgaactctcacgttgaccaccagtccaccacatatggagatgcggtgtaatttgggaacaaacctccctgatcatcagttccatcccagccgagatttcaggccgcgcatggcaatatggcatgcatgctttgttgtttgttcctctgcgttttgtgtgcttacctgggattggagcgctgtgtgcacttttgttcattccactggctattctgcttgtcaaccaaagaaaactcggtgggtccatacaacaacaagcactagccacaaatccaacaccctgcaactctgcaaagacatggagtcttcacaagagtactgttggcctcgtgcgtaactcgccatcgatcctggtaatcttgggttggaaccttgcttcaagtaaacacaacagtacgtacgttcgctcgccgagcttgttcctcctgagcatgctctccgtaagtcacggtgccctgcttgacgcctctgtgtcctgactaaagaatatattcgcttcaaatccccaagcttattagagcaaggttaatagtatcgcttactgcgagctatacttttatccacatcatttataactaacagagtagttaatttgtataataaacaggctttaacattagctaatgcaaacaatattttattcctcatttatctggttctctctcttcttgtttcctctgatttgtccgtgagcctttcaccatcttgaaacgcgtgtgtagctgagcgactatttagtcgtccactcatattctctctcataccttttctccgccagctcatcgttgtagtttacgtggttgttttagcgccggtgtagcgcctcctattgcacctgctcttagtactgctgctgctgcctctcagtttaacatcattagaggaagattagagattgcagttttgcaccaaaagcaagcaagcacaagtactagtctcatccaagagaagctctatggaaaatcgtcgttgacttgacaaaaataaggtgtgcagaaacaagcttcggtttctggaacaaccaagcagtagtgcagtactagtacttatagttaaagttgccaacccgaggagtgatccatgtgcattggggggcatatgccacacacgagtccaatactgtgacaagtatctcaatcttcccaagaatgtcccccctccacctcaatcttgccaacaatcggctagtaaaataaggcaaatgtgatgggcaggagaaactggctgctccagaaaagacagacatcccaacccagatccaagctaacaacaacagccggtgcacctcgcagccggcccgtcgatcagggctccatcatcccgtcggagaggcgggaactcttcctctgttcgaaagcctccccagcgtccaggcctgaccacgccttttcacgtacaacagatgatacagcgaaacgcccgggtaagaccgtaggaaggagggaacaccgttgagtttgggaatcggcgtacgaaaaggtcttgatgtcactgcaccctgtccgcgccatgcgcgacgccagagggagacttgacgacgcacgctgcgcgtatagcggcacagaggcttgcggacgggggaggcgccgcgaccgcgagggcggttggagaagcggacgcagagagagtccagagacagtggaggattggggttgtaaccgatctgcgtacgggtcgttgcggctccacacttgacacctgcaagcccatggtgacaccttttaggtgacccaagaggtttgggcctgattggtgccatctgctgggccgatgagctccgaacacgacctccttgctgcttttttcctgatgggttggagcatctccgttctccaacaatcactccatcagtcttctcaagctaaattttgataatttcagttaaaaatcgtgcttcaacaacctctcccactgaatggtcaaaccatccggttgaccaaatccctccactgatcacttgccaaatttgatcaaccacactcacttattaattgtgggccccatatgctatccccctcttcttttttgctctcacgcatctctcttctctacatcgctattgtccgccgacgtccctgccactaccccttctccccttgtgccagtctcgagggaacagtatacatgccgaccacgagaaagtagctggtgtaggcttgggtgcgtttgcggtgatggccgcagtggttgtatggaggagatggaagcaaaggaaaggaaacgtgcgggacagcaggaggcactgcccagaggcaccaaccatcaccataggaggaggatggagttggcatgggctcgggcacagttactgccgtccttttctccagcatcaactgccactaccctgttcggcgtcgagctcatccttggagtgctggtcttgaagtagcgggggcggacggggatagagctgaggacagcggaagaggcgcctcaccttccgccgcgccgtcttccgccctcccgcaccgtctaatcctcattggtgttgcctcgtctagcgctacccccttcctcgtcggcatctctagtgggataagacgaagatggggaaaaagaggagggaggagaacatttatgaggctgatatatcggtcccactattatagatctagagtgaagaggctgttggagtgagcaactagttttacttgccaaatcaattagagagctggctatatagatgtttgaagagtctaatttgtatggtctgttggagatggtctaagagaggtctccaaaagttaatgagcatacgtgcgtctaaaaaataatgatgtcatctattaaaaaaaacatagggagtacttgtctttttctttcaacaactctttatttacatttctcctcactatatctccaccaacctcccgctactcatatactcctaatttaattggaggcgtcatagtttttttttccttcctccttaaaatcttcaaaacaaattagaattctttagattatggaatcaaggtagtagtaccttgttgatcaacatttgatactccacagtcactgatatgatatgatatgatatggcaacggccacggtcccagctctcctcctccttggcttaagattttttatctgtttctaataatctgatgtgacgaccctcagacctcaattatcatgtgaagttcaaaactttgatgattaaatggtgtataaataatgtgttcttcctattcttcagaagaataataattctgatggtggtcagaaaaatctaagattctcaagtgattaattgacatttgattaattttagattcccttgtgtatacacatcttcatacattttctgctttatatagtaccatttagactacaatacagaaaaggatactatatagggaccatataacacctgcctttcatgcaaagcacgagaaaaatgtctttttaaaaaaaatagaagaaaattaaatcgaatgaaaatcgaatgctacttttttaggacttactcgagtgctactgggtcattgatcaataaaaagcaaccttttcctcaaaatgaaacaaagttcatgaaaggaacagtagcatatataagaatattacctgagatagatggctttgttgaattttctccaaaagacaggacaataagaaaatatattaacgattcacaactttcaaattcgtgctattacaaatacacgatataatgactccaacttattgcaacctttgtaaacagaacaaacgatcaaacccgtagcaaatttatgaaacaaatacacaccaataagtgtacactcgatcgactggaacggctctagttctgcagaaccgcggtggaacgtttgcgacagaagatcaacggtggtatagctatatatgcatgcatgcacatataaatgcagcgtaaatgcaactatgcaagcgtgcacaggcggcggcggcggcggctacgagtgtagatagccacgcatatatatatgcatcaagtttgtttaagcgcaggtgtagccactggggacgcacttgccacagtagttgacaaggaggctcagcttcaccgggatgttgacgacgacgccgagcacgttggccttgatggccgtgcagaggcagacggcggcctcgaggtcggcgaggccgctgatgaggctgcagcacggctgggcgggcacctggccgacctcgccgctgatggcgcccagcacgtcggcgcaggccccgaacttgagcgtgttcacggggcacttgttatggtaggacggagtagttggagtcgaaggcggcggcggcgggagggccgggggcggcggcgtcgggcatttgccgcacgcgcagccgcaggcattggccgtcgtgaagaagaggaggttgatggccaagagaaacacgaggatcttggatgccatggagcttatccttaagggtatatatggctatttgctaaggccggtgtaggatatcagagctagctagctagtgagagatggggatggtctagtgagagggttatgtgggtatatttatagaaggtaaacctgcaaaggacaaaccctaacctctctctttcgtggttatattgtctagcagtaacacggaaagttgttttcatctttagaggaaacatcatatcatttctcccatcttacataaaaactgcattcatcctaaaatacagcaactagtatgagatttgacacaacctagaagtctatcaagatttgttttactagttgtatctaatccggtactagtttgctatattttgaaatagtaagagtagtcattattttttttaaaaaaaatgaataataagataagttaatatgagataatcactccacaaacataaagtttaatttcgacttctacaagttgtaacaaaacaataaatataattgtgaagtgttatagtaaaagtcgaatttgaccttacatgtttctgaaatgatatatccatattaatttatcctatcatttttctttaactatttaggtaatatacaagaaataaggggatgtcccctcgtggattgagaattcatcttcggaataacacttttattggagtatgagtgaattgtttgtacgtcttattacttagcttaggaatttatgtgaaatagttggtatattcagcttgatatggtattagaattagaggtttcaaattataagctgccaaacataataaaataaactttacatattaaatgttaccaccagtatttttttaatatatgacatggttgacttttttaatccacttgacgagctaaggttgcagattataaggttggtaggggtggatgggggaggtgaaagggcgggctttcccaagcttggagggatgaccgcaagtggcagaggactagcagtgggcgaaggatgcgaggaggtcgctaggcaatggcgatgtcgattgagccatcgagatggatgagagctatggattggtgttggaggcaagacaaggaaaacaatagggttagaagctgtcagagaccatgaatacagtagggtgggggcacctaactgtcgcctagcttggaacaatggaaaacaagaaggctggtggggccttgcctgcgctagcaaggctttttttttttgggggggggggggagggtggaggggacgttggctaggagaggtggcggtgcagaaggaggtggcatgtgacttgattgagaccactggcgatctagaaaattggtttactagtgtcataacatacatactggtatcatagcatgctaatcatgcttaagcaatggcgttatcctatatgagtaaacaatttaaccataggttttgctaaaagttatcggtatcaccagacactgaacctaatactttatattcatccctgattgtgacttgtgatggaaacaaggggaggagggaagaaataacattggaggtggtattgtagctgcacgaaccatggcacgatccgagtcatttaaaggtgacttgaatgagcgagatttttcttagaaatattatagcaagcttaatagtacagcaaaccgctagctctaaaattgatacattatctacaatcactctaatgacctactcatacaatagttttatataaatatatatcgcaccattaatacttaattatagccttttttttcctctctcctattctctctttttatatgtgcttgtagttagaatatactccagcatgttctttttctgagatagacagtctcttaaaaattagctacatgccttataatattatttttcctctatatatttattaataaagagtaaactacacgggtggtccttaaacttgtaggggtgtgtcatctaagtcttcaaactctcaatatacagatccgattccataacatgtcaacgtatgtcatataggtcccaaatctccacaacttctctaggatcctacatgacactaatgtggcatgccacacggacgtgacatgtcataatcttgactaacaaatgggacccacttaaaaattttcatttcctttttcttctatcttctttcttttttatttttcttccttttcttctctttttcttctctttcttctttccttcctctcagttcagctgtaggccaccactgaacggggtgctcgagtcatagagaaaggagaaaaaaaaatagatttaggagaagaaaaaggaaagaaacggaaaatgaaaatttttaagtggatcccatttgtcaatcaagatgatgccatgccacgccacactagcgctacgtaggatcctaaatgggttgtggcggtctgggacctagatgatacactttgacaagttctgatattttaatctacattttgagagtttagggatctagatgacacacccctataagtttaagaaccgcctatgcactttacccattacatatatgtgtttagattcattaatatctatatgaatataagcaatgttagaaagtcttaaaatatgaaacgcatagagtaataaataacgtgttgtactaatttaagcataccacttctaaagaaagtaaagatgagcacatttattaacacatgccatgcctgactatccattctacgctactccttctgtcccataatataagtgattttgacattttgcttgtaccgtttgactacttatattattcaaaaaatttgtgcagatataaaaaacaaaaagttatgcttaaactactttggataataaagtaagtctaaaaaaataataattctaaatttttttaataagacgaatggtcaaacagcgcaagcaaaatgttaaaatcccttatattagggaacagagggagtactttcctgtctttctgatcaatttacagaacaggcattagcccttgtttagttcccaacattttcttcaaacttccatcttttccatcacatcaaaactttcctacacacataaaattctaattttttcttcaaactttcaattttagttaaactttcaattttagcgtggaactaaacacacacttagaatcaaactaaaaaaattccctactcttcggtacagatggaaaaagatatggctggtagctaggcatatcaaagaaacccatgtggaaatgccagggccagggcgagcagcgagctcgtcctgagctggctggcgagagttggcttgggagctagccggcgcggcctgcgtggagcgcgcacacatcagcatcgtcgccagctcggccgcccgcacgcgctggtcaccacagggttgatcgcgcattggctccatggaccgatagaaagcgaagtatcagtcgcgcgcgacctcacggactgcacagtagcactagcgtgtggcagaggaactctctgtgatgtatcggccggtgatcaggtctgcacagtactcatggtcttggaagacgatgaactctgtctgtatttggccttttgttggcctgcttatgggtgaagcgctgcaccgacgttacgctcctgcttggctacagggaacttctggctgaggattgatccatgtaaaatccgtggagaaactaatgtgctcttcattcattcttcaattaatcatgaccgtgtaataaagcatctttgcatggttaattagatcgatctgtcgacgggctgtaaactggttacgggcacacatgcatgcccctctgtcaacggcagaagtacgtacgttcatcgccatcaagttttccaggatgtggcccaacggcagcccacggattggagcccattgcatggagggcggcacactgcacagttagcgcgtcccagcctgcggctctgtgccactgcaagcagcgggcaagaaagaacaaggaatcagtataagccacgcgtacgatatgaacagaaatatctggcgtaatcaagttctcgtgtctcatgcaacgtcgtcactttcaccggcacaaacagcgtcccggccggccgggaggtcacgggtggacggatgtacgccttgacgatttgatcgatgcgctacccatggtattgttgccgtcggcgacgagagattaaagtatgtttcgacagatcggttgcagtgggaatgttccactgtaccaagggcagggtttagatctggatctcttgaaacaattatttggggttagtgataatttcgcttatctctttgtacttttataatgcaatcaagttttttgcgttgggcggacgtgcatgtacaggcataccttacaaattaagggatgtacgtataagctgatgtgcgttttgtagccggatatccttgcgatattggacggcgaatttctttggatcctcctatactttgcgggtcggtcacggcataaataatcaatacggtaccgaacttgtttctctgatggatcgagaactatatacgtggtccaccacccggctagcgagccaaggatggtcgcgcgcggattcgtggtgcacctacgaaatccaccgcagccgacaagacctccccgcggtgtattagcccgggcgcgcgcgcccctgcggtgtaccgagagccgggtggacgagtaggtcagtaggccactccggcccacgtgcttagagcaagtttaatagtacagctaactatcaactcgaaatcatctataatcaatgtaatagctaatttatacaatagttgtttactatactactaatacatagtcacatatgtcatatacacattacgtcttgaaatccgtgctgcaactgactacaaatctgtagcccgctgctcttctctttctttctttatatctttaaaatatgtttatagctagcttttagcttgctattgtacctgctcttaatagtatagctaactatcgctccaaatcatctatagttaattttatagccaattcatacaatagttacccataaacatatactacacaattaatatctggtctctcctgtcatatatacatgcatcttgcagttcgtgttgtagctggctacagatctgtagcccgttgcttctctctctctctcttattttatctccttaaatatagctggcttatagtctgctattatacctactcttaaccagaagaggtaagtaggtaacgtgtgtgatggcttcgttgcccttgtagttgcagccgtccactattagctctaatttatctatagccgatctaataacgaatttatacaatagttgcttactatactattaatatatggtccgacctgtcatacacacactgtgtcttggagtccatacaaatttgtaacccgctgctcttctctctcatattttatctcattaaaatatgtttatagctggctaatagtctgctattgtacctgctctgaatggtgggttcaccgagcgaatgttcgcacgcggtctaggtccgtgaacacttttggttcaacccacgtatgttatctttttgccgaacatgagaatctgttgtgagtgaattgcatattgggccatataaatttaccagagcttcagcttagaccactgaagcatctaggcccctggtgttaattttggtaattaatgacaagcactaattatggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcattacacacacattcatttgcaaattcactgggttcggcctgaccaggggcggtcagaccggccacatagtggcggtctgaccggcgtgccctggccggtctgaccggccccgcgggcggtctgaccggcggcactttcccggtcagaccggccccctggaggccgagatgatgctgctcgggatggccgatacagagccgacggagccgtagtcggtcagaccgagctgatggcggtctgaccgagccgaggccggtctgaccggccaccccatgtcggtctgaccggtcaggccgatggggccctctgacagcacttcaacggctagttttctagccgttgcagagtagcacggtctgaccggccacataccttcggtcagaccggcagagcacaaagttgggggatttcgccaccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggcttccgccttgcccaccccttgacgaagggggcgtgcggtggctttgtggttgagcggtggagttgggctcgcctcaatggggagtaggaaaccagcgagtttccgaacctcggtgaaaaatctcttgtctcattgtctcatttgattgtcgcatttacatttgtgcaatttactttcctagagatataattgagccactatcaccctaggtttgcaaaacataacttagttacttagttagagttcaccctcaccaagtctagcaacttaggttagatttgattaggtgttatttaatttttaaatcgcctatttacccccctctagtcgacatctcaatcctacaaccacccctaatacaaagatttcactttagaccatataactttactatttttttcactttggaccacccttgtccaccatctccaacttcagcagcctgctgccactgttggtgtgtgcgccaccactgtgaggatgccaaggtgccgtgagggcttccacacgattgttgctggcctctgtccactcatcccctccctttcagtttgtacaatcgagctgccatcgagcatgggtggcttcctcaaaattgatcaacagaagcttagagctggtcggcacatgagctccaaccgttcttcgcctgctctggccgattaactcgagctcagctgaaggctgaagctatctctacgcgaactggcccgatgcacgtgctcgcagcctcgcactcgactgtacctccttcctagcgcgctctctctctctcggatgcattgccggagttggtgaatgcccgaagaagcaacggcttgccgcttgcgtagtgcagtagtggtggcagtcagctagcaaatggaaacggatagactgacagattgatagaatagtggcccaatgtgcaaagatggtaacaaacccttgcctaaagtgaaaatattgcatatggcctggtccaagatggaaattaggcaataatacttggcccatgatgcaattcactcaaaactttatgcatagctaagtgattgtccagtactctaggaggtattagaaatacatcataaatgtgtaaaatttgataccctactattaattaggagatatgaaaattacactaaaacttttttttaccacttgttatctttgagctgaggcactgtaaaatttctcttacacatataaatgatttattaaaattttattgtaaaagtatttcaatccgaattcgaattaaatttgaaaatatactgtttatttaattttttcttataaatattcgggatgtaaaattttttgcgtaaatataccgtcaatctcgcacaaccgttgcgcgagaataacgtgggaatgacgtcgtgagcggtatccgcggcgaaagcgcgagaccgctcggtctcacggaatggtacagcgagacagaacggtctcgcgcaaggactgagcgagaccggtgccatgctgattcaattagcgactaattatcttaattagcaattatttatttattaattaatcgctaattaagataattagttgctaattattattagttaattgctaattaagtaattaagcactaattaaatggaaccggtggacagtttcgctgtttgattccgcgaaaccgaacggtctcgctcttccattgcgcgaaaccgcgcgctctcgtgccttcaccgcgcgagaccgtgcgctctcgcactttgaacgcgcgataccgcccatgacatcacacccacctaggtttcgtgcaacggttgcgtgagatcgacggtatatttacacaaaaaattttgcatcccaagtattcatgagaaaaaattgaatgcatagtatatttttaaatttaattctccgaattcaaggtttaaatcggagtcgaacatgtaaactctttcagtgcataaacttaaccaaaaattaaaaaaaaacatgtgctgtaaaaggaaaaaccataggcatattcgcatgtctaggtcacgcgagaatgttcacgcctgcaaccctgcaccccttgtccgattggcctcttgttgacttgttgacgtgtagcttaaactccggctcgcacctactaatagattgcatcctcattaaacatgcattttttaagaaaaaatggttcatgtactagatttactaactatatatctacaatgcagatgagttattttcccaactatatatttatgatctcttcttgttaagaatatgtatgtgctattacaccaattaaacgaaatttgtgttaaatttattgtgggatatatatgtgtagaatttagtacaagttacatgtttttttacgtgtgcgcacgcttatctttgggggccggggtatataacattgtcatatatttcctccgttttatattgtgtgtctagatttattaacatatatatacttttttcatctcaaaatatagcaacctagaatcgaattgaacatatcctagtactacgaatctggacatgggatacgtcatatccggtcctagattgctatattctaggacggagggagtatatgaatgtgggcaatgctataaagtcttataatatgaaacggatggatggagtattttagtagaatacatttaaaaaaatcattacattttagacgatgacatgaaagtgatgagtaaacatgcaagcacttcagttacaaataacagagcagagagactttatttttacgtactgaatacaatacaagtgatatgaatcaaacaataatttccaaaaaataaaacaaacatgtaccccgatgcataatctcgcgtacgcgcggagaaggccacaaattaaacaaaatcatatcgaatcaaaccagatacgtacttcttgccaccaaatgcacgcatgcatgaacatgcccatgcatgacaagtgacaacacgctgctagcacgtaggaaccaaataaacccctgttgcgttgagacgtgcatggatcgatcgcgcggctactttataaagcctttagaagcacttgaagccggtgggcacgcgcttgccgcagtagttgaggatgaggctgaggtcgacggggaggttaaggttgatgccgagaatgttgcccttgatggccgtgcagaggcacaccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttgccgaatgcggcgggagtcggggtgggcgtcgacggggtcggcggcgtcggcgtcgggcagtggccgccgcaggcgctgcccaacgagaagaccaccaggttgacggcgaggaatagcgcgatcgaggccttgcctgccattgctgctgctggatcacgcgcactaaaccgaaacgatattaattatctcttgataactcgatcgatttgcttagtgcttgtgatggtttggcattcaatttgacgtcgtatttataggagatgattaaagcaatataatgctgattggttatatgttatgacgagcaaccatgcatgtgagggtgattaggaagctgatctggattctccaaggaaagtacgctggaaatactttagctagtattgaacagaactagctagagaccaagattgctgctttgtgaatgcacgttgacgtttgtacctgcttgaaggttttggtcataattctgcttaagcatattcgcgtatggggtggctgctctgtctctctgtgcctagctaataacgtgcacaaaatgccaaataaagttggttttaattagtaacgatgcaataattaatgatcagggaaaataaacagcgaaagaatcattcgacgaaggacacccgtgttaagttgttttcaggtttcatagtgtacgtacttgcagaagagggaaaataaattccaggctgcagttttgtttcatttggctcacgggatcgtcgtcggatgattctatcgaaaattcgaacatatgcacttgtagtcttgtttggtttgcctcgtatgtaaataatctaatcacgtcgctgtgctacctgatccaatatatataatcacgtcgttgtgccgtcgcaggttttttttggctttttcttcgtgtgggtttagcctaggtttttacttcaaaccatgcttatgtgagggtttttggcttggttttctcttaaaatctaggccaagtcttttcttcttaaataaaaacagacactctttgtcctcttctgtgtttttcttttaaaaaaaaactatgatcttagacgttaactctaataaatttcggctgactttcttcagccagcctagtggaaaaaggagtagatcttgaattttgtctgccagatgagttacttatttattacattgtgtttgattttattcgctacaacataaccgttcatctctgacggttcaataaggttatcactaattattgagtgatccgatgttgattattactcggttgtgagaaatgactcattgtaacatgtgaacatccgtgagtgatcaagacatctataacgggccaaaaaatatcaaatgtgacatatatgaaaatcgacaaaaaaaaaagcaaaaaacataatcacagtgggagcttgcagtgctcgaggctgagggtgtagaaaagagagggagaaacgacagtccgccactatttcattgcttctgctcggatgggtgagggttagcacttaattagcagcatccgtgtcggtgctccggcttgggataggagctagacggtagccgcgttggtgctcgccgtcatatgggccactgtagtggcctctagtcattatcgtcgtcgtactacataagatcctatgttcttgagctcaaactagtcgaatatggcatcctcgagctcgaagtagtcaaattcagttactttattatttgtggagagggttaagcaagggagcattgctggttgtagggggcgaaggaagagacttggggagggaggggggaggggaggggtaagctggcaacatctgcattatgctcatgagtacgatgagcgctgctcgtttcaagagttcaacttgtgcgagagagataatagagatgcaggtcgccagttgaaaatcatatagattagaaagacctgctagagagcttttctctaatggctcgtatttatcattcgttatttatgatgctcatgatttgtgatggttcttatagactctagagatcaaagctcatctttaacgactacccatatattggttcataactatggcccaccataaagggtcctatacctcttatgggtcattctccacaggtatatttcaaacatactactttttagccattagaaatgagttcatctcaatgttttgtgttgggccgttacggcaccttttttttaaaaaaaaatagtgttttgcatgagtttctgaccccttttgagcttacccaccatatgcttacaaccttcttacccaccctaagcggtttggtaaacccagggtggcattcgttcacatcacccattccacgttggacatatgccataatcccaagcggtgtcaccaagccaatagatgacagcgggcatttattgcgcaccagacacaataggttgacaaggagtaaaaattcacaatttagtcaatctttcaaaacaatttaaccgtcaatattatattagaataagttttaaaaatctaacatctttatgatattatgatagtactagtatttttcaaggaaaatttatctatatataccatttatttgattttaaagtaagtattcgagaaagtactatcgatggtcaaaagttcacaaattttgataacttttgtcttaaacgtctaagtacgacgaaaacagctagtaactctttttgcggacagacattgggcattccaaacaaagtgtgaaatttattttattcataatgcaaaagaaataatcaacagatcatacaaggacccacacatgaaacgaataaaaacacggaaaatcgagtagctccatggtacgtgtgcatgcttaatttgcaggtgcacgcatgcatatttgtcgatcgatccatgcatgcgcgcaaatgttgcaagctaagctagcacgtagtagcaatcaaacagtccagataaaatagccagcggaacaaatgcgcagtagcgccgccgcctatcgatgcttagcatttgaagccggtgggcacgcgcttgccgcagtagttgaggatgaggctgaggtcgacggggaggttgaggttgatgccgaggatgttgcctctgatggccgtgcagaggcataccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttaccgaacgccgccggcgtcggggtgggcgtcgatggggtcgacggcgtcggcgtcgggcagcggccgccgcaggcgctggccaacgagaacaccaccaggttgacggcgaggaacagcgcgatcgaggccttgcctgccattgctgccgctggatcacgcgcactaagctgacgagcgattagctctctggagtttcaggagctcctgattactagctcgattgctgtgtggttgtgatggtttgatggcatttgtggcttgagtatttataggagaaattttggtgcaatgctggatgattagtgggtgcagctgtgagcttgcatgtgaggatgatttgctggttgatctggattggcctgaatatattttggtagaacattatagtgacccagatgctgcatttgaggaacatgctgacgtttgtttctgttcggtgattgatgatagtttagcacacaatcttggcgtatggcatggctgcactgtacctcgtaacatgcaccaatggcgaaaaaccgaattaattaggaatgttttttggcgtgatcggttgatagatcacggaagggacgtcgacatgtactggaatcaaagcaggaggaatcatatcatgctaacttgcttgagctttccagacaaccaccactccagcccatatttcggttttttcggaaaatgctagggcaggcgcccgatccggcgggaaaaaaaatcggacgccctctcccccacgcgcgcctctccgcgaaaaaaaggcgccctcctccacgcgcgtctccgcctgcctcccacacgtccccaccactcaatgccctccgttgcaacaaatctcccacatattacggaaactctctgttaagagaatacgtttcattttttttctcaactagtgtacttataatggttaattatgtatggatgaaatgtgaaatgttgcagtgaattgaaatattcttttgcaacaaattacccacatattatggaaacgctttatttagagaatccgtttcaatttttgttccaccaacaatgtttcagtaagtgtactcataatgtttcactatgtatagatcaaatgttgcagtgaattaaaacattatttcgctatttgctgaaatattatttttatataaggtgaaacaacgcctgattttttaaaaaaccgttttcatacgttgtagcaaaatgttttatgaggtgattttgttgtgtttcagctttttaaacgattgaaacattttcgatctatttagtgaaacaattccgatctacttggtggaacaacgtgcaacatttaaaaataattcaataataagctaaatattttttcatcggattatatccatgtgtggtcttgtttttttttaaaaaaaatcgagcacccgatccgtaggtgcgtcgattgttttctaaagtaaatttcgatggtactaatagtcatgaatggattttaaactgttgaggaaatattccctcgttgtttgcaaatcatccaaataattatgaaagaaaatggcaagatatgttaatatgtgatatatcactctgaaacatgttggttaaaattcaattcctataagttaaaaaaaatcaagttcgatttatataagttaaagaaggagttaaaatttggtttctatataagttaaagataaagaagacagtcgttgctcgttagcttggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccagattgctcgcgccggcgccgcccctctgtcgtcgttgccccttgttcgcggcgccgtcgaccgctgccgtccgctcgcatccttcgcccgtgctcgccgctgccactcgctcgcatcctcagccatggctgactggtgcagcgagcagagcggaggaggtagtgcaacggtgagggagggagggtgcggcggcgagggagtagcaagggaaggaggggaggctcaacggtggagggctgtcgaggaagacgaggctggccgcgctcctgtcgtcctctgctgcccgtgttgctcccgccgtcgcagcctccatcctcgcgccacactctcgtcgtcctccaccgcccgcaccgctcccgtcggcgccgccttcatccccgcaccgctcgagtcgtcctccgccgccgcgccgttcccgccggtgccgcctctattctccccacgccacactgcagagaagagaggagaggaataggagagaagtgggtgaagaaaaaggggagagaagtggaggaagaagggttatttgaggctgacatacgggtcccaccgtcatagattcataatggagagtatggatggagagtctgttggagcaactaactagtctgactagctaagtcagatagagagttggctatataggtgtttggagagtctgatttagagaggctgttggagatgctcttactggtaaacgaaacatggaatatttcagcccagataggccccaacttctctcaaccgctatcatgggtcacagatttcagccctgatagcccccaacttctctcagcccagatacgcggagttgcccatgaaactgtgaggcctgaacgtttataagctttggcccattgtaaacactattcacattggatcttgatgatttcttgaggttagttaggcctcattgagaattgcagtggctcctcccaccactgagaaacgagcacagcctcatctcacgcggcacgatgcattccatcaaatcaaatccaatgcacagccgctttgcggttaccgaagcgcccgtttcggcgaagagtcgcacagcacaactcctcttcaaagcccatcactcacacgcgacgcggccgctcaaacaaaagcaaaaaccgcccactactttgctcgatcgatcgagaggaggatcgcgcagacgtagttcgtgcgccaccgatcgacgacgcgagcatggacgtggacatggagaggccgccggcggcgacggcgcagggcgtgcggcccaaccccgtcgtggagaggaagctcggagagctggacgcctgcctcgccgacgcgatgtcctcccgcccgcggcggagcgacgtcgacggcagcctcttcgcggagattcaggccaagaccgacttcctaaagacgcttatcgccgcggagggggagtgccacggcggcgcgctgccggagcacctggaggaggccaaggcgcgcttcgccgtcctcaagggcgcgttcgacaagtgggcgcggcgcgacgacgcggcggcgccagcggaggaggagcagcccgacggggcggccggctcggggtccgagtgctcgtgcaccgagtcatgcttcggggtcgaggtcaccggctgcctggaggcgacgtccgacgtcgagcgcgaggccgtggaaatggcgacgctcggcgccacgttcaacgccgagcgcagggccggacacaagccgtcgccgtcgccggcggctgcgacaaggaacgctgctcggcggcgcggatggaggcggagcgctgcttgctgcggtgcagccggcgccgtggcggtgctcgcgctcgccatcggggtggcgattgagtttgcgtcggtggctcgccaaaacgtttacgttgttccgacctgacagatttgtttcccttgcaatttcgctgtttttttcgttgtggcctcctacagtatttagcaacatgtagagtagctaaatttcgctcttcctgtttcttgtgtggtatccgactactcataaacatgtagtagtttactgtaagaagtaaatcaaggagatattggtattttatagtctgcatacattctaaactctcttaaatgtgtatgaaaaaatttgaaaaaaaatcaacatgtgagataaaatttaacaagataaattaatatgtgatagatcaatccacaaacatacaagataaaatttaacttctacatgttacaataaaaaattaactgtgaatgtacattaactagttgtagtttaatttgttttattttgtaacttgcgtattagtggagtcatatattacatgttaacaaatcttctgatttttttttcatttttatcataactatctgagtcatgcaaacaacaagaatgttctctccgagactttaaaatcccttatttgtttctgcatataagagattataatcctgcataaaacttgtcttaaataggttagtggggttgcttggccaaagctatgacgacttgacgagtccttgtccatggcaatcatctgtgtctgttcattttgtcatctaggctcatctcttcacttcttgagtcaatagaggaagtagtaaaactttgttttctctatctatcacggcattacagatcacaagtacttcaattatgctatacaatttacatgaataaaatgcaaatagctcgtcttctatctgaaaatgtacaacctattgaatattttctatgcgtacactactactctattgcctgtgacagtattatagatagcggagatggtgcgttagcttggtggaaataaacagagatcctttttgcgtaaacatatgactaaaccttgatctgcttcatgaagtgcccaatgcagacagatgacatgaaaactagcagcacaaacattgctgagaagccctgttgagatgatcttgctgccctaagtagttcctgaagcaatattaaatttaaatgttcagacgtttgacaaaaaaatacaactaatacttgtctaagcagtcgttttaaaaaaagtgtgttgcagttgtgataatcaggtgttagaatttacaagttgtacactgaggttgttcatcaatattgagggcataataactcataattagcaaaagcctgtaactgaaattgtagttctggtaacatttaactcgagagatagaaaatgccaagccaatttcagtcatgtttcttaaagaatttattctgtccttatatacctaccactaccggtgcatcattatttcagatgagaagatacaaacaggaatagcattattcctactccagtttgtcgactactgtagctcagtaacgcaaatgttcccttcatggaaactaaaggactagggctcattaaaagatcacctatctatcaccaaacgccaatgcatcccatatcctcattgattaaccaatgctgctattcaacagtttcctggagtcaaaagctcctttgtacatatttatccaataaagatatccagattcggtggttttatgtcactcaaaaataattcgctttgtaccaaactaccaatagatttgattgagtacgtgtcatttttgcagagttcaatccagctttttagtgcaaacatattcagtttaacaatattgttgcctcaggcataatcagggtgaaaaagttaagtattatcactatttccttcaagatataaacattgtttcaagaaaacgatttagaagcaggtactgcagtagaatccaacgctgaaatggcaggctattcaaagagcgtaacatacaggaaaaaggtactgaaatcttaccatctgttgctgaagcttctgattttcttctactggatattctctctctgcaaccagcattgattctacagagacaccctgaacagccacacgcaaatgcaatatgagcaaggcagagcaaactgatagattaaagcgtcagtttactgcaaaaaaattctgagtataacccgctaaatagtattgtctcaaccaaccaaacaagacaatacactgaattataacatacaggttctttgttttaggtatcatactgctgtactgacaatggcatggtaccaaacaaggtcacttatctacccagacaaaacaaactgaagaaagaagttgactactaaacttttgataatgacatcaagagtctcattctgcaggagaagcatcacaaggttgttaggtaaaacacgttagagataactttgacatgaaaatttttagtattacattagctaacatgtgattgtgatgaacctgaaatttttgttttcttttaaaatcggacatcggctcgtgtgcaatgtgcatttttactatagaaaaagcatcagagtacactcaatattttttaaaaaatgtaaaacccggatgccattatgacaatgcaaccaacaagactatgcatcactcatcttagtgactaaaaaaactttaaccgagcaaatggttacctcagcagatgaaactttgtctgctgacctatcggtgagtgtggatacctgagaaggaaacatgtatgatattgttttctctgtagcaccgaataaacatcaatgcatgatattacttacagttacagcatcaaacactgatgtcattttcactccatggctcatgacctctgactgaggggatgcatcctcttcctcttcctcttcctcctcaggcactggagagggaggattagcagcaacatacaccacccgcagcttgaactcctcgatcaccctgcctggcgctttagtaaactagaaaccacaacaccatcagctctaaattttggtaagccccggctagagatatcagatatccatgaagattgctacaagaacttaccaattcagggacaaagtctctcatggtcgccccatatccaaccgccacgctctgcacgaggaacttgtccttgcagtggtaatcggatagcatttaacgggagcctgcattgtaactacaccgatttcacaatttcagtaacgacatgaacacaacagaccgatcggcaagtcgagcaaattaactaattaagcactgtaatagtgtaatcatgtagagcaaatcaagcaaacctcacctgtgatatcgcacgagctccggggcggcagtataccgcaggcgtgccgcacagagtacttccttgggttcgtcgttttcacctacggattgtcagttttgcagaacgaaaatccgtcaccctttcctccaaacgcatcacatgctcacagcagcatcagctcagagcgagaagaagaacagagtattcattcaccttgaacgccacgtactggttggtcttgttcgtcagctgcatgcagcaagacctcttcctcttgtactcatcttatcaaaccaccgcataaacaagaaatcaagaagaaaatcagtcaagaaaagcttgaagccaacgctgcgaacaatcaagagtttggttctggaaagcacttacaggggatcttgagctcggaagggtgcacacgaagcagcgtattactcatggctccgatcggacagagcgagagcgagaaaggaggagcagcaacagcggaaaagattcggccttttgctccctttcccgttccaaagaacctgtgtgacctggacgtcgcggcgcgggaagtggctaagcggttgctgcctcttgaagtaaagtatacgggcaaaatggcgatggtatgatgagcggatggtgatctggaattctggattccgtggagcagctcggggatcggaggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaattgcagaagcacaacgttcaaatgccccatgtataattcagttgttctttctctaattcagtttatccatcataattcacggccggcttgacaggccaacaccacgttgaggcccattagttgtcagcccaatgctcacgtggactcaaaaggcccaaatagcctattggaaaaagtccactttgactcccttaattgttcaccgaatctaattcgtgacccttaactacaaaaccgggcaggatgactctcccaattactaaaaccaatacaaattgaatccctcaacggttttggagggtggttttgctgacgtggcacttggcccattatgctcgctgtcagcctagtcatgaggcccacatgcaattgattagggaaaaatataaaaaacgtagggccagcttgtcagggcactcttctccctctatcttttaaataaaaacagcagagcaaccgccgccggcagcgatggcgatggcggtggtgcgggcggcagcggtggatggcaatggcgatggctatttgtggcgccgcttcggctcgtcgccctccttctcctcctttgtggccgactgctgcgtcgcgcacgccacccttgtggagcgcggcgccgctctcgccgaccgcctggaggtggcgcgctcgctcctcggcgagaacggctacaccatcacgcgctgcagatgtgggcccgtgtggcaaatcctccggcgcaaccttgtcgccgagacgctgcacctatcgcgcgtccgcctggcggggaggtcgagggaggatacaacagatcaacagcaactcgtgttttctagtaacaactacagagctgagcaggacacaagccgccgcaagatttcatcagtgatattcttcttttgaaaattaatcatcagtgataatcgagcggggcaggcgtatccttgagatccatccgctggaaatggacatcctgcatgcacatcacaagcaaaaataattcagtcatcacaaacctacacaaagcacacatcaagattgggaattcacacgcacgaacgtaccgatgcgaaatggttgacgtcgcggtggtgcgcctcgtcggcacgaacaacaacgacgacgtccttgagcgtggcgccggcggggagccgccagtagtcgatggcgatcggcggcgcggggacgttctcgatcttgccggcctcgatgtccttgaggtactcggtgtaggagtggatggcctcctcctcgaggtagccgacgacgcggtgcgcgagcttgggggagaggaggtagccgaggaagtaggcgttgaagaagacgcgctggacggcgagcacaagcgtgcgctcgtaccacctcggcttggccacctccatgaaggtcatgaggtgcatccgctcgttctcggcctcctccagcagcgcgcgtatccagtcgccgctgtgctcgaagctagtggcgctggctcagtcccgggccttcctctccgactgcctcatcaacgccaccaccggtcacccctttatcttcgagggcgccttcttcctctccctcgccacccgcatcaacttcggcacccccaccaccgaccccgtccgctaccccgacgactgcgtctgggagtccgacatggcgcgcagcccaacttcctcgttgaggtcgcgcccgctaccgctcagacctgaccgaggctcgagagcgaagctcggcatcgcccagatgcggagctcggcggccgtcgccccccgcctgccgtcgcccccctgctgaattgggagggagagagataagggggagattggggaggatgaggaagggatagactgacatgtgggcccacaaattcttcttctatgtgaatgacaaatgggtcccacgtgtatgttgttagttataatgccacctaagcgtcacatcaacagcagaccaagtcaacattgccatgtagatgccacgtcagcgaaaccactcttcaaaaccgccgagggattcaatttgttccggttttagtaattgggggagtcattctacccggttttctagttaagggtcacgaattagattcgatgaacaattaagggagtctaagtggactttttccttacaacaatatcgatcccatgggccaccgtggtgcaggcctagttgaaggctgcaaaatcccccttctacccctccgttctcgatatatacgccgccgcctagatgccattctcctcttctctctccttcctggtgcaacacatcgatctcaaattcttcacaggtttctctcatttcccttcccttttattatgaacttttcgatcttttctcccgcgcgctctcaatcggttcgagaatgagaggattcgttgtcggctcgccttgtgtttttgccccccttattttttttttcgtttccaattccatgatatttcacatccggggtgcaagtttgtagatttgaatacttttaggggaatgccatatatactagatcggaactgttcatggtgtagttacctttctggcatactccgcgacatggtgtattcatgccgcgcacgaatcgcatcgatgttttctgtttctgaacttgattgtctaacatgtcgttattactttagatcgtatttattccatgatagactcaatgcatgtgctgtctattttgtgatggatattccccccccccccctgaagaatcacttccttgtagttctctaccgtcagattgaatttttacagaaattatgcatgattggtttttaaaatcgaagtttacagcaatgcaaattgactttggtgccctcatgattcacttggcaaaagagaagttaggcgtacctaccatgtcattaagggttaatgatcgatactagttacttattgctaaatgttttctcgggtagcttatcactgtggatggttggcattgcattcgtaataactgaatccttctggtaaatggcatgccattttcagattatttgaagcaacaacaatttgattctgcaatgtgggcagatcggtgcatatttgtactttgctctttatttgaagggaatgtttatactttgctccaaggccttttcaaccaaaatattgagataaacttttctgcccacaggataaaaattcaatttagagcgttgagatcaaagtttttactatgccgaccattatgttgttttcattctttcctcaatgacaaggacgctgatgtagcataattactttctgcgggattaatctaggtgcaaaggggattcctgttggatagatgccattatatgagtttgctcatgtacgcatgatgtcatgtaactcatcttgtattttgagatttttcaagataaatgacgcctcttggctcttgcatgcaccaatgctatatgaccaggtatatgcgtagggcggattacatggccttttctatctggctgtcatttttctgatgcacataccttcttgaactggagagtacatgaaggtaaatcacatttttgtgattgtaaagtatatgtgcgtttagttgcgtcatattattatcttgtgttttttttttccagatctctgctaactttctgttgaacaactgtgcacgcacctacaccaagaagaaaacactcaagaagtggtttttcattgacaagaccctgggttaaatctagttgaagaaggcctattccacctcattttggtagtggatatgagcaacggtttgccactcatgaccaatcccatgatcaaaagccagccagtgttggcactgccttcaaatctaatgccatgtttggttacatccaagaagcatccatgttcttcattgtgtgtgacatacatcagtaagcgtgaacttgttgaagtcgttgatggacttgtcggggtaatgatgacatcatcgaaccgtgaaaagccagacattgaatctggttacgacggttcgtctgatgaagattccactgagaattctcgtgcagtaagttgcttctttcggttttctgttattctctttgttttctacaaaggattttaatatgtttatcttttatatcaggaaatttgtccttctgccttatgtttcttcgaccaaatcgtagctagtgcgcaagacaagaaggttgtgttgtttctagactatgatggcacactttctcctattgtgaatgatccagagaaagcattcatgtcctctgaggtaagccagctggtgtaagataaaatatgtattgaaacattgctttatgtatgtgccacttactaatattctcaatctgaataccttccttcagatgcgtgctactgtgaaaagtgttgcaaagcacttccctacagcaatagttagtgggagatcccgcgacaaggtctgaatatattttttacatgtattggtcttcacgttttagtgtgacaattatgtcagtatgaaaatcacatatctgatgtttgatgctggcctctccatgtccaggtgtttgattttgtcaagctgactgagatatactatgcagggagtcatggtatggacatactagcatcttttgcagattcagacagtccatagaaaaggtgagtagttgtaggatcattttaggtttcaggcatgaatacatatatttgttgctcttacatttttaacgattgaattcattacatacacgtcccttcatgtttcatcatttgaaaatattgttgagctctctattgcagaccaaagaaaccaagctttttcaacctgcaaatgagtttctgactatgataactgaggtactctttgtttcagtcatcagaaagcaatagatctggatggatgatattgaaaatattactctatatgctaatgtgcctgtgtacaataggtttccaaatccctgatagaggtcactaaagcgattaagggtgcaacagttgagaacaacaagttttgcgtatctgttcattatcgtaatgtcgacaagaaggtttagttggaacattcttgcctcccttgtggccttgtcgctttgcaacaattgcaagttttctcctataagttttttttttctcgaatacagtttctcatataattttcacctgtttccctccagaactggaagttggtcgcacaggttgtcaacaatgttctaaaagattttcctagtcttaaagtatccactggacggaaggtagaaggattaaaaagatagcaatgtaatatactgttcctaataggcggttcatcatttgtatgctaaacaggtatgctattatgcaggttttagaggttcgtccaatgatcaactgggacaagggaaaagccgtcgagtttttgcttcgatcgcttgagctagatgattctgaaactgttcttcctatctatattggggatgataaaacggatgaagatgcattcaaggtcacctttcttcagaaattgcataccacattttagatccatcttacttcgagcgttagtgaactcaattattattcctttttttttttattatacgaccaggtgcttcgcgagcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaattcaaaattgctttggtcatttcacttaacaattgccatgtaggtgatggaatttctcagttccttggtgagatggaaggaacaatcaacatttgaagattgacagcttagccaatcagttttagttgggatagctagctgacgctagcgtttaagcattccctgggcgacaattttacagtgcccggacgtggagctggatagtagctagatagtttagctcccatagttgcaaagaaccagtcgatgctattccgtttcttctaatatttatcatcagaggcagagttctagtagttttttttttatgaagtgaacaatctttcagttctaccagtgaaaattcacaagcattacggcactgtgctaatcctgatattttctccattagtctccatcttggttaggtaccaggatttgcaataatgtcaactcgcatcccctttctcccctgaaaatgacagggaaaaaaagaagttcactggacccgccgtagacggcgacgtgattctctatatctctaagactaaattgtggggtaggattccgaaaattcatgaattggttacaccagtttacaacaaaaaacttcttgtcttagtaatcaattgaaattagttcgatggcatcgaccccatccggtcagcctcgtggatgcagatgatggtcaccggggtgtccatttcttcatgacgtcttcatcctatccatacaagctggctggcagcccaatgatcgaatgcatgcaatgcataagatcttttcctggctttgctgaaagctcacgaaattaggctacaattcacaatatatcgtttaaactagaaaaaaaaaatgttccgcaggtttgctcacccggcccaaaacgagcctgacttttctgaagttagtactactaccactactatttacgaaaaccaaacgttaaagctgacagccgttgcccgttattacgacttgttggagtgatatcactgatatggcaacaaccctcaaaaccgagtcaagttcccgtataaatatttccaccacctgtacataattcgcaagaattttgagtcaagccgtttaaaagatccggaa

SEQ ID NO: 74916 - DNA, 13496 bp, Oryza sativa
  unsure (1)..(13496): unsure at all n locations
ctctgttgacatgtaaggatggaacccccaggccccatcacatccaccagtaatcgctttgatcgattgtgaaacacagagggtgctgaatactcttcaaatgaatcaattcaataagcatatcttgcaaccaaggagatgaatagagtcacaaacaaaactctgcacaaacttatcagcggttatcatcattaaacagcaccttgtaaaacttcctcctctcctccctcttctcagcactatccaaccgcgctgcttcctcatcgtcctcctcctcttcctcctttatctcaatctctcctctcctcctcttcttctccaaattatccgaacgccgccgctgattatactcatgcagcccctcctgcatcagctccccgagcctatccttcgccgctaccaccggatccttctccctaagctccgacccctcgtaaccctcccggagcaccaccgtgtgtatcttgtacctgtttgagacgtagaagaggcacggatgccgatgcagcatcctcgccgtgtcctccggcaacccgaactccctcctgaaatgctccagcttcagaaccgacatctttttccacaatgtgagcgagaggagctcgtgcaccaccgccaccgctcgcttctcggcgtcggcgtccgtgcctatcgccgcccatctctccgagtacggcgagatgtacggcgtggaattgaattcctccatcttggcatgagacttggcccaggagggcggcagcgagcaggtgaaccgcgggcggaggagtcggcggcggaggcggccgccgcctcgacggaggagacggcgagggaagggacccaccggagaagctccagctcggcggcgttgcggcggtgcgggtaagggttgccagtccgaanaggtcggtccggcggggaggagcgnnagcaggtagtcgtcgggaggcccgagcgggccccgcagcgcggcgagctggacacctggaggcgncggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactggaggaggcggacgggggcggtgcgggacgggaagcggaggaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgagccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaattctatatgaaagttgatttaaaaaatcatattaatccatttttaaaatttaaaatagttaatactcaattaatcatgagctaatggcttacctcgttttgtgtatactcccaatctccttaatccccttctgctcaaacacacccttaggccaccagctacatgcaagaactgcaagctgcagttattaggggtatgtttagtttcaaagttttttttaaaactttcaactttccatcacatcaaatcttttatatatatagtaatttttcagtcacatcgtctctaattttaattaaattttaaactttggttgaaactaaacacactctagatgatgatgcgatgaattctgaaccgggggcctactaccgtctaccactagtctggtccttcccctcgagtaataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcctaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatttaaaaatatcattattatgtttctaattttatagtttttaaaagtcatgtcaatcgctacacctcactcctttgtcacccctttatttgcttactcgatctaccactacttctattcattctctttacaactttaaaaattagaccttgtagattttagagttcattgtccggtcaaacgtcgtcaatgtactcatttaccacccgttcgctgcctcatctctttattgttattgggattttaaaaaccgaacataattattgtgtgtgttcttttttactttctaagagtcccaccaaaccgtcagcagcttcgtcactacagtcctctacggctctaccgctgcctcccatccttattatcattgagattttttaaaaccgaacatgtttatcattggctttttttttttactttctttaagtcccgccaaccgccataactatgttgtttaacgggctcgtcatttctcctcttaatcatcattgggattctatttttcaatagcctttattttttatgatgaaattttatttatttataaaatgtattcctaattgaaatattatttttctttttctaatttcaggatttagtttattttttgtttcaaattttaattaatattctatatggactattatttttaatattcattatttttttatttcaaatttcagttgtttcaaaattgtattcctacgtgaactctcttttttatttttctaattttggattttattttatttatttttattataaattagttaatcttgtattgggtttttatataaactcttctttcaatattgcttactttaatttcaaattttagttatttttaaattgtatttctacttgaactcttattctatttttcttaatttcggattttattttatttttattctgaattttaattaatctcgtgttgggttattacatggactcttattttttattttgaatttcagttatttttaaatcgtattttgatttggctcttcttttctttttcttggattaaacccgcgcgattgcgctcatacaaaattactcaaatgattttggtgagctaatattatttcttttccaaacgtatacgcaaagagtggatttttttttaaaaaataatacaccaaaccgtagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagcactatcggtagctttctcgaccaatgctacaaatacataaagcgggagggaaggggacttctaatttgttttatcttctccgtttacgatttctcttcaaacttctgtatgtaatgtactcgatctgattaattacttttcttgatatgactctacatacggactgtatctataaatcttttttctactttctataaataagattatattatgtattaatctccaccatcaaaatagagatcttctacaatctaacgattaatatctttttctttttcttcgattaatatgggaatttctaacgctcacagcgaacgtggtgtcttctttcaaagctgttttaataatataatagatagatgttgtattgaatgatgggtaggtgaggggtattgaagtaataaaatttctcgttttgcagattggtggaacttcgtaggcaagaagtttgaagttggagttggtttattttaagacaaatttgaactttagaagttgatttattttgggattttaggatttaaattttatcccaaaagcatgttattttagagtaatttttatcacatcaatcacctcgaattcaaagttttctttattctactctcaactatcatctcactcccaaccccatatcatttatcataatcatttttgttaaaatttagattttactatcttcgtcccaaaataagtacagctgtgggtatccatgtcaaacgtttgaccgtccgtcttattttaaaaattaaaaaattaattgcacataaagtactattcacattttatcatctaataacaataaaaatactaatcataaaaaatttcaaataagtaggatggtaaatcgtttgatatgaacagtataaaactaactaaacaacctcaaatgataattattgtaggacggaggtggtacatattgaaacggagggagtaaattttatactcctgcgtagtaatagtactagtagttgtaatcttttactcactttgtccaaaaaaaacttaagctaggtgaagatgggatccatcattctatccaaatttcttgtaatataatagattgcatttccacctagattggtttattttatggaggagaagtgtacactatgactgtttgtttatgataagatgcataatttaccttaattattgttagcacgattttcaaactattaaataatgtgtcttgcaccaaaactttttgtaaatgatgctctaaaatataaataaattcatttttaagtttgtaataattagtatttaatttattattcacccatagcttatctcgtattatgtgcatcaaaaaatcttttatcttaacctataacaaacgaggccgtcattccatctagaccccatttgttataggtggagtgacagccttgctttattcggcaatagtttaatctcgtattgtgtgagttaaagaaaatatttatcttgacctacaacaacgaggttgtgtttaggctgtgtttagttccacgctaaaattaaaagtttgaagaaattggaacaatggtacggaaaagttgaaagtttgtgtggaggaaagttcgatgtgacagaaaagttggaaatttgaagaaaaaagttggaatctaaacagggtcttagaactgctggttcacatctcctatttctcgttttttgtgcacacgatttttaaactgttaaacagtgtgtttttttgccaaaattttctatacgaaagttattttaaaaaaatctgtgcatgctaggtaggcatggtttagttcctaactttttcttcaaacttccaacttttccatcacattaaaactttcctatacaccaaacttttagcttttccatcatatcattcaattttaatcaaactttcaattttaacgtgaactatataacacaccctcctattgttgcgaacacagccagttggagtggcgggctcgctctactcctagatccaccagattcgcatcaaaatactctgatgcctagtataccagtagatactcccaggtatacttacactgtttctcggtactcccatttactggggtagtactcgtagcacgaagtaccagtacactctactcctattcgtacctcttactcgtaaagctgtagcctgtaggagtatttatttttctccgtccacgcaacgcattgcattgcaggctacagtacgagaagcaaaaaaaaaaaaaagctttcagagccaaagtcgtgacaacataatctcaaaagggaaaaaaaacaaaagaaacaacggggaaaggaaatgaatcgccatcaatgcaacgcaacgcaacacaacgcaatgcacccccccccccccgccctctccccgggccagtttcgccgtgcccaaatcatgacctcgcgcacgcacacgaacccgcaaacacaaacacacgcgcgcacgcatcgcttcgcactcgcaggcgcagcgcgcaggcggtgatccatccatcatcccaatacatccagcgcgtcgtcaccgcgggaagccagcgtgcggcaacggcaagcggatcggagctcccccgtccatccatggcaaccacctgccgcggccgggctgctgcgcgcctgcgcctgcgcctgcgtgcagcgatgctcctgtcgtcctgtggctctgctgctatcgtcatttccgcagtaattgcggggctgtccagtgtccatcgcttcccgcgaaaagtgggaagcaaatgcggtggcagctctgccatctctgggcgctagctgctgctctgccttgcctgcctagcttccgtttctcctcgcacgcatcagcagcagcagcagcagcagcagcaggtcgcatgcgccacacatttcccgtaacttgatacagccactaggggtacgctggtcgcagtcgcagagcaactagctggcccgcgcgggcagcagagtgcagaagaagaggtgggggtggaggggttcacggcttgatagcgaaaagaaaacaatgcccactttcctctttcaaactccacgcactctctcggtttctcgtgacacaaactatggatgatcggataacgtaactttcccttgccttggtggccgacatatcggcccgatagtggtgaggcttacagtacatatttcacggtgaatagtcacgtcagacgatccttttccgataatagagcatcaacggagttgtttgaaatgcttgatccagagattaatttttagtctttatcacatcggatgtttggacactaatttaaagtattaaatatagactaataatagaactaattgtataaatgatagctaattcgtgagacaaattttttaagcctaattaatctataattagcacatatttactgtagcatcacataggctaattagagattaattaggctcaatagattcgtctcacgaattagtccagggttatggaatgggttttatcattagtacgtttaatacttctaattagtatcaagcatccgattggacattgactaaaaattggttataaagaaaaaaaatcagtcatgtccgtttggcgcacacactctctctaaattcaatgcatggttattttatctccaactacctgggtggcccgcgcgattgcacggttagcacataaaaaaatcatatattttttagtatgattttacttaaaatttattaaatagctaactcgttgtcttcaaactttgaaataccaaatgttatcatccccgtgtttctaattatatagtttttaaaagtcacagtcgctaccccttacttctgacatctcctttatttatttgctcgatctaccactatttatattcattcttcttggaacctttaaaaattggatcttatagtttttagagtttattgccttgttgggtttctttttataatttctagaagtcccatcaaatgttgctattatactcctttatggcccgttgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcagggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccagtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggacaccgttggggcgtgtcctcattgatggaggagcagccctcaatatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaatgcggtcctggggaggcccgcgttggtgaagttcatggcggctgtccactacgcctacctccagatgaagatgccgggccccgacggccccatctctgtccatggcgacctcaaagtcgcgcttgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcagggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaaactgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttagcggcgaccccccaagtagttagtgcagcgttggttgtggagcgcgatgagggcaatcctcattccgcgcacccccaccctgtgctaacttggcccgggagcgagcagggaggagaggccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagggttggccctttgcccgcttgtccgacgacgccaggagcccccgacccccaggacggccccgaggccactgcgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgaccaataatatggcagagtacgagggactccttgccggactcagagtggcagctggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgc

SEQ ID NO: 74917 - DNA, 35190 bp, Oryza sativa
aaatccaaaaaagcggtctgtttgacaaaagaaaacaagtagacatgtttatgacacttccattttctagtaatcttgttctccaagaacattttctgataatctcgaaaaaaatctaaggcttgatgacatactgtatatgcacggatagtttaacctgccatatttcattatttgtattccacaaatttctaaagcagaagaagcatatctgcatatctcacctcatatatatttctgaatacacataggtaaaagagaaatgcattcttcagtctaggtgagaaaaaatgaatagttaggaagattagattcatttactatggacttaaccaaaaaaaatagtttattactacacagctttagtaccgctgataccatcgatccattttgtccattctcttcgctgttacagtattgctgcaaattactgaacagttgtgacaagaaaagttgtattttctcttagggatggcagttgaaaattataggaacatgagcatgccattctcaagtagtctatatgtactgatgtttggtcaaatttgttcaatctgaaaacatacatgtaactgaatatggcctaggattttgaaggtaacatgaataaaatagacaccatgccttttggcttggttacaacaaatagcactaaagataagaatacacactacagatggttgacatctagaaatgtagatggctgttgtagaattagcttattaatatatgcgatcaatggaggaacaatattgagagcaacttaccttgcctgtgggcaggattgatggactacgggggccgggtgaggcatcccgctgatcttgatcaatcaattgtgaagctggtgagcagacaaaagatcagtctgcaaatataaattaatatatcaatgatccaatttgtagtaatctgttgcaagcatacaaaaggtagaattttgctatggaataaatttagcacagtatccacctaaatgaaaaccaattcagcgagagcaaaaaaaaaaataccgctgacctcctaaatcagcatgaacacttatagcaaaacaaacttcattcagtttggatattttcacttgtaatttcacgagtctggacactaccataatgatctcatctacaatgtagagaagacatggtcagcacatcggtagtacctttctcccaaaattcaaggcagaaccagaattggacaacgataattaaaattttataccttacttggattgactcgtagcacatataaatagaaaggttaggccatgcaatttaggctactgttgattctataaagcaatgggggaaaatagttgataagggtcagggttgccatggaggtgatgccatggtgagacagcagttaaagtaatcagtaaagcatttttattgtatcgacggctgacatttaagatgcacaacaatccaacggctgctatatttctgatgatgtggcttcacatgatcccagctaatggtgattccgatagtagatggatataattgaatcacactcagtttcagcaaatacattatacacaaaatggcatgtatttccaaggttggccacagtaatcagaggaactttggattcgcaggcagtatagctgtatttgaaggtaagagtacagggtaaaaccaagcatcatgctatcagggttaactgcagctgttgtgccctctctagaacaaataaaacttacatatatcaaaaaatagattgactgtggcagagaacgagagcaagaactccttaccagccagggtcagctgcatgccgccatgcccgcatctgcacacccgtatggtattttgcctccatgccatcgcaatcgcagccacggcagcggaatccgccggtgcgaccacagttgacggggaacactgtcacgatcctaacttcttcccgaggaattgctagctaatcggaatcggagatagatttgaggagagaattggattcgagagagaagagcaaaagggaaagaacgaacagaggaggaagacgatagaagcagcagagagatttgaattgatttctgtttgtgtattacaaaagtacgtaatctctctctctctcgctgccggctttatagcaatgtgccaaaaagcctctctctctatctgtggacccagccaatctctactgagtccactcactcacagggaaacgcttgctgggctgacggagtcaaacgggccgctccttggtgcagcccaagttctcctggtctgaacctcttgcttaggggtggacaggaagctcgtggctcgttagctcgctcggctcgtgacaggctcggctcggctcggctcggctcgtttgagataacgagccagctcgagctggctcgcgagccgctcgcgagccttaacgagccagagcagatgaggcccaggcgcctagcccagcccaacagcccatcacctagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgccgacgccgccgcccccgcctctcctccccggcgctgacgccgccggccatggacgccgccgcccgcgccgctcctccccggcgccgccgcctcggctcctccccttgttcgctttctctcttgtccccaaagctcacgagcctaacgagctggctcgagctttcaaacgagccgagccgagctgggtttctagctcgttaggataacgagccgagccgagctagctcgttatcctaacgagccagaccgagccgagccagctcgacatccacccctactcttgctatccgaggtgttgccgccgccgtgacaaacacgcgggtgacccgacggctgacaggatgggggtgcggcgaggtcggcggatcccgtcgattcggcggcggcgcaggtgggcgcggcgctgtgcggcgaggtcggcggctcccgtcgacttggcggcggcgcagtggagatgctgccgtcggcgggtgagcagggtagggggaagccggaggaatggatgcgggatggaagggccgcgatgggtggggatgctggcggagggagcggtcggcgatagagggatctgcggggcggaggatgctagggtttggagtcggcgcgacgcggggagagggaggggcagaatgcggaggtggacgacggtggactcgatatcatgaaaggacggcgatgatggcggatgcggtttctgtgggatggggaatacggtgattccgcaagaggtgtgagtggtgcgcggtgggaggtgggagagctctggttcgtttgatctgacgcgttggatgatctggaccgttggatttgatgaatgagtaatgtaggtgtaagagtgagttgatgaattatagggtagataggtgtaagagtgagttgatgaattatagggtagatacggctgtccatgcgaagaaggatcatcctgttagccgtccagcagcggtgtttcaattaatgccaatcaaagaaagagcttgcatttgattggcccaccgagttggttcgtgcaaaggaaggacggctgcccgacaaagaaggcatgaaacgccgtcgccaacaatgaccatagttgatgcacggaacatggaagtaattccttcgtttctcttcaatccttttttctatatatagaaagtaaccaaacaaagccgtaagataagagtagaacgagtgctccctgcacctgagccggactcctctggcggtcactgcactctatctggcacgtcgctgtaatctatcaggcactagtttagctctagttgttactagttctgttgtaacaactcctagcttctaccattgacaaacaacctgtaagtacaacactaatgccaatattgaccgatactagcttatgtgggtgctacctttttcactagaaagaaaaatttcaaaaatcacataaatatgagttttggacatattgaagtgggttgggtgtgttcgttttgaaaaatctctttgtgactcgtgcggctaacttttgtcatttaatgtcaatattgaccgatattagcacacacatgggtgcgatgtttttcaccggaacgaaaaagttcaaaaaccaccaaaacatgaattatcattgttgctttcactctttcatggtagagcggtgcttccgtccagcacgtaataccgacgggtgttgaatcaaatccatccgtccatcgtgagggggtaggatcgggaaacgtcacgagcccatcgcgcagggcccaatctccttggcgctttttttctccctcacccaacaatccccatccctcagcgcaggatcaatgatgccatcagcacggcagtccgagtcccttatcccccctcgatggctccagcaagtacctgccctgctgctctccctcccttggtgcatgagcaatggagctgccgtcggcactgcctaggcccctaaccagtttagggtttcctcccaagtggtgctcaagatgtatgtgattttctagcacacaaaatactcagaaatcataccaaatctcatagtagtttgtttgattttagatgatttatgagtattttgtgtgtctttattttgatagatttggtatgggtgatgaaatgtgagacaacttagaagaacaagaggagtacaaaacgatgatttctatcagatgtatgagacttatgaagtgaatttaatttattttcagcaaagtagaagacgatgtatgagacctaagaagtgtttctttgcaccggtggaagttgaatcaggagttctttgcacttgtggaagtagaattttaatgtttgatttccatgtgtgggaagttgtgttgttggacagtcaattatatattgtttgcctctatcagactatgagacttatgagcgtgtgtcctgtagacacttatgctggtgcagtgcttttgtatggtctagttattttggaatgaactactcaatcaaccatgcttcttgtattgaatctgtgaaaagagcacaagcttatgatggacacattttgttgttgaatgggaaaatttgagcttattttggacagagcatgatcttctgtcatctttatgtctgtttgtgtgtttgttctggaaaatttggatatgtgcacctgaacttgtttgaaggttaacaaatttgttttctagcgaacctagaacctatcttgcaaggcttatggtaccacatagtacaatcaggcttggccctgaggagcatgagatgagcagccagcagccgaaatcaacaaacttgtctcctgttgcgatggcaactttatgcatcgagttaaaaatggatattgatattgtaagttggggaatatattgtgagttagcatggctaaatgatatctagaaataagattccaatatgattcaaataatttcatgagaaggagcacaactagaactattgttccaatgacccaattaattctaaaccaatttctaatatcatcagtctcctttttctgcttggacaacttcttctaaaagacggtcgtctttcagccatttcctgctttagcttcgtcctctcttgttccgcctttgttttttcaacataacaggtccactcaatacgtagcctacccaattggcacgttccagcaagtgccaaaactgctcgaacgtcttttatactcttggatgccactctggatctactcaaatcagagtgtcgcattactcatcctcctaaaaaaacaggactgttatattgacatgcatgactaaaataaaagaaaatttacctatactaaattaccactaaaaatgacatatgcttggaatgaaacttcaacgaaaaacttatgtaacaccactgcacatcggcaatctcctcgaccaccggcatcgctgcaacagcaaacggagagtcctacagcttcggaggacaactggagcaccgccactacaccgccatggctgccaagtcgccaacgccccagccacagcattgacgactccaggaccacctcgccgctacagctgccaaagtccccgccgtcgccgccacatcgtcggctccgacgactccacgaccacctcgacaccatgcccagtagcacctcgctccatgaccacctcgtcactgcaaccgccaaagcccctgccgctgccgccatatcgccggctctgacgactccatgaccacctcgacaccacacaccgcagccgccatggtcacccacgcaccagctgccgctgccgccaacaccacctcgtcatcacggtcgctgccacgttcgcccatggaccaaccatcgccgttaccactcatcggacagaggggattcaagtagtacctacaaatatagtattatctttccacccctctcaacactgtcggtaccacctcatgggcaaatatgtatctggcggtaccgcaccttgccaattgtccgattggacagaatgaagggctgagatttggtaccgggctacccgctgaacagaagaaaatgtcttcatggtatgagatacccactgatccagctatcatctgctcttccaccgcggcagatcctgccatggctgaccccaaacctactcccgctttcgcactcatttctaacatcaaaaaccacatcccccctcacactccaactctatacatggtgtaaacttctctttgttcttggccgtttcaatctcaaggcacacatcgatggctcacccaaaccagccaacgctcaattacaaacaaaaggctgtgggtgtcgtagcatgaagaaaaataccacggaagtctttaggaatcagctgctatgttacattaattcatacatggaaccagtaaatttcaacagttccaccttctcctccttagtcagcaggccctttgtaaagggctgctctacttcgtgcagcttcgggccgtccgatatgctcacgacctgcatggatgaaagagcgcgcgatccaccgatggatgacagctccgagcacgacttgagaatcaggcatttgacccgaagatttgtgcctagcggaatggactccatgttgttacaggcacgaaaatgcaggatgtcgagagaggtgaggctctgtaggtaggccgggaaatcaagcttacggcaattcacaatagagagtcgtcggagtgagggtggcaaaaccattccttgcggacacaccaatttgcagcgccatattttcatctcttgtaggtgttcgaatcccacgaaactatcgacatgtattgacagtcctagatggctggatttgttgatctctgtgcactcgatggatggcaagtattccggggacaagcacccatcaagattctgtagctgataacagttgacaagacgtatagtagtgagtcctctaaggcatgcagtgcagttgctgctactgctgcttgtatgcttcgtcttttcaccaccagttgaaccaccaagaattgttactgcttccatccgtaaatttgcttctagcattagccgttcgagagaaggtaacgatgcgatcgatagatttttcaagccatcacacttggaaagctccagactccttaaattcaacaggcattctggtctaaaccaactaggagaaaagctatcacccccaaaaccttggactttaaggcgtacaattcttggtggaggacgcaaggcttcgaccactccattctcactgctcttccctatctctttgccatgccctcgccagagtagaactagttcctggaggtattgtttttcaacaaggctagcctcagcggcttctttatcattcttaacattacaaataaactgatagttagcgttccactgagctgattcatgcccctcagctcaccaatttttcgcccatccccttttccaactctaaaatgttttaagttccatagacgagacaaatttccaagcctacttatctctgataactttggagagcaactcactggcaatgctagacgacgcaagttgattagctttatgacatccagactaattgctttcagactagaacgacttgcatcaacaacctgtaggctgtaaaggctacagaatttcttcggcaattcttgtacaccgctacgagaaatatcaagataacggagactgttcaactcgcctatgctctcaggtagcttgaccagcttacaaccctttaggctcaaatataggatgttggagagctgattgaaccaggtaatctcaacattgagtttgattccaaacctaagtgaatgcaatttgttcaaatcctgaatgcctctcattccgttcttcagggattcatcagccaccttcacggacatatggcgaactacatgtagcattctcctctcattccgagacctcaaatcttgcatcaagaggcattcatccacataaacggattgtgccatatcatggatcaagtcatgcattacatatctagtttgatcagggtacatgggatcggtttgaaaaagaaacctgctcctcaaatcatccaaatacctaattcccatatcttcaagacgcatgattcctcctgacgcaacaaagccctcggccacccaaatgtcaacgatctcatctcgttcaaagctataatcttttggaaacatggagcaaaatgcaaagcatctcttaagttcttgtgggagatataagtagctcagctggagggccggtaatatctcattgtctcgatgtggcagctcccacaattcactgttctgaacagtctcccaatgttgcacagtcagcttcatattcaacaaacgtccagtagttttggcaactaaaggagacccacataacctagaggcaatgctccgaccaatatcttgtaattgaggatatgattctggacactcttctccgaatgcacacttgctaaagaactcccaaaatatatctctatccaagccttcgagttggataggcttacaattgttggtggcaacacgatcaacaacagttgtaaatcttgtagttactaagatcatactgcctttaggtccgttcttgaatggtgtataaaatgactcccactcgtcaatagcttcttgccaaatgtcatccaacaccaaaaggaacttttgcctctccagctgctccatcaattccacctgaagagcatctaaaccgcaaagtggcttatactcttccctattgaaagactcaatgatctcgtttgttactcttttcttgtcaaagaggtctgaaacacagacccataccctcctattgccaaagtgagcttgcacccttggatcattgtagatgaactgagccagggtagtcttccccaccccaccaatgccaaaaatcggcaagacgggaacattgtcgatgcatttggcctcagcaagtctgggtcttgccctagtatctcttttcagttgcttcgctctggatgatgctgatgtgttgccaatgaccggggctgctgctctctttcctttagcccgtgctcgtgcaacaccacttctggtgatcagtggcacacccagtaactcaatcacatgatctcgttgactgtcacatccaatcatcgaacacacacccagcttctcaatcactagatctcgttctttgtcacggccaaacacctgagacacacatatgactgaacttgtctctggcatgtgttgaactgcctcgatactaacacccactgaattaagcactccttctaaatcagccacagccttgtcgagcttctctcgggcctcctttatttttgttttgctaccacggatcaaaatttttgcaagatttagaatggaagaatagcgtttaccgaaccagttccggtcagcatcctccatcttttgccgcagcgcctgatcatcggactcgcggagaagatcctcggcgtcgtaggtggtgtccttgagctgtgacagaaggagcgccatgtccttgttcttgaacctgccccactcgccgcgattgatgaggaagcgagccttgggcaaggtggcctggaggcgggacagttcattgctcagctgggtcgcttcatggatgttgatcccggttgagatgatcgtttccacggcgtccatcgctgctgccgtagtcctcgattacttctccggatttgatcttgccctcgctacttcgatgagatcgaacgagcgtatcgattgagatcacaaggagattatggggtggagaagtaggagcaactaggtcaagtcaatggacctcctcggttatggacttcctgtagaatccaccaactccacaaggtgacgtggccaccttgacagccacgagctctccctaacaccccgaattaattaatcaatcaattaataaatatacttaacactaacacagctaacgaccccactaatctctccctctccctctcgtcgaaattccaattccactcgcctcgcctcgcctcccccaccttccgattcgctcgcgtattatattgcgccgtctcgagacttctagatccttccagtggaacccgccgccgcttctggatccttctcctgcccctcattttaagcgccacctcccccgcccccccacgccaccgaccgagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttcactttccattgcagaatatttcatttacatataaaacgattcattcctgacctgaacgtatttatctttacacttttgtttcatacagttcttacatgattttgctattgcctgaaaaaatataattgacttgaaaaagcattagcttcgttattgacctgtgatttaactctttgcagaatcaatgggtcatcatactatgactttcttgcaagttgtgcagttgttgcctcaagcttgctgcctccgtctgtcagaactgcaactaagctaggaagttcaatcagttttttttttttttatcttgaacagtaaattcaatgttgacaattaatgtagtaatgatttcttaaggaatgaatactaattttgtgttcatggggatcgatagtcttttttaaacatcatgtttaaacacgatcattactggtgctttgagtagagcctaatactgcattactatttattgcttgctgttatagtttgttacgtaccatgtccattccttaaggaagctaacaatagatctatcttttgtattttcctcttcgtgacacctttttcaattggatacgtgcagtataaaactatcgaattcacattaagagtgcgatatattttgggatcttcattctccttatttgaatcatgatcttgttcacagtatatattctatgtaatatgagtatgactacatggaacacctactatgtcctcgataaattataagtagcttttgatcctcctaagatttttatcttatgaacacatgactaccattgactgttttcttgggaaaaaaattaacatgacccgcttgtttcaggtcagcttgtgacctgtattgtacgttagtattattgttttatggtgtaattgctagtagttatcaacccatgcacctgtacgggctagaaatttaaaacatgtttgcctagtgccgaataatttaggatttactaaatactaccacatcgtctggcagatgtactatttccactactatgccaaattttcacaagaattcgaactttcttattctcaaagccatgtgtgtgctaactgtcgaaacagaaccaagcgtagcatgcctatgaacatttaacttaggcatttaaatattatgctagatgttctggctggactgatcccccgatgatggtgttctgtgttttgtttgatcatggctgtgtgcaactgtgcatacatccacaactggttatgcacttttgatcgtcagcgtacggtggaagatgatgagacaggactggcaagtgaagtggtgaccaaatgatgtgaacgtcatttggcacctcagaggtacatcagaggtacatgtatgaatcttagtgttaattgttcaaacataggttttctcttcctccaagaggaattggtttattttgggatgaagggttttttttggccgcctcctcttcttcttcttttttttttttgagatgtctgtcatttggatcagtaatgttgaaacatgtgttatgtgaaaactctgtaaatagttttttgttgcacgcgtctattacttggtacagtaaatggtaatggatacattcggcccaaatatgtgtacattggtccaaaggtgcgcataagctggcccgattcggtctaatttctcgagtgggcttcgtgcggttcattcaaaattagttgtgggccaaatttccttgcagctactattgactgtaggccaaaatttggctcatatttgaccatctgttggcacgtggactaaaataggaatgagtctatttgcctgactaaaattggcatgataggaagggtgttaggtgcctccctcatctcttaactgcttattgaatcgtctccctcaatttcaaaaccgcgtataatgccttctcctcttcaaaaaccagagcggagagcagtttctgtggacgtagtaggttgatcacagttgacttgttaagtcagtaggtgcctaggtgggacatacatgccaatgactttctccttatatcatccttttgctcacctctccctgttctctctttcctctcttccctcttcctctctctcaccttccatcaacagtagacgtcgggagggtggtgacaatggtgagccagacctaaggaaggcggtggtagaggcgagccggagccgtgcgttgttaggggtttgtatcgggctaggcaactggctgcgtcgcatgataggaagggtgttaggtggctactggcaaaggacttgcagtgagtgttgctcggtggtcaagcgtgaaggtgagcggctgtccgcaccctcctcacttgtgcaggaagccgaggaggcacgagggcatgctgcaatttggttttctgtagacacgccaaatggatgatgtggcggcggaggagcttggaggtggcgacgcaatagacaatggtgacgacgtccgaccacgccacgatccccagcaacacgtccatcgaaatctgaatctaatccgtggacgcatggtggtgcttccatggtggcatcttcatatcaccttgctatcatccatgtcatgcctgctcgacctcgacctattgtcgtgcaattaggacagtggcgactacgcgctgcaccacgtcgcggacacgctgcaccgattcgcctccgacgagcatgaccaaagatgagtggactcaatgggaggaggcaacccattggaaagctcaactgcttcgggggaccgtcttcctcgtctttggctcaccaccactgctgccctccccagatctagctcgccaccgccgttgccctcctaggctctaccccttctggaaggtgaaagagaggaagagggagtcaatttgcacaggcttccgaagatggagaagcgttatatctggttttttggttgagaattgtgattcaattaggatcaatagaatgagagaggcaaaatagacttgttccatgaaaatatcattccatcttaaatgtttagatggcctattttctggctaagatcaagcagttgtgggcttaatctcacgctgttacaaataattgtgggctttaatttcttaattcctccccagcgtacatatgagaatttattaattatttgtagttattttgatggtcgctttagtagcaagtggagattacgggtgaggctcaaaggcacctgcatgcgctggatattctttctggttggtcgtttatctctgtatacgatgagaaaatccttttttaaagcaaattgtatgggcgttacatgaacttactatatggatgcaatcatgtacataaatttgcaaagcatgaatttgatagtgcgtatgacccaaaaccaaaattgcacatcataactaattttgataggtttgacacagattagaagaacacaacataggcccgttcttgtgtacgatgaactaactcaaagaacatactctatctaaattcattaacatcaatataaatatgggaaatgctagaatgacttacattgtgaaacggaggaagtaacatttttccctcttcaaaaaccccccacaaagtcacaatgtttttggctgcctctgattctctcctttttctggaggtctggacaaatacaacaatgacaaactagggattctcttgagctgaacaaaagcaagagtcgtgttacttgtgtaatcctgtaacaacacccatcttgtaagttgtaaatttagatgcgcattagcacgagggaatcccaggtattttggccttataggattgatgaaattttagaaactatgagtttttgttatactacgaaatcccgatgagtaaattctttatttttgcccccaataccaacttgttttaggtacttcaaaaacatggcaaaacacggataaattatgttctttgttttatttggtacacgcagcccttgcaactagtttttttccacctcatgattgcttagtctttctaaaccaaaaagaggggaaaaaaagaaaatttgctgtagcatgtgatttatctcccatatcctgtgccacaaggatatttgccacccatccttcttaaaaagtctaaaacttgtaaccgtctaacagtgcagtcctagttctatttcttcaaaaacctcatacccataccccttttctttagcttacatgatatagattatcgcagaaacacactttccaagctcctaaattgtacgattcttttagaaaaacttatcctttggcatttcttagagaacttttttaaatcagcattttaacttgctttctaatatttaattctctccttaaataattatcataaactcggtttcatccatcatctatcaacaaagaaaaaacaaaaagagaccatactactcccatatcagcaatcaactcaaggccatggtccatactactaccaagcagtccaaaaggattgcaatctgctgcaagttgcagctagctagctaactagctaggaacgatatgaacaatcagcaggttttttcttcttttaaaaggaaggtaacagcttctcgtatattgatagagtaggaatcatcagggttggtgagccggcagcacacagacgacgacccggccatttcttcaacgcaaattgtactcactcgctactactcgtagcgaaatagcgatgcagtggccgctttcacgacagctcaagccgtgtgctgctagctttggacctcggctcgttcagggcacgcacacatctgcgtcaaccttacctccttttatctgcttgctgaaaaggcaggagttattttctctgcttgttactgcttctattccaaaatataaaagtctaaaatcatataagacattttatagaaaatacatattcagatttatagtaatagaaaatatttcatccgattctaagtctttatattttcggacggaaggagtattaatattccatccgtttcatattataagtcattttgatttttttctagtcaattttctttatatttgactaagattttatctataacactaaattagtaacattgaatatattattgtgatatgtttggcttttttattgaaagtgctactatatttttctataaatttaatcaactttaaaagtttgattagaaaaaaatcacaacaacttaatataaaatagagcgactatatgcacttgtcgccttctgcatacgttgtctgaaaacgagcaaggagaggtgaaatactgaaaatgcatatagtccttttctgcttcctgccatgatgggagcatatatgatgctttaatatgttccctatttggttattaggatttaggagtagttttttgaatttaatttgaagtaactactgtgtatcttaattttgcacttatccacattgcaaacaggacatatatatatagtgtattgctataatctagcatatgtttcctaatctgaatttaagaaatctctagatatacgtcatcgattagtatattaagttcggctctaatctctagctacctgctcttgtaattgtatttttttggctatggaccaaaccatgcatgataactttgaatggtggtacctaccttatcttgacaagatgagtgatgagttggaactaaaaacagattctaccggctttctcactgaccaattgtatgctgccagccactcttctactgagatacggtggttcatataattttctgcaaccgaagccgtttaaatatcagaattgtttttaaacatctagattttatgaataaaaaatcatattagtagttccccatataactttatcgggggtatttttacattctgaatgtaacggaaggtatcatattgtttttaagtaaaacttggtaactccaagtattaggtatttcaagataagaaaatttttagaataaaatttatatatattgaggtactttctcaagtacaataaactttttttttgtttgccggggtttgcaactattttactaccgaaattaacggtcaaatttgcaagtcgaagaccgtgtcaacatataaaatgacatgttgcagtggccacattgccaggggcgtctttctttcagcgtaattgaagctgtcacttttgctttagcttctgggcaagttgcaatcagatcattaccatctcttccttttggaaccttggatcataatcatctgacatctctgactgatgtatatatgctgaaagaacagtaagtgctaagctagcgcttcactcgctgccttcaccaaaagtgagcatgaaacttcctagcttccgttcacaactttacatagatgttcctaataatgtcacacagagttagaatataggactgtctcgaatcttcctcaagtaccaatttagaaatgcagagacatttgctggctacctgctctaggagataagaaccatatattcttagtagcacacttattcggtttttacaaaccttttcatctccaaaatggtggagtacacctatgtcggtctcgaaacggttgcgtgcatcacatgatgtagaggctgggatatataaatattttgttgtctagaaaaagtgccggtcgcgaaacgttgaatttgatcttgctcttgacttctggcagtaacattttctgcagctaaagattttgacattcatgtcaacaacttcattttccattttttttctttttctcccggaatcatctcaacaacttcaatagttcatatgccacactctgacatcatatcacacaaatgcaggtgcacttacagaaaaggcaggcaggcactgaaacctgaggctgacctcacaacaaattcgtaggagtcggcaggtataaatctactgtttggtcccattacccaaatcaacatatgtttttccttgcaatcagagcattttacaagctccttgctaaggtactataaatcatttggtactgaatatttagaggatgatttgtaggttgggattgttcttggtagggttgtttcactttgatgtaattagctgagttcaataaatctttcattatagaagagagagagcgcgcatatgattcttatgataacttcacagtactttgaatattacattcattcttctttttttcgacaatgaaaatcaatccagcctctacataaagtgataaagatgtatctggtatctttggcatttgacactatacaaatcttgtttggttgagaagtatgaagtcaaaaccataggtccatagctaccgacatactcgacgttcaggccatgagcagattgctgttctacctgtctcaactctgaagaaggtgtcaacatccattaacagccaaagtcttctgaataaataactgcaattgtcgccttccaattacgcaagcctgaaaacaggcaacgagacagcgttttcttccttgaatgattgagtcatgttgtcttgtatctcaacaattctccaatgcatgtaggacgaacaaaaccttgtttatggttacccaatttcatttaaaaacatattcaggcactgcactctgaaaaaaataagtctatagaccactgcatctctgaatgattgttctctttttgtttgtttcttttttgacacagatggataacagcagcaatgtagcatccttggttatctacagttgcaaactactgacatcgatgctggtttgagtagtcccatagaattcttcagcaatctcagtcagttcctgtaatactactctagcagagaagcatgtaccaggaataattccttgactgacaaagatacagtgatactagattactactagtattagattacatcaaaatcacacattttctagtgcggttaaccttaagggaggcaattagactccatgatgcaaatcacgcaggacctcaaataatgcactgggaaaagaggggaaaagcagacactgaaactgaaacaaaaactgaaactgactgcacaacaacgattctgaatcagcaggcaggtagctaccgcttggtgccactgccagacacccaaaaaatcagcacaaactttttttcaaccaacttatttttattttcttgaatcgaatgtgcagatcaaaaatcttcagaacactttttatgatctgctgagctttattaggtgtgagagaggtttaagcgtcagcatttgagtgactttttttttggtgtgcttttgttgtgttcatgcgtctcctaatcgagttgattctggaacactcaaaggggagaggcaacgacggtgaaaccgacgctgcagccgccatggatacatgcttgcagattgcagctatcctctaccttaagacatgcgactttaagtcactggtacttacattgcagattagcatcaatatgaacgtggaaaatgctagaatgacttgcattgtgaaacggaaggagtatgtgggttcatagcaaagagaacatatatgtgtgtcatatgatttactctcaacgtaccaaaatataagagatttgggctgaatgggacatatcctaatactacaaatctggacaggttcttagtccacattcataatattagaatgtgtcacatccgactaaaatactttatattttggaacagagggtattttggatcagagggagtaagttagagaatctcaatttggaaatgggcagtggatcgttcaaacaaaaaaagagagatgggcagtggagtttgatgctgaatcgtcactgtctcggtatcttttctctggtggttgtatcctaccgttttgtcagcaggcatcctgtccgaggatcttatagttcagctagcatcgtgtttgtgcgttgcaactttcggatattgtttagacaaaatgtactgcaggatctaaataaatgcactataggatctcaatttggagtgcaaataattattcttagataaaaaatgtgcaatgatgtatgcaaggttgttaaaatcgcagattctaaatcggatcggaaagcttacgataggatcttaactattgaatcgtaaaatcatgtagattctattgactagaatcatagaaacaatcctacatggctacaatcgagttggatcgtaaaatcatagtcacacaataaaatcaagattttgacaaccataaatgcacgagattcttaccactgatagtgagtactcccctgtcccaaaaaaagacaaaccctgggttttcgtgtcaacgtttgactgtccgtattatatgaaatttttttataataagtattttcattgttgttagatgataaaacatgattaatactttatgcgtgacttatctttttaatttttttataattttttcaaataagacggacggtcaaacgttggacacggaaaccagggtttatcttttttttttgggacggagggagtaaaactgactttgacatttattggtcacacactttgtttaactcaactaaaggctgagtttggttgtttactttcccaactcatttctctcattttccgtgtatacgttttttcaaactgtaaacgatgtatttttttaaaaaaaatatcatattaatcttttgaaaaaatagctaatacttatttaattaggtgctaataagtcactccgttttacttaccggaaattagttttcaacccataaaaaaacagagactaaggcgggtcaagagatacccacagagtaacacatgcccgttactaaattatcagtaatttagtgatatacaaaaccatggattgacacggctaaaaaaattgcttccgactgcatggtcaggcgactccttaccgtcagcagtaaaaaaatgatcgatagatcaggtgtattccccaaatatttttatcaacttatgaaaaggtagatgtataaaaacggccaaaagcctaaaaggtgctgtgtcatagttattagacgacggtcaatagattatgtggatcatggatgaaattaaactggagaactacacaatggtagctaggacaagagctagcagctaagaacgccgtcagctaagcctatagctaactatacacatatccgtcagatagagcaactacaaattttagtaaattaacaatgatatgtgttgattgcatcttgcttaggatgcaaatctcaggcaaacgcgctagctaggcggctatagagacctctacaaaaagcttatttagcttagttatcttagaaactaaaggttagcttttaattatttgcattggcttcttctgctctaccgatgtcatcaaggaagaccatctaatcatgcaatcaagcccgttttggattatgcgttcaactcgctttaggtgactagtttttaataaaaggaataacaaaggaatccaatatagcaaacttttgttgaatttctctctgacattgactctcaacccgaaataatgtacgattacaagccgattgattaacaattagaacaaaatttccgccttctcgaaaaaaaattagaacatttgaaatcctcggtggatcccgggaggatgttctataccatccaaaaaaaaaaaagaatgttttttcattttaacaaaaaaaattcaaatttatcaaaatttgtccaaaacttgaaaaatattagtagatttctgaatccccccctctccctaaaatttccgaaatttcgacgatgtattctgaaataatcctggatatattcaatgcatcacaaatccacagccacgcacagggctatgcatatatgctcgccaataaaatggacatattatatatcaattccaccatttgtgaataaattacatgcttaaaactgacaaaacgccatcatcacgcaaccctgtgctaccaactctcatgccacaaacccaattacggccaagatacaagccgccacgagacacaaatgataaggacaggcagagacatcataataataagagaacaacgagctagtcatgagagagtagcaagtttttccgtgtcatcttaatttggagaaagaaaaatgctttttttcatgtcgtaattttccaattaaattctgcttgaagagagctcatgtgtccatatataatgtgaaagggaggaaaaaaaagagatagatgaaaaagacggaaaagaatttcaaagaaaatgaaaatgccatccatataatgttattcacaaaaagtcagatcgaattgacagcaaattaatttccagaaaacttgaatatcaaatcatttatgggcttgtttggtttagtgccgtaccaaaacattggtaatgctaaaacctacgtatgttttggtactaccaataatttagtagggtagaatttttattgatgtgtttggattgataccaattgatagccaaattttatgttatggataaattaagcataggcattaccattcatttggcttcaaaccaaacaatcatatttactatttaaactaccaaaatattaacatggcacattttggcatcaatccaaagtggccctatctgtccttttacataaagcaagacaactcaaatagcgctacagtacttttttttaaataaagagattacctccagcttttatagcatttattcagtacacatgccatttagttttcttgtaggtgtgtggttgtttaccgttttggttggaaagtacttgcgttgtgttcttgcgagaatgcaattgtaaagatgatggcaattatatcgtgcattttatggtcatagctggtacaaattgagagtactactaattaattgttgaaaaaaaatgacaaacggggtataatagagacaaagatggtggaatataacaaatactaatttatttgatgggaataagaggagcaggaggcaagacggccagcctatattcattcaaactcaagtggcataataacagcaaaaccaaattccagcacacaacaaatgtgggacaaaatagggcaggagaaggtacatgcatcatgcatggcaaacaaaacttaaatttgcttttaagaatggagaattaatttacacctccggactttgtacatatagccagaaaacaataataaaaaaaagtatatgatggatgatcacaagtactcctaggaaacaaagctaactatctaataaatcggtgaacatcttaatcctaggggtggggggagctcatttagctggctcagtggaacagtttaaaattgccctgattgatttggataaaaattattcaattttgaatgaaagtagtttttacaatggctctccttagctcgttaagaataaatatatgctgaactgataaggtaaaatataataaattatataaaagtaatttgaagaaagctcgataaaaaagccgaccaagcttttttcccccactgatcatgacagtcattgagaaaaacaaacaacacatgctagctcataacccatataagaaaaaaaaaaccctctaataagcgatcggactatatgcttctctaactataaatacatgacaattatcaatcttaacaaattcaatacatgtattttttttcagagaatgcgagaagattaccttataaattgacgtatctttaaaccaacgttaagaaaagaacaaattccattttaaaaatccgggtcaagcattttattatgtccctcagaacaactcaccagacacgtcaatccacattacagctgggtggtgaaaggttggaaggcaataaaaaagtttcattttcaaagggaccaaatatattactaggtgatgtgtaggtgtgtacacccccaaaccaatcacccaccggttgatcaccacaccagcagcaaacccagcattccataaccaaagtgtgtggccagatatcagatgccaccacccttggctacaaactgcaaccggccacgaaacgacaacgaccagcaatcaccaaaccccccacagcgacacccatgctgcatacgtggacgacccagcacgaatctccgcgctaaatattgttttaaaataattgtcttgattttttttaataatgatgaaaactgattcatatctgtggtatataaaagacacagccgataagttataaaaatttagggggaggggggggattaatgtcatgggataaattcacccatcccttcaaatgatagccagctgaaatataaaaaaaatgatcatatagtaaattctataatgaaagtctgaaagtattatgccatccaaaatagaataaattatttccaacaactgattccaaaattgtgcgacgtagtatcttactccttttgtgaaaacattaaacaccaaaggtggatcaaactagtagaagatgtgaagatgacatgtatttggctggacaatttttcgttttcaccactaaaaatttcttacatggttgtattacgataaacaaaggttcaagcttttataatttgagaataatattgttttgaatatttgaaaaccttgtttagaaaaataagtggcatcagtctaaaaaatacgagtggctaaaatctaaagataaatagtttcacttattatttatttcagtaaaagaaagtttcccttatataaaaagggatgtgaagtatttgagtttttttttgcgccaaaaagtatagcaccacttcgcaatacttttatatatttaagatgcaatataatttggtaatatgcttgtctaaaatatttgaaaatatttttttttataaaaatccgactggttaaaattttgaagagggatagtttcacctattctccagctaaaagaaatactccctccgtttcaggttacaagacgttttgattttggtcaaatttaaactaatctaagtttgactaattttgtaaaaaaaatagtaatatttttaacccaagacaaatatattatgaaaatttattcaattatagatttaatgaaactatgctagtgttataaatattactaattttttctacaaagttagttaaatttagagtagtttgactttggtcaaagttaaaacatcttccaatctaaaagggattgagtagtatatatatatcacttatatttagaaacggagttaggagtatttctttgagtatttttctaccttttgaggggcatccctatcgcagaagtcaaaccgggcggggcccattcgcgaaaaaaagcccaaacccgcgcccgtaaatataccaaatccacccccctcatcctcgccgccgcgactcccaaacctttcgatcatctcttcgacttcgtcggagtcggagtccgagtccaccgcctcgccggagatggagcacgcctcctcgccgcgcgcccatggcgtggtggtgatcgcggtcgccccggaccacgacgacgacagcggcaagaaggggtggcgtctcgccgccgccgccgcccccgccttcggggacgaggcggggttcggggtggaggaagaggaggaggagggggaggaggaggaggaggaggtgaggtggagggagcggcgggtggcgtcgctgtggcgcgtggccggggcgctgctggtggtcgcggcgctcgcggtggcggggcactactgcctgtaccacgacccggcggcgttctcgcgggaggaggggaggtcgtcgttcttgctgccgctgtacccgaagtccagcgggggcggcgcggcgggggagtcggccggtagcgtcaagccggacggcgccggcgcggaggcgagggagaattcgtcggcgctgctcccgatcagaggcaatgtgttccccgacgggtgcgtgcagccggtgcaagaactcgattccatttcgtatgaaacagtagagttttgatcctttctctcttccgaagaacaaattactggagttctttttcgcgatcggatgctggttggtcatgattcctttttattgggcggggttattcatctattcttgctttaggtagaatttcggattcttttgagtttgatttgaggtggatttttttttggtttaacctgcttgggctttggaaaaggtagaactacggtgactcgagtttcttggaaaaagttgatggtttgatttattacctgttcttttacaacaatgatttcacatgaaacagttgaaatttttaaataaatttggaaacattcctgctttcctacatctctgtcctgtcactttgattgggatgttttgactgtcatatcaaattgcatataagtcttgactatacaaattgtctgtttatactagtatttatttgtgattagtttaagttgaagtaggaaggcttctaatgtgctggctcatgggtcaacgtttgatgttcatattcttctttctctttgtatgatatgtttaatctttggcagttcatgttcattgatgttacctaccagaatgcagtgaattgcaaatactaacatggaattggtgcccttctgggtattctgcttttaatctgcaggcaatattacacttctatgtacattgggaatcctccaagaccttattttcttgatgttgataccggaagcgacttgacatggatacagtgtgatgcaccctgcacaaactgtgcaaaggtatgctccaaattcaatcactttctttttttttgtcctgtttttaatttggctttttagctttattagaatgagtttaagttagcatggatatcttatttcaccatcttattatgagtctaaatttcccaatttcattgtgtgtttgtgtaatgatcatccaacgttgttgcagggacctcatcctctgtataagcctgagaaaccaaatgtggttcctccgagagattcatattgtcaagaactgcagggcaaccagaactatggtgacactagcaagcaatgtgactatgagatcacttatgccgatcggagctcctctatgggaatccttgcaagggacaacatgcaactgatcactgcagacggtgaaagggaaaatttggacttcgtatttgggtatgacttgatttccgataactaattctctgaaatttgtgaagatgggatgctcttttctgaatggtaaccatctgccatctgtgtaccatctgcaggtgtggatatgatcagcaaggaaatcttttgtcgtcgccagcaaacactgatgggatcctgggcttgagcaatgcagcaataagccttcctacccagctagccagccaagggataatttccaatgtttttggccattgcatcgcggcagatcccagcaatggtggatatatgtttcttggtgacgattacgttcctagatggggaatgacatggatgcctatcagaaatggtccagagtaagtcccatccttttgtttgtgaaagtttcattacttttcccttggatactatgcatcatttttactagatataatatgctctgtctgcaaaagatcttgagaaatcctaaccaactcttgtcaccctcaagactgaaagtacaggggaaattttgcccaactgctctttgatataatatttttaactttttgcagttttgcactgatgctagatatagatttattttttttacactagtaatagtaatcgcattgatgattcgatcatacttccaagaaatgtcatgaaacttatcacaaaaaaaaaaaagaaatgtcatgaaactggcaaaatgctctgcatattatcactcttataattcacctaatctttttgctgtaaaagatggggcgagcctatatgttcagatgtcagaaaattagcataagttccagcaaaaataaagaaatgatgccatacgaggctggtatttccttttagcattgatatgatctatgtaactgaaacttgtcccttttcattctgtcaggaacctatacagcacagaagtccagaaagtgaactatggagatcagcagcttaatgtgcgacgaaaggcagggaagttaactcaagtgatatttgacagtgggagctcatatacgtatttaccacacgacgactacacaaacctgattgcttcagtgagtgcctctattaattcccttacatatggagccagttcaatctcatcttactcatgtttacttgcaatttttaacagcttaaaagtctctctccaagccttttacaagatgagtcggatcgaacactaccgttctgcatgaaacccaattttccagtgaggtaacgtgttgaaactatacgtccaaaataaaataagtgttgaaactactcatgtgctaaagagggcaaatttccaatgtccagttccagataaataaacacacagttcttaaacaatcctctgcatttttcaggtctatggatgatgtgaaacacctgttcaaacccttgagtctggtattcaaaaaaagattgttcatcttgccaaggacattcgttatcccccctgaggactacttaatcatcagtgtaagtttccatgatcaactttcatatttatcaaacgtccaattaaattttggacatctacagcaatattccctcgaaaattttcaacaaggagagcaaagccataccataagtcattcatcatgtttttctctggaatctttttacaggataagaacaatatctgcctaggagtgttggatggaacagagattggtcatgactcagcgatagtaatcggaggtatccatctgacattttcctttggtacatttctgttgccgaattcactcactgtagtttctaaacttgcatttgcttgctgtttattttttcagatgtttcccttcgaggaaagctagttgtatataacaatgatgagaagcagataggatgggttcagtcagactgtgccaagccacagaaacaaagtggatttcctttcctctttaaaagagtgctgcaaaatcaacttttgtaaatgtcacatagaaattgaaatttaccaccagctcgactgaccatgctttacttttggacgtgcaaattctacgttcaaagctgccataatcaatatcagtgaaagtaattaaacaggacatagggtaaaaagaagatgtaagtagagatagccagtaagtatgttgtacttagtaatttgtctcttctgtatacacaaagaagcagaattatgtatatgtattttgtagaatatatctcaaccacctgtaaagagtatatctcatccacttgtaagactaagtggtgaagcatatatcagtgaagccatggcatttctcgttcataactcctgtttatattgtgattgctatctgatggaatatagtgagaatggtacatagggagcataaaaaacacacaacaatatattgcaggcaacagcaaaacttagcaaagggcaatagagcaatcaataagtgaaaaaaaagatctcaactttgggcgaagtacaacaaaaggatgaagaggacttgtgaacacactataacttcctcagtggagtaggtcaagaaacactgtaccaaatgtacttgagcggcccatgcatctatagccaggagcaacaaattattagcaggttgattaaacacattagtagtacaatggccatttttaccatgatggatcactttagtggtagcaaactggagctccattcaaaaataaagctcgcaatattctcattgcatatacacaagtgtagaatttatacacatttcgtggttcgtaattcttaaacaaaactgtattgaaaaaaaaaaaagaataacaaggtttcagatgaaactagtagggtcatttgcgatgttaactcttgattccgacgaatttgcatattttatggagaaagccgccatcactagtactaactgcaacaggctcctgcacaggctctttgaagttagccttatcactcaactcttgaaatgcattaacaacgttctgtagtcgggcaacaaactcgattagaagggaggcaaatgtggccaaggacagagcacttgcactttcatatgtttttgtttcctcgtcttcaagtggcagatttggatggaatgatcttcgagcaggccaagacagtaacttgaaatctacagttgatgatgaatcatgtctgctcagaaatgaattaacagcaaagctttttgaatgatgcgctgtagtttgttcaacaattgtaggctccttcacttcgatcttgttttcctttcccataatgccagtgccattcagaacttctttgataccttcggcttgcttgctagtgtcccatctttcagtattcacaagaaggtacgacttctcatcaatccttttttgcaactgttcagcagccaagtggacttctgctagaatatctgaagagctcaatttggtcattgtcttgactttgtctccaagctcgcgcaacacttttgcaccttctataccaactctctgaatttctgcactaaaaacctttctgctttctggtggtgcctaagatcaaaatccgatatatatttttgtttataaaaataataaaagcagaagtctaaagtgtgctatagaaattttatgagaaaacctgaatttcggaaagaatacagccatgcaatgccatgactgcaaaggagcaatgcctcaatgccccaccaactttggtgaaattcctccaggggtacttcatcattttgtaagcgccatggggtggctcccatatagcaaaacccaactgcaaacagataagaatgtgatcaattgaccactcaagaaatctaagtagaactcttaaatttagagcaagatcaaaccagagtttcctcttgtgctgatgcctcaactgctgccctatagccactatatagaggatcatcagatgcttgatatacaagtattttcgaaggaatcctttcatactccatgcatttcaaatatccatcaacgcaacctagaatgaacagccaaaaacggtatcaagcatacaatacttgatatcataatttggcaagaaatgcataaacatcagatgtatctatgctctatagcaattgcagtgctagcacaaagccacaaacaatattcttttaccacgcatttcaacataaagtcaaataacgcaacatggaaaaaaaatactatagatggttggtttgcggggttggagtttcataccttccaaggattttgcaacaccaatgaagttttttgcaaccaaattgtgcaaatcttgtccagcccatattgggtaaatacctacattgattcctagactgacagcagcaccaatagcaattaatataaatctactcacagccgtatcagtgaacttccctgtgttgtacccagaaaccatgacatagcagaatgtcaacaagaatacgcggaacccatactcataggccttcatttttggatgcagtttcgtcaaggttgtgaaaaaagctaacaatgaaaaacatcaaagcaacatactacaagttagatatactcacaagtcaacactacagccagcaccaggaaatgatagacaacagccacaggcaacagatgcaatactcaccaacaataaatatgctaattataagaattacttcctccagctttcccaggtgtttggacaattcggcgactgctagcgcaagccctccagcggtaagggtacccaatcccctattaaaacctttgctaaatgttgcacctgtattaacacgaaccacattattcaagggtgacaatttatttttgagtaaattgcactttgagccatgttttagcgccagagtttcagtttggaccaccccttaattcatgttttcgctttggactaaataattcccttccattgcatattggactacccccactgtttatctcttccatcccttcttgctcctccctgaactccggccagccaatacccaaagacgctgcacgcgctcgagctctgccagccctgagtggcttgagctcagcatccatgtgagcacgaagtgtgcacggaggaacgtacaaattatgatacaaacacaaagaaaaaactatgatgcaagctcaagcctctgattgggtgcttgccaaagaatgcatgccaatccaaagaaaatcatgcaaataacccatcacaatcagacctcaagagtcatataatcgaggctaagacgctactcaatgaaacagctcaatctcaaagcaactatcttgccaaaccatcaccctctcagaaaggcactccttccttagcgtgttgcaaagcgtactggtgctcggcaattgactcgagcgcagcgcaacgccggtggagcttgagcatcagaggtgccaacggatggagctcgtgccaccctagctgtgggtggagcttgagctcaagctaggccacagtgcagcatgggaggagcttaaagcgtggcagtgtgcgcaaggttcctccggaatttgagcttgagccactcaacaccagcagagccgagcgcattgcagctcttctggatcctagcagctagccatagtttaggaggagatgaaagagatgaatagtggaggtggttcaagatgaaaccaaatgaaatattatcaagtccaaagtgaaaacatagcataatgggtggcccaaattaaaaccttggtaagaaactgtagcccaacgtgcaatttactctttattttttttcagttttacacacaaaggaatatatcattttataattataaaatgtttattatgtgaattgtagatacgaaaatactccctctaatcagaaaagacatgcgctacagtaaaatcaagttaattttgggcaaaactattgcttacaatgtatggtttggatatatgaaaatgatgcaaacattatttttataagaataataatgttattattataaagttttatgaatatgcagtaatagagtgtggtccaaatagcgtcctgttgactcaaaaaggaataaaatgcaaacttgcaagccaacagtagaattatgagcaaagcattattaattgtatttaatatttcggcattaaaacaatattacagaaaatagaagttgtctccagtgcaggcgttcagcagcaactgtggtcaatgctatattttttgtcctactcaaacaacatccacttctttagtcaatgtgtcccctatttcatttaattctacagttggttgtagaacaaagtgggtccaaacaacatatactatctagcaacaaaatttagtggtactttccagcactaatggataaatttaggacgtttcagagaggccacaggcacacgttctaagacgtggtggaccataaccactttaaaacggggtaaacatcccagcacatgaatacttaatcgtagttagtatctgcaagtgaacaagcaggaactctttaatcatcaaatcttattctatcacaggttttctataattctccttgttcggttgcacgttctacttacaagaataataacagaaggtcaacagatgaaccaaaatggaagacaggttcccccatttcccttggaaatagaatatctcatcctcaatgctcttgctctacacactagtactacacagacaaattagtttgggtgacacgatttgtgagtcttgatttgcagatgcaacttctgatctgt

SEQ ID NO: 74918 - DNA, 100744 bp, Oryza sativa
tttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatggcagtacgccaatgtgaaacctccaagcactttcttcaaactaattgttgatgctatactatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgagttgggacaaggataatagaattagtatcatcctcctagtatgcaacaaacaagtaaacacagattattagattgtgtatctctattaattggttagaaacatgaaaatataagaacttactaaatatgtgcttttgtggtggcctcctctaatccaactagatgtacacaccaaagcttgtgctgttgatgggagtaaagagctgtgataatcactaatcacttgaccccctgtgctgaaagctgattcagatgagactgaggtgatgggaatagtaagaatatccttggccaactttgccacaattggatactttaattcattcatcctccaccactgaagtagattgaaactttttgcaggaatatcctcaacaggatcatctaagtacctctttaaatctgacttaggaagactagcagcattctttgatttcatatactcatgaaattggctagcagcaaagaaatgactactagtagtgcccagagatgtactagtagattgagtggtggcatcattttcctttgatgtgctctggagttcactttcatatgatgcatgcaaagatttcaatgtggattccacatttgcaagtttcttaggaagtacagtttcttcatacaaagcagggaatgtgtagttaatcatacccatcttaaaccttgggtctagaaccaaagcaactgcaaacaaagtattgcattctgggccccagtacttctcaaatttttcaagcattgcatttgccatttctttaagaattgggtctttggacttcatgtcacgccccgagctagtcccgactggaattagcccgtgacgctccaaattaacctgttaatcgataccagtcccaggaaaacagtgctggtatcacagggagacagaatatcacagcaacagaggtctctttattatagagtagaggtacagtcatgttgggctgcggacagatcccgagctcacaactgcattacaaaagggaaacggaagccagggcttggaccaaacatcataggcgcgacttgggaattaggccgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacggccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaaataaaaataccaactgctatcaatatatattctgcacaaggtaaggaatcaaacaagtacaacaagaaaagcattgccatcaatttaccttggcaaatggcaaacacacggtgttctgcaaccttcagtctttcttcagaagaggaggacagcaagataagtactactctatgtctccacctagtccataaaattcaatgtaaatcaataacatccatcaagcaactaaacactacacaattaatacatgtagggccctagatacatgtgggtgcaaaagaaataaaaatgtaaaacaaagaaagaagaggaaacttactcagatccgagtcgtcggttcgtcactcacggcggaggcggtgggctgctgctgtcctccatggggttcttcctggacaggagaggcgaaggatggacggtgcttggctagatccacagcagtggtcagtggagcactagagcagcctaggattgtagatctagaagagaaatgtttcgaggaagagagcaaatgagctagggtttggatacgggatggggatataagggaaataaatggttaggtgatggactgctgttggtggtaggattttggaattggagtgcgggagaaattgggataggtagcgggagtgaaaatttcaagcttctgccgaatagctcgagctcggctcggtagagctcgcgagcttcgagacaagctcgagctcggctcgaatccttgccgagtcgaactcgagctgagcttgcgacgagccgagctcgagctgctcgcgagctccgagcttttttgacagccctaaccgtcgtcgatgaatcgccgccacaaccatcttcgagctcccgacggttggccgatttgggcctgccgctgatgacctccacccatccctgatctagccgccatcgagtcgctgatccaggattcgctacatgcccctcctcccgccgccatctagggttctttctctcgcttcagcccagcgcttcctcctctctcgcgaaacagcgaagaaacagatgccgcgtgcgtgaagccgtgaatcggtatacaacgcgaaagtacaaaactaccctccataccacggtaccgcgtcaatgggaggtgcggtaccatgaggtaccgacgccttttggaccgttggatgatctcgaatcaacagtcacgatttggtactgcagttgctcaaggacagtaaaaactcggcttcagatgttcatttccagacttccagtgaactatccttactgcttacagttaaaacgcagttaaagcatatgtatctgactaaaaaatgataacgggcaagaacaagcattcattgtagcagatttgatagcacaaaaatagggcatacacataatgtcttacaagccaagtttcagaattagcccccacaaaggtgccttttactcctttcgtgcatccttgacagtatgttttcttttccacgtagcagagacagcactaggctattcttttccctctaggatttttatgatattgaatgtgagggaatccaagttcgctctagttgatcacttgctcgtgagatactgagatctagagacgaagattggagagagggccggcttggctgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctcgtctaaaaaaagcgcaagggtaagcgccacctgatcgcagccgtccaaccatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaaggatctgaaacggcggagagctccacgtcgtcgaacggcgccgggaggttcagatcaatgaagccgttgcttttaatcatggctggaatatcgtcgcccgatgcggccgccgccgcggctgagcacagctgggaccgcttgtggccgcccagagcttggccggacgcgaacacgcggaagcagtaggggcactcgtgcggatgcggcttcgcgccctcctcctcgccgccgtcgcactccggcaatggctggagaggcgtagcgggagaaggaggagggttaggcggaggcgcgcagcagccgcccctgccgccgcgcatgtggctagcgcgatggccgccgagggcctggtacgatcggaacaccttcttgcatgcggggcactggaaccgcgtccgcttctgcgcggccgctgcggccggagccggaggtgcgtcgccaccgtcgctcccgtcgtcgtagcctgcgccgcggagacggtagggcggcggcggcggcggcgtggctggccaggtgtcgcgggagagcatcatgagggacagcgctacgtcctcctccgacgtggcgtcggacaccgagctcacctgctcgacatcgcccgatccggtgttcgcgcgcttgccgtgaggcggcgaggagtagtactccgtctcgctctcgcgatccgagaagtcggactcggcgaggcggaccctccgcttgggcttctcccgcagcacgtatccctggatgggcctcttggcatcaccgccgccgtcgtcgtcgccgaccgcgacggatgtggacgcggaggacgtcgaggagatctgcgacctcgaggcggcgactgagtgggagcgcatgtggccggcgagggcgcgggggttgccgaagcggcggtagcagagcttgcatgtgttcttggccatggcgagagcttggatagagcttgatgaggcacagagcttaggagagctaaaaatacgagctttcagaggaaacggagagagatgaaagcgctgcttccgtggggagttagaatagagcggaactgccagcttcctctcgtttattgttttccttttatttcccccctttttttctgggtgactcattgtattcttgactggttgtatttgcagcatttcttttactgctcgtgtagaaccaagcccaaccgtatggaagatttcggactgatgcttgtagttaattgttagtacggatgaaaggaatgagcctattgttcttttcgatgaaatgagtctaatgttttgccatgtaccatcatgtggtccagtgcgtagtttttagcagtagcggttgtattgctgagatggtggctattttggtgatcagattagtcctaattaaaaatctttatttgctaccatacagaaatggcttttgcatacgtgccatatggctttctatgcgagggaatgtactgtgggatgctgctgtactcaatgcaatagctctgaaaattacccgccttggaagatgccactacacttcatggctgtcaaattgcccttttgatggatctccttaatatagctttgccttgttaaaccaccatttttatatcctgatcatccaaaggccacaccttggtgcagctcaggcgttcagtaagttgggtgagatatgtctgaatagagggctcagaatgagatgggaacaaagagtaggtgacaagaaggttgggaagatgggtagaccagtgagaacaaagcgaacacagggtggagtgtggcttggggaatcagtgatagtaataagtggcagattaatcagccggggtctaaatcacaagagtcacttacaatgcaccactgtttttatacctttctcattaaattaagatctgggtatggtgggaacaaaagatctcgatacggtttaggcaacgattaatcccttattagcagcacgttagttgcttacccacaaagcctgaccgagtgcccggccagcatgcatgcatctcatcagcggatctctcagaattatgcccatccaaatccagcctcatcttgttcttaatctccctggaattactcctggcctccccttcacattatcttcctgccaattttaaccaccaggcatgcatatgcaccagctgctgcatgctcgttgagagcttagcacttagcaggcaagcaagcaaagcatctgcgagagctagcctttccaactaaccgctttagggatctctctggttatgatgggtacgcattaggtgcgcccccgatttatgtacatgatggccattcaccccgaataaacacctaccagctagcgagctagccactcaggatcatatttagtactaccatcaagtagcgaccaagtatccagcatcattgttgatcaagcatttgttatgcttgctacggctgtcatgttagtagcatgctactgtgctgccgatgcatggtgttcattgtgtttgtgtgtttctgtgtgtttctgtgtgtgtgcgtgtttggacttcggtaggtaatttccaaatttccatttcactttgtagctggtactgtcagtactgtactagtacagcgtacagatacggtacaagtcaagggggatcggctggctggcttcaattccgttctgaacactaggcagcgtggcaggcgatgagatcataggcgtgtgttggtttcttgcttcgctcctcctctcgtatactctactggagtgtgaagtttttccccctatctgtcaccttcttttttcttttctgtcatcttggtgctgtccttgttctgctcttgatccctatctccaacctttgggagtattcattggaatcatcatcccgaattcatgatatgatatcgaagtgattagctctgaatacttacaaaacatgcagtgttctccttttcctttccttgggcctgcaggtgaagcagatttgtattctcctgtaaaatgcagtggcttggcaatcagtggaagcaaagggttagtgtcttcctatgttactattccacaatggtgtgtgccacgatgtctttttttctttcatggagaaaacgaaaatcgaaggaacgagtacaaatccgcgattcggtccagtactccggtcattgtcctaccctgtgaacttcacttgcagtcgcgtcgaggatccagaggaccaaagctttccgtgcaacggaactgtttagatggtactccagtccaggaacaagacgcgcgatgcgatggcgatgaaaaccacacgttgctctccggcgcgcatggccgtcttgtcctctcgcgctttcaaaacgagcgtgcgttcgtgcgtgcagcggagcggagcggggtaaagaacggaagccgcgagggctacgagagggctagcgtgcagtaatgtccactcgcacaactccttggattcagcaaggctggatggacgggagcgcgtcaggcgaggacgaacgggattgggtcagaaaggattacggaagaagtcagcgtcgcgtcccggtggctgcctgcctcgcgctcgaattggagtggagcgatccgagtcaagcgccgaacgaagcgaagcccccgtcgtttccgccgtcgtcgtctcgctcggcagcctcgcatcgcatgcgccggcgctcgccagctgacgagagccgcgtgcgccatcaagcttaattgtgagcagctagctggctgttcgacacgtaaaccgatgaacgaagcgaagaagaagctaccgaatgctgatgcatttgctgtagacctgtagtgcatcgtgtagaaaacgaaaaaggatcaaacatataggccgtgtttagttgtaatttttttttcaaaattccaactttttcatcacatcaaaactttcctacacacacaaaattccaatttttccgtcacatcattccaatttcaaccaaacttttagttttggtgtgaaaacacagccatagctttgttgtcccctttaatgccgggttggttcggaaagtttcgttaaagagggtttatgatattcctacatgtttacttggtctttttgagacggatttgctacatttatgtcgccataaattttcgttgattacagtcggtatacatgcctattggtcacacagccgcacaggcttcccactgcatgtgcttccatgagagagaagattattttcacacatatatcgcgtgatgatagacgattacatactaattacactataattacatactattttatgacttacatatacaattttgaaacttacattgtaaatacactaaaattacatatgtaattttgggacttacatatgtaattttgagacttacattataaatacactaaaattacatatgtaatttaagaacttacgatgtaaatacatatcgactattttttggtgaaaaatatggcgtcataaatatagctactgatataagaacggtaaatatattcggtagtttgacgtgagggaaagtaaaactaggtgatgtgaaagacctttttacacatcgacggataaattcgttgtagtctagctggttaggatactcggctctcacccgagagacccgggttcgagtcccggcaacggaaatttttgattttctattttctggtcatgcaggcatacagcttcaaaaattcatatcttaaataacgatttcagggtgcagcatccaggctgccattggcccacgtggcactctacaaaattttccagggctactctgaaattatgccacgtgtcctcccgtatacataattaaactgcattcttctgtccacttaactctcaggaaaagtcaggagtcaataaatcaccttgcctaacccttgtgaagaagttggatatgtaacccttccgaagtctctagaaaaattaagatagaagttggatatgtaacccttccgaagtctctagaaaaattaaaatataacatggttcttcacgtgtatttatacgcacaaactatgtcagtactcacatagtcacatattgatttccaagacctttgatgctttaactttttaagactggttttaacttttaatacaaagagtaatcttttaatacaaagactggctttggatattaagctgacaattagagtcattagcctaaaaaattatgccttacataaatttcgtaattttcctataggttaacaaattctgtaaattatactaattcaaaagacacatcttccaaagtatttgtccaaaggtacttatagacgcttaaacaagttaatctttcattagcaaaacttttttcaagttgaattataatatacagcagagaagtacggctatctaaatgtggtagagaagaattaattagccatgcatacactaattaaccatattactctatttgttgataatattgctctaactatgttcgattgtacctatgattagcttgtattatttttaagatggagggagtatcgtatatgagactacagagaggagtaggtgacactggtatgttagcagaagaaatttctcttagagagacttgtcaaaaaatatatcctttagttttcggtccactaatgatctaatcttaccaattaataataggtgttaattactctgtctaatggaagagaaaaacaaaggtttgaaagcaaataggcaagtactatacataatttttatacataattttgctttatgtattaattcttttacaacgcttaaatctttacataaatatggttattactataagttaatcgttcctcagtcttttcaaaattcattaaataggttcttgtaaatctactgcatttgaaactctagacaacaacaacaataatttttctaaatgagtaaatatatccagctataagttggtgtgccgatggtgcgccaattttctaggatatggaagcagggaattgggaaaggatagggaggtgagatttgtatatttgtttctaatttttagggtatttagtgtaatgttggactattctataaatttgaaaaacataagaactaaagtaagaaatatgagggcccggcatgaaaaatcaagaatatctctagagttactttgcattataggataaacaaatttgagatatgctaactcatcctacgtgatactttgaggagggtcttgcactacgaacgccctaagagaggtggtatagctatagttttccgaattatacatatgaggctacgaattgtgacatctaaatggtgtactactcgcaatagaagatatggaggcgtgtccctctccattcacatgtggctcttcaaatagtgtgtgaactatgtggtcctctcgtagtcatgagtcatgactattttcgactactgagaagataagcaaatatttggaaaaaacagagagcgcggtagagatacaaatgataagatttttaaccatcgaggatttaataatgtaaaagtaaaataaataaagagaatttagaatgttatacttaggctgaaagaaaataaaaatatgggaagaagaaaaagaaaaaatcatttcccttttttttcataaccagttaaaaaaacaattccaactgttagtgctattataagaaacctctagttattatgagtaaattccctgtgtacccctgaaaactcactcaatccctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaacaattgaaaaaattttgtttgggtgcacagtatgtgcattttataagactaatgaaactaaataattagtgcagaaaattttgacataaattttgaaaataaaataaatgtaataaattaaaatttttatttcaaattttaataggacaatggatttttttatcgggagcattcataaaaaaaatgttgtgaacattggtagtcctatctttatatgaatgctcctcatttttatgactttttttaaaaaaataaatacgtgttttttatttcatgatctaaaaatatttttgggataaataatgcatcgcacaacaaactcataactataatagtctcatgcgagaagcttttatatttttaataatgtaattcatgaatttctttgttcatccaagggtaaaatggtcatttttatggaaaatagacggtcaactaacggtcaactgatgggaggggtatgcaagggatcaaaatcaaattttgggggtatacaaggaagtaagcaaaattcaggggtatagaagagattaggtaaaatttcaggggtatataagggattttctcaattagtatagtcccaaacaattttcatataaggcttcaccttttagccttatcttattaataataattaaatcgaccatcaaccaacatatatttgacatcattttttcctctgtaatttaaatatttacaaatataatgtttactcagacttgtaggcataaaattaaaaactgctaaaatatctctttaaaattttacgcttttacaaataacaataaacagtatatgtagtattaatatggtttgctatatggatggtgtgctaacggcgcaccaattttctagtatttacctcttttgtgaaaaaaatactcaatacttgcttctcttgagaagaaacaagagaagcacctatttctttaaaattttctggtcatacaacttaacagattaaattcatatattacctcttttgtgaaaaatactcaatacttgcttctctcgagaagaaacaagagaaacaactataactttaaaattttctggtcatacaacttaacagattaatacattatcttgtgtgaaaaaacaagagaagcaactatttctttaaaaattttctggtcatacaacttaacagattaatacattacctaaattttctggtcatacaacttaacagattaatgcattacctcttgtgaaaaaacaagagaagcaactattttttaaaaaaatttctggtcacgcagcttgacagattaatacattacctcttgtgaaaaaatactcactacttgcttctcttcagaagaaaaaaaaatcctacaagtctactgcctcttcccaaattcatatgttacctctttgtaaaacatactcactatcttgagaagaaaaaaaaacctacaagtctaaaagaaaagaaaaagtcacaaaaaagaaggcaaatacttatatgctcatgcgaacaacatatatgcaattgcaaacgcatggaaataatgtaacagtatatatgtatgtactgatcaattcgcagatcaatcactccttgtcgttatcatcagcacccccgcgagacgaggagccaatgccgacttgcagccacggtgtcgtctcccctgccatgctcacgtccttgagatcgctaagcctcgctctcttgacggtggtgctgtccgcctcgtcctctgctgcggcggtgcttaacccgaccgcgtcgttggcgttctggctgccggttgtcgcggtagccttgttccgttggctgggtatcgccggcgacgatgggatgtataccggtggtggcgcgtcgagatgaaacgagctgccgccgaccttcggacggactgttgcggccgaggccagcagtggcgggttcgccgcgatgctgaggtcgagagcgggctccggtgcgtccaacattggccggaacgagagcgggacaaggtcgtcggctaggggtgggactgaggcggtgtgatccgccgaacttgacgtcagccagtggcaccgtttgtggcctccaagcgcctgcccggaggtgaacagtcgatggcagaccgagcattcgtgcatcttgcccttcttcttcaacggtgcagcggcgagcgcggcgaccggcggttctatgggcacgatggccatcgacagttctgccgcggcatcgctcgtgccggcgtttccatcaccgtcgatgcttgcgtgcacgttcctcctggcatcagaagtggccttggcgggattgtcctcgctccgatcagcgacctctgcatggtgtgatggctcagccacctctgcggcgttgctctccagcttggcagcgaagcagcccttcaccttcttgtggctggcacggtgcccgccgagagcttggtgagaagagaaaaccttcttgcacgccttgcactcgaacatgcctcgaggcacggtcgagacatactgtggcgccggcgccggcgggggaagcgccatcactgtatccagtacatacgtcgtcggctccatgaacgtgatcagtctcttatgttccttactcgcggaagaagatgaccgttgttctgcttcagtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctccccttgtttggcgattctaaaataaggccttcccggggaattttcggctcctttcgccatcctgcgtcaacctgctgatcaatcgaccgggcaagtaacgcaccgccaggtccgtcaacacgagttgggctgtaactggatccccacacacgtgcccaactacatgggccggaacgggattcccatctgccgcaattagttgggccgggactgtattcacacgaacgcgcaacatgaattacagaggaataagttcactttgagtccctcagtcgccgagtccaaaattagtcccttgagcgcaaaactgagtagaacgcatccccaacatataaaaccaatacaaacgagatccctcggtggtattgtcctcagttttaactgacgtgacacatacgtggctcctttgacaaggtctttatcccacgtaacattgacgtggcgcttatgtggcaatttgattctgtaaaaattaaaagacgtgggacccacatgtcagctacacacaagataataaaaaaaaagttgaggcccatgtgaccccacgtgttatcgtcactcctccctcttctccctatcccctctctccttcccctacactgcaaggagaagggcatagcggtagtgggtggcgcagaggagctgaagatgaccaccgttggcaacgcccacaaagcctcatccatatttccgcggcgtgcactgtgctcgggaacagctctgactagtacacatgcgccaacttcatttccaccaactccgactcctcctgtggctcctaggccagccgcgtgagccgccacaccttcttccctccaaaaccgcgtcgcacctcaacttccaccatgccatgagcacatgccccaccaccgccacaattaccacgatcaccaccacggagtccgcggacaacgacaactcaaccgcctcccctctcctctcacccttctcccctcctcctcctctcgtctcctccctgccacatagatctcaccgccccacccaacctcttgcacccaccagatccgcgcgccaatacatccactccccctcactatagccaacctgtcgaaatctagggctcccaaattttcccctctctcctcttctctttcctacccatgttttgtttggtctttggaagtaacagagagacaacaaatgaagaagaaaaccggcggaatccacttctagtctacgcacttgggggtcataatgcggaagagcaccacgagcaccaggagcgtggtggccttggaggcacggtcgaagagggaaggcaccggtgaggtcgccgcccaccatcggttagctccgtccgccacctgcctcgcttgcctgctccgccattctcctcgctgcccacccccacccccacccccgtccgccaccttggaagagatgatgaagagaggggagatggaagaagggaggagtgaggatgagtaagaatagagagaggagagagaggggagagggcaaaagggtggaccggaggagcgcggatgacatttggggcccacatgggccccatcatttttaattgttttgtggtgtaactaacatgtgggctcatgcttttttttattacccatattaaattgtcacgtaagcatcatgccaacgtcacgtgagacgtagtagtcaaatgaaccatgtaggcgtcacgtcagtcgaagccggggatagtatcactgagggatctcgtttgtactggttttgtaagttggatgatgcattgtacctgattttatggtcaagggacgaattttgaaaattaagggaccaacttattccaatcacagattcacagccgacgtgcctccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccggaaagcaaagttgatcggtcgtgacaacatgaaagaaaatcaattttacttgtccccgcatcagttcttttaccaatcgaggtagagaggaacaattgcattgcacaattcttactcctatcctaagtacacgagcaaaccataactatttacatccttgatctttctgggcactcgagtggcagctgccggcgatcaaatcgtgcggctgctgtgccggccgcctgtggcgggcaactggcagatcacgcgcgaatggcggctccggagctgacgtctactgggctgccgccgacgccgcttgcctctgctgcgcctgcgcctcgccggagcagacgagggccttcttgaggcacctctccacctggtacccgccgccgtagctcacctccctctccaggtgccggcagtagctctggaacacgctgacgctcacgttgagcctgaactgcatcaggaagaggaagtccagctccagcgagctcagttccgcggcggtcagcccgcccaccgcggcgaagtacgagttcttgtagttccggtcctcgacgaacttggaggcgacgaggatggctgtggtgagcagccgctgggcgttggccgacacgacgcgcacgccgtcgccgcggcgaagccggtccaggtacgcgtacgccacgacgtacacctgcggcgagacgttcgcgtaccgggagaaccgctccaggaacgcgtgaaggctcatgtccagcaccgtgccgctgtcgaaggcgcgcgccctcctcgcggcctcgccgtccgccgccgccgcctggtccctctcgttccgggcgatgtgccgctccagcagcgacgcgaggaccgacacgaccaccggcgtcgacagcgccgtcgtgccgtcgtcgccgcacgggagcgcgtacacatccgacgctaactcagtggacgccatctcctgaagaattcaatggcaaaagcttggttcttcacaaaacctatgctacacaagtacacagagaactcttgcaaatgcagacactttatacaccagagggaggcaagcgtgggggcaaaaagaagctattaacaatggcggaactgaacagctgaaggcgacacgaggaaggagcaaagaaacaaaagatatcggcataaaaaaactcagcacgtacacgcaaactggagctaaaacaaatcgagacacggagatgaagccttcaggcaccttccattgaggcccctgacccgatcacccgagcttatttatgatcaagcggacgacaaatgcatccaggggcagatctgattgatggctggtactgcactactgcggttgggggcggcatccgtgatcgacgaggctggatttatgagggaaaaacaagcgcgagtggcgaattatcgcgtcggtgcccggcgaacccgtacacatttaactatgcgagacttttcccgcgtacgtgctacctgctgttcaggtacggcgtcttgtgtcacggcgagacgcgtggcttgtgggcaagtgaagaacagatgcctctgatctttttagtcttgccttgccggttgataagctagtttatgatggtaatgggaacttctgttaagacgtcgaagcgaccgatggatgcaggagacgacaatggccgcggcgttgtaacaaccggttcttggagttgctggagaggagtggccctttctgccgacagatttgcactattttagtaggttggatgatcagtgggaatactgttcttgggtactcataggacagcggcatcgaggtgttgacatgaagatccagagaggatataaaaatggatctgctgatagtttttcttcatcatcagtactacttgcagaatgatgaggttaggttgcaataagctgcttcatcgaaaataattaaagttgccaaaggttaatttatttcatttgtgaggatcattttttggaaagagatgtctggttggtatatgcacgcacataaagcttgcaggaataaagcagaactttgctttgctttctgataataatgatcaaagttatcatgcccctgatcttagattttttttttgaactcctgatcttgattggatattggtatttctctcccactggacaagtagcttttgtttattattgtcaggcgtgataatgtacagcatgatctttgccaagagattccactctgggacatcgaatcaatcggccatggcttgcgacagtgctcatgcgagcggatggtaaacaaattgaggcatgtgtttactagagaatttttaaaaataaatttcatgaaactataggtgttttaactaaactatccaaaattataaatttaaggcaccatatcacaaaaccacatatttaaagtacataaaaagctatagatttaatattaaagttaacataaaattatatattttatagttgaactataaatgttatagttttgtgattaatatgatgctaaacttgtagttttaggataattttgttgctaaatctgtattttttgatacttttggtttgggataactttagtgataaatctaaagttttgtaattcaacgtcttaaaattacatttttttcgatagtttggttaatgtataccaatatatagttttgcgagatttattatttttttcattgaagcatgttttacattctgctcttcacttgcttacggtgaccaggacaaagatcatctgaacgggacagagtaatgttagagagcagagtgacagcctgggggggggggggggggggttgtcataatacgtagcagaaaccacatatataattgaaacctcaaaactaccgttagattaaaaatggacgcctaagatttgttcacgcgcacgtggacgaatcttatgtccattttattttaatccaacgataattttcaggttttcagtatataagtgatttacactatttttgcaaatagaatacgtatttatcaagtacttccttcgtccaaaaatataacaacttttagtctttagaatttgtcctaaaatataataatttcttcattaacattctcctttcaaccaatcacaacctccactattcaattttctcacatatctccacttattctccagtcagagcactcccccatttaattctaccaactttcttaataaccgtgtccaactctaaaaatgcttatattttggaatgaagggataagctagtttcaagcaagtgcatgtttggtgaatgaaattgtctggtacacaataaaaaggtttattcaccaaaacaaacaacttgtctagacgtatcagacccaaaacaaacgtattataagttaatacactaacttaagtccgtataccggtaatgcatatttactcttttacattcctcaaaaagttcatgaacgatcacatcatataaaggactaagcataataacaaaagctatggttcaacgaagatatgtaacatccatggtgtcatggtgtcatggttatggataccacatatctaatagtagttgactaaactcggcaggacccaccacatatcatgtcttatacggaaacaaacctcgtatataaaaagagttccggataaggaagaataaatagagttctatatgaaaacgggaaggactactcggattgtatccatatttatctccttaatcttacttggacaagggggcacttatgggtataaatacaagcccccctaggagaaaaggggacacgccacaaagccacaagacataacatacacataagccaagacgatggcagctatataggttatcccaaatattgtatttgtgtgatccagataaataaagagcaacactggtttcggctaacaggatgtagggttattacctgtcagataagaggcccgaacctgtataaaaattcatgtctccatctcttttatcttaatctcgcacataccctgataccaacgatccccataccatccaaataccctagtcgtgactatcaaacgtcgacacatggggatgccatctcaagcgtggagctgcaatgatgtacgattgagctgggccggagcacggaaggcacagaggtggagccgtggagggattggacgactggggccacaacggcggcgcggctgccattggagacagaaggggcggagggacggggtgctgatgtgttgggctttttctcaacttgggtcttctgggctcaagtaatagcgctgtttcggaatggagaaggcttcgtattagaatagaggaacaagtccatttgtcatccctcaactttgcaccgagtttgtatgatatccctaaccctcaataccagatatcttgatcctagtcttcaaaaccgtgcaaagttggtcccatgacggtatagatcattttcccccttttttgttgacatggcatatggaggtcccacttgtcagggtgtcgttggtgtcactgggagatgagggaaagagagaggagcacctgctgcagtcgattgaggagcccccgcggaggggctcaccggtagtctccctttccttttccaccttcaccttccttgcaccaatgccgagcaagctcaagctcagtggggctcgtcggccacgtcgccccttttccgcctccagtcccctcacatggaagctgagctgacaacctccccctctctgtctcaccgcatgtagctcatgacccgccaccttctcaacctgtcggacaacctcctccccagcgagctattccagccgccagccctcgacgggcacaaccatcgtctcaagtggtcttagtgtgcagacttgggagagggggagatgtggatgatgtgcactctccttcggcgagtggagaccgcggcggcggtcgaaggccctcgaagaaatcgtccctgatccgcctcgacctccaccccacttttctcgctgccgtggctacagcagcggctgccaccaccacatcacgcctcttccgccattcatcatcatctctgttgccgcgccgctcacctcaccatttgtccgtccctcatctccgagccgctcacctcgccatctccgtcgctgcgtcgctcagctagcctcacctggtttgggaggagaggccgagaacaaggggaagagaggaggaaggagggagagaggcagccgaacaaccccggcagctcgccggagggccagttgtccaccagtgccagctcctgcagcctcgtgctcgccggaaactggtctttgctgttgatttgtcaaacaacggcactgacgacacactgacaagtaggccccaccgtatgccacgtcaacaaaaacaatgggaaatatggtctatattttcatggaaccaatttttcacggttttgaaggtttgagggggtcagaaataatttctggtattggagattatgggtgtcatgtagactcggtgtaaacttgagggatggaaaatggacttattcttagaatgactagcgcgtgggccttccccgacttggatcgcaactactggtgtcgttgcccttatttgtggccaacgagaggtatatgtagtatccggttcggcggttgccatctcggcaaagtcagatcacggcgtatagattgacgtaagctgattcggcagagaacagaagacgtatcatgtatatatatggacgttggaaaataagaaatcgcttactgcatacgattatgccggtagctaaaacagagcaagaatagaggccgtcacacggccgggctcgtcaaaaccgagctacggttgccggttggggcaggcccgggatgtctccaaccatgtcaacgcaattatacaagtgcaaatcgcaacgcagaattcggttaagttataaccaagcaagagacgtcactagaagcagctctgcaaacggccacggagggagaacacacatcacgaacacttaacactaacagatcgaactcctcttttaccgcggctgcgcacgattcccggacgcgcacacaccgaactcacttcgacgaggcgagcttctgcctcgcgatggatctatcgcggcgacgttaacaaacacgcgcgtacgtagtcgcgcacgacgccgccgcattaggcggcgtagttcacggtggatcggtaggtcaacccggcctgccacccggaggggatgacgttgttggcgacgagcaccttgccggagcccgaggtgagccggatcgagaacggcgggctcagcggcttcccggtgttggagttgaggcgccaggtggcgccccacgactgctgcatcgccttccacccgccgccgccgcgggcctccatgatgtgcaccgcggcgaggtcgccgtcgccgttcgcgtactggaccaggatggcgaggtagtacgggttggagcccgcgtccaccttgaaggccacgttcatggcaaacctgcacggcaccctgcaggcaaaagtaaaaattcagtaaaaatctgcacttgtacattgcagagtggaccagaactccagaaataattttgcaaattcaatggcggggcacctcttatactggatcttgaggactccggcggagcggaggcggtcgcccatgccacggttggccatggcgccgaaggcggtgccgctcatgtcgaagtgcgccgcctcgttcaggcatacccctccagggcaggagtcggtgatcacgacggtcactgggcggccggagcacgcccggttgccggtgcacttaatctgtacatctaatttagttaggaatgctccacgtcccatgcatttgactggtaaaacatacaaatacactactgacttggtagcatgagccgcagcctttgccattcttgaagagggagggcccgccggcggcgatcatcgacgagaacgggcgctgcccgacggcgctctggtaaccgcacgcgccgcctgcatttggattaattaaccaacatggcaacgtgagtacttgaggtcaaatacgcacatgcatgcagttcatactaccacttgacaacgacttaattaccttcgctgccgtcgccttgcgggccgccgtaccacgtcgcgccgccggaggaccagccgtagcctctgcccagcgacatggtgctccgtctgccggcagtgtagttctgctcgtagccagagacggggagtgacagtatcggtagcgccactaggacggcaaaaacgaaagtgccccggctaaccattgctattttcttgttgggcaatcggttaggtagctgggattgttaagcggagattgctcggtgatttttaagatgatttgatttggttggtatttatagggaagattagcggtcacaaacgtggtagcaaattatgtgtacccaagcattattgaggtgaacgtggcaacttgaatttgtacatgtgttgatgtgtatgtcaactatgtgtgtgtgggatcgaagagtatacttgtggactttacggaggtccttgcatgaaggaggtgatcacgcagccgcaagggtttggataaactattctcacaaggtagttgtgttggttagaaacgctttgaaaattcgcaatttgatattcgtcttgtgtcatccgtacgtttgtcaaatggctactccataatgtgtacgacttgagcgtgagctgtacgtgcgcaacgtgcctagcaaagtagcgagtatcatgcccggccactcgaatgtttgtacatatggtacatatatagttcctttttcttttggagaaatatatatagttcttttagaggagaatgttgtatagtaacacttagtggcagcaattcaatcgaactagctgggtagcccgcgcaattagcacccatacaaaattatctattttaatatgatttattcaaaatttgttaaatagctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcattttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggatattattttattttttatttaaaattttaattaatctcatattgggttcttatatggattcttctttcaatattgcttatttttaattccgaatttcagctaattttaaattgtattcctacttgaactcttcttttattttcttttgctaactttggatttatttttattctaaattttaattaatttcgtattgggttcttatatggactcttcttttaatattccttatttttgacttcgaatttcagctatttttaaattgtatttctacttggactctcctttccttttctaattttgtattttcttttacttttatttcgaattttgattaatctcgtattgggttcttatatggaatcttctttcaatattgctttttttaattctgaatttcagctatttttaaattgtattcctacttggactctcatttccttttctaattttagattgtattttatttttatttcaaattttggttaatctcgtattgggttcttatatggaaacttctttcaatattgcttatttttatttccgaatttcagctatttttagattatacttctacttagactctccttttctttgttttctttttctccgattaatgtgggaatttttagcccctacagcgaacgtggtgccttcttttcgagctgtcttaataatataactagctgggtggcccgcacaattgcgcggctagcacccaaacaaaatcatatatttttttaagtatgattttacttaaaatttattaaatatctatctcattgtcttaagaatttgaaagaccaaaccttatcatcatcgtgtttctaataatatagtttttaaaagtcacactagttgctaccccttatgtctcagcttcttctttatttgattgctcgatctaccactatttctattcattcttattggaacctttaaaaattggattttatagtttttagagtttattgtcacgttgggtttcatttttataatttctagatgtcccgtcaaacgttgctattatactcctctacgacacgtctactgtcttatctctttattgtcattgagaatttaaaaatcgaacgtaattatcgttttaagttcatttttactttttaaaagtcccgccaaaccgttagcggctttgccattgtaatcctctacggctcgcccgctgcctcccttctttatttcattttgattttaaaatcgaacatgattatcattggtttttttacttttcagaagttccgaacctttaaaaattgaacttgtagttttatttttaataatttttagaagtgccaccaaacgatgtcactgtgtccctgatctacagcccgtctgtcacctactctttattgtcattgtgattctaaaaattatttttttttactttctagaagtcccggcaaccgtcttattcgtttgcttcacggcctccctgacgtctctccttttaatcgtcattagaactctatttggtgttttattaacaatttttatatgtcatatcaaccgccaccactctactcctttatagtcatgttacttaatatatctcgtcatatattttagatggtcttttattttaataatctttatttttatcaaaaaatttagttatttataaattgtattcctaattgaaatcttatttttcttgttctaattttagaattttttttaaaaaaaattatttaataccgtattgtgttattttaatgtttttattttttattttcattttcagttgtttcaaaattgtattgctacttgaactctcttttattgttttctaactttggatattattttttttattctaaattttattgcttcacggcctccctgacgtctctccttttaatcgtcattaggattctatttggtgttttattaacaatttttatatgtcatatcaaccgccaccactctactcctttataggcatgttacttaatatatctcgtcatgtgctttagatggtcttttattttaataatctttatttttatcaaaaaatttagttatttataaattgtattcctaattgaaatcttatttttatttttctaattttagaaaaaaatttaaaaaaaatgtttaatactgtattgtgttattttaatgtttttattttttattttcaatttcagttgtttcaaaattgtattgctacttgaactctcttttattgttttctaactttggatattattttattttttattctaaattttaattaatctcatattgggttcttatatggattcttttttcagtatgcttatttttaattccgaatttcagctaattttaaattgtattcctacttgaactcttcttttattttctttttctaattttatatttatttatttttattccgaattttaattaacctcgtattgggtttttatatggacttttcttttaatatttcttatttttaattccgaatttcagctatttttaaattgtattcctacttggactcttatttgcttttctaattttggattttattttatttttattttgaattttgattaatctcgtattaggttcttatatggaaacttctttcaatattgcttatttttaatttcgaatttcagctatttttaaattttatttctatttggactctcctttccttttctaattttggattttattttatttttatttcgaattttgattaatcacatattgggttcctatatggactcctctttccatattgcatatttttaattctgaatttcagctatttttaattgtatttctactttgactcttcttttctttttctccgattaatgtaggattttctagcccccacagcgaacgtggtgtcttcgtttcgagctgtcttaataataatagatagatagatagatagatagatagataatagatagatgatgagggctgtatgatagtataagttattttccgacaaggaaatgggccgtttaccgcgagaagttggtgtgggcccggctgcaggcccaatccccccgaatctcgcgccgcgtagtgagctgagagcgttgctgttcccctcgacacagaccgtcacgccggcacgcacgtaatcctcctctacaccaaccgaatcgttgccgcgcacccacgcacgcacgcacgcaatcggcaatccccacgagaaattccccggagcgatcgctaaacgtgcggtgcacataggcagggagggtgacgaaacgggcgtgtggtctcatcttaacgtattggatattttgggtcgcggaatcgctggaatctcccgtgcaacgcgccgttgatagcgaagctcctgctccaaccgcgcgggcgggcaggcggacgtgggaggcaacgctgttcgcctgttcgggccgaggagatcatcatgcagtgatcagacgacggctgatcgcgcaggggggcgcacgtcgtcccgtgaaaacaacagccgcgcccgcgcgtctctatctgggcatatcacatcgtcttccaccgatgggctcttcttctcctacgccgccgatcatgtagtcgacgccacggtgggggtggtgtgtgtgtggtggtggtggttgggggggtggggggtggacaaaggcaaatcatgtttgttggcagcgttgccgtcggcgagattagcggaaagttgttgtgatagcaggccggttgacgtagatagagagcggcctaggcccaacacaaatttgctgcgctttgggaggagcgaattgggctctcgtcctatacgggctggaatcaactatcccagcccaccttggataatccgaattgttggaagcttcggcctaaggaataagttcatctaaggtcccttaatttacaccgaatccaattttcatcctttaaccccaaaaccagatataatttgtccatgactgtcaaaaccggtgcaaataagctccctcggcggtttggaaagcggtttttgctgacatggtgcctacgtggctggtttgactaggtcttcatcccacgtggcgctgacgtggcaattatatcttaaaaaaaataaaaaaacggtgggcccacatgtcagctacacacaaaaaaataactacaaaatggtggggcccacgtagaccccacatgtcatcctcacttctcccttcttcctctcccctctcatttcttcctctgcgccggctgcatcagggacgcgttcgacgctgccatgaacaggacgaacaggccgctctgcgagctccgcaagaacgtcatgctctactacgactgcttccagctcctgttctccgacgtggactttgtctccgggtacggcaacaagccggagtagccgctgaacaacaccaacgtggtggacaccttcatcgccggcaggttccgggagcacgtcgcggtgctgttgaacgctaccgtgcacgatggtgtacgctttggtgcagtgcacccgcgacatgaattttattttatttttttcaaatgttcaccatatcctgattaatttgtttctcttgcttggttgctgcatgattttggtcgtggtgcagaacaatcgggttctgatgtcccctccggcgttgtcctccacctcggcgtcgccctccgctctcggctccaggaggccgttggtgatggggaagcgacgacgccggctttggtgaagcaacaggacaacacgagctcgtggctcgccacggctttagctccttcgttcctcttcccctttcctatacgcgcgtgccccggggggagtcaggcgcggggacggcggcggctccgggacacggagcagaggggcgccgcggcgggcgagcggagtcgtcaacgcccgcctcccccgcagcagcgtccggcgccggccgaacctgtccctcctggccgaccgttgcacgaccccgcgtgagctcgccgtcgtccacgccgccatgctcgtctccggccgcctcgccgacgacgccttcgcggcgacccgccttctcgccgcctacgccgtgctctccccttccgacgccgtgctccgcctcttcgccacgagccacgagcggcggccggaattccatgcgaagcgccgtcgcaacaagctctgccgcctcgtgctggctgttgcgtcggtgtagaggcggcgcaggggaaggaggatggaggcggtggtccggcgagggaggagcctggcaactgaggcggcggcggcggcggcggcggcgaggttgccgaggtcgccgcctcgcagcctcgctcgcctacgggaagaagatgaagaaaagggagagggaagaaagggggtgtgaggatgacatgtgggcccacggattttattatttttctgagatataattgccacgtctacgtcgcgtcagcgccatgtcaatgtcacgtgagacggagacctagtcaaaccatccacgtaggcgccatgtcagccaaaaccgccttctaaaccaccgagggacctcgtttaccccggttttaacagttcagggaccgtttgtatttggttttggggtttaaggacgaaaatcggattcggtgtaaaattaagggaccttagatgaacttattcctcggcttaaacccaaaactgcccccatactttccaaagcctgggcaccgaatggtatgggaccattttaggtacactctaccaaactggtgtctagtggggatgtccactcgctgtttgcatgtcattcaaataattataaaaaattaaaaagattataaagatatattaacatgtgttatatgatatatcactctataaacatgcaagtttaaattcaacctacacatctcgtaacaaaaaaataaatttaactttgaatatgcgttactagttgtagtttaatttatttttttttgttgcgagatgtataagttgaatttgaacttgcatatttgtgaagtgatataacacatgttaatatatctttttattttttaatttttttcataatcatttaagtgacatgtaaataaggagggataaaatagtttcatggtgcatgccgagagacatgtatgcacagtcaagacacaacaacacaatgcgaatatgttcatatatagcacgtttataagcactggtcggctctgttctgatacaaataatacacacagtaaacacgtataacgataatcattgacacgtactgcggcgaggaggggagaactagtaaatcatctgcgcctccgcctctgcatctcgccgttattaatttcacacttacgacaaacctgtagccctgtagcacacatcgttgttgcaccaacgaataaccgatctaacatatgcctgcagactgcagacacatgcatgcagcaagcatgcaagttgagatattgcttgcgatcgttagaagttcaccgtcgatatgtacgacatgccgggcttccacccggaagggatgacgttgctggcgacgagcgtcttgccggagctggacgtgaggcggatggagaacggcgcctgcagtgccgagccggcgttcagcttccagacggcgccccacgactgctgcatctgcgtccaggcggcgccggcgccggtctgcatgagctccacgccggagaggtcaccgtctccgttctcgtacttgacgagcacggcgaagtagttggggttcgagccgacgtccacgacgaaggtgagcttcactccgccccagttgcacggcacgctgtacacacatcacgtgcgttcgatcggatcgtttgaaagaaaccaacacgagaagaagaattgaaggacagttgcatgcatggaggttatagctgaagcagtgcatgtgccccggtggccggtggtccatgcgtggtgataagaaaagatgagtgaagccgtgataactgcaagtgttctgctgcttggccgacttttggccattgctgctgcagcaatttttgcacggaagtgaaagatgctcgcttaccggttgtactggatttggaggacgccggccgcgcgcagctggtcggcctggccggggttcgccatggcaccgaacgccgtgccgctcaggtcgaagtggaccggctcgctgaggcacgggcctccggggcactcgtcggtgaggacgacagtcaccgggttgcccgagcaagcgctatttccagtgcatttcacctgaaaaattatattgttgatttccaatgttagatgcaatacaggcatatactccctccttccctaaatacgccgttgacttttttaaatatgtttgaccgttcgtcttattcaaaaacttttgtgaaatgtgtaaaactatatgtatacgtaaaagtatacttaacaataaatcaaatgataggaaaagaattaataattacttaaattttttgaataagacgaacggtcaaatattttttaaaaagtcaacagcgtcaaacatcttgggacggagggagtacatgtatgtgcacagacttaattatactagatatatattctgatctgtcggtatatatgtacctggtagcaagagccgcagcccaagccagacttgtagatggaaggactgccggcggcgatcatagacgagaacggtgcctggaagacggcaccctggtacccacatgcaccacctgtacacacagatattgcactgttaagacatgacatacataggcatgaattttcttttcgaagaaactctcatctgatgacaacgtatttaccatcacttccggcgccatttgcagcgccataccacgtagctccgccattggaccagctggagagcttgcggtggaactcgatggaagcgcaagggcgtggaagcatggtgacagcggcaatgacaacgaaggtcgacaaaatcagctggaacctggaagccatggctgctatacctgcttagctaaacttgctaggattgttgttgctttgcaaggatttggaagatgcaagcaaatgagtcgatgagaggtggtgtgggctgtgtgtgaggtagctagggaaaggaggtgatctatttataggcagcagacgatgggtttgtgtgggcatatccctccgtgcatgcatgcgtatgcagacaaatcgctctgcttgcttgctctgttggatagttccatatccatgctaatgcacatggctagggtcaacatgtttaagtacagtcgaaaagtaattagctatttacgtagtagtaggccggtccttttgtgtgtagttcacttgtccaatcctcaattcgatcggtatcgggaccatggcagttttaccggtattattactagctttcagtttctgcctgcctggctagatctggcaagctagtgaatgaagccataccatttggctggagcccatctttggttaacaaactcgtgaatgtagcatacatgctatgtgtcattgcaccctgaacctccagggcggcatgcatgagagaaaggtgctaatacaattaatgtgcatagcttgtgttaatctgcaacagagggtaactgtacatgattataatttgtgcataacattgtcaataacttgctggacgacgacgcttacgtttgcgaatcctgcctactactattggcaaaatggaaagtcaaaagtgcacaggagattggccgttatttcggttgatcactgcacgcccgcacgcccgcgcgcgtgatgcgatggtgaccgcttaagcttgcgcatcccgagacgtctcccctagcctcgctctcaccacaccagcttcattcttcctcctcccgggtcaaccgatcgaccgtttcatccccggccgcatccccaaatccgccaatctcgtccccgtcaactctcctgacgagcgagcgcaccgtcggctcccgcgagcaaacaccgggattcggggcagctttgccgggccatggcctcccgggctacggctctctacatcagcgagaattaggcggtcgtacgtacgccatcggcggccaacatgtgcgcttggccggcgggagggcgggcgagctccgggtgccacgcgtgaatgtaggtaggctgcacacagtcgatcggttggtggcaacgacttggcgttggcgatcgatgtgcaatgcatatgcatgaaagtgtgtgggatgacgaaaggcacggttgcatgtaacttgcacgagtcgtcgtgcagtgttaactgcgggggatagctgttttgagtactgtggtcgcgtcaaaaatcgatggagtgcccgggtggctaattttgtccgccttgatttctgccattaacccgaggatcccgccatcccggtgaatctgcacggcacgtatggcatgacgtaatcacaggtgtgaaccggcctgctctgaagggccttccattctagcccattaacatttaacctccccaggccgaaacaggagctttggggcctaagcctaccaggggtttttccgtactggcttcactgcgtttccagcatatccattggctggaggtaattttggttttacttccagctggtaaatgtagcaaacgcagcacagtagagttcacagacatgctgcctcactctcaaaataaaccaatctaaaattgaaaaattgaatgtgacataaactcatataaatgttatatctagataggactttattcagatttatttcgtcaaatcataccctagattcgcttatttcggaattaagggagatcacaacatgaaccaacgcagcatgaattccatgtgaaattagtcctcattttgaaaacatagtatctttaccgcaacagtctgcaagaggtcctcgttttaaaaacagagcagctttgcccgcaacagtcttagagagtaaaccgtgacggtcgttccaaaatagcattaaacacaatacggatacacattctcccggaactccttggtacaatatcctaagtgaatgtctaattaaagacaaacaaaaaacttacaaacattctaggggtctatcacaaccatcacacatagcagatcactcgtgatcacaaaaatgagtgtcaatgcttgttactcttcgttcccgctctcttccttcgtaagtttgatcatgtcatcaatcctcaggatagtaatggccgcctcagtggcaaactgcaagggaaaaaaaaaggaaatggcgtaagggcctcagatttcagtcaaacatcatgataagacctatgctaagtataccaacctgaataatctttactttactcattgctggctcaatgacaccatattcaaggttgttgcgaatgataccttttgaaaggtcaagacccatgctgcagcaaacagaagtgaatttactggttactctattgataaattacacacattcaggaacacattaacttcttccttttaatagatggctgactaacattaactatatgtttaatgccaagtatcgcgaaaactacagatttaataataaaattatcacaaaacaacagattttggggttcaaatcattagcactaatggtatgtttgagttatcaacgtccaagttttgtgattaaattgacattaaacctgtagttttggggtaattttattattaaatctgtagttttgcaatacttggcatcagacatatagttttgtgataaatttattgttaaatatatagttttgtgatacatcacctaaatctgtagttttgcgataatttgctcaagtatttgtagctttgtgaaatttactctataacataatatctctagaattgtcccaaaagttcatcaaaaaagaatttggagagcttttcaaagatctagaacatactatatgtacaagataaaagaaccacatcttattcagataacaacgaagacatgttctgtaattaccttgaaaagtgttgcttatcagcctttgtttgagcagtatgatgatatgccctaagctttgctacaagctcagttgcatcttttgcagcattgacagaaagaacctgacatcacaaggtcacacttcacattaatattttatgtcatccagtatgtaaacacatagaacacaagtgatcaaacctttggaatgattaacaaagattccgcgaattcagcaatggccaactgttccctggacccaagggttgtagcaagattctccaagtatacagacaatgcagcttcaactgcaccaccaccagcaacaacctgcatgatacatacatgtttaaagcgccaccaaagttacaatgccagaactacattcacggctaatatgaagtatacactgccaacattgttctgtggatggaatgcaggcataaatgactgaaacaagtgacaacacagatagaattgcaccaagtggctcagttgtgaaaattttaactgctttggttgatttggtttgcaaaagcatggaagctatcctctgaagaaatgtaatggcaaacatggtcatttggcattgtacagcataagcaattgacaaaagaataatgatggggcactaaatacaactaatcaacatgttagtgtctaatcaaaggtctcacgtggtaacaggacaacagtagtgctcaaatgaaaaaaaaagacatttttttcttactctcccaaaaatcttaatataacagtgaactttatatattcaactgcagggaaccaacatgttaaggaacagaagcaaaaggttataccatattggattccagagttctcttcacaatgcacaatgcatcatgcaatgatctgtcaatctcatctagcatgaagtcatttgcgcctctaagtataattgagacctgcataaaagaaatgcaggcgtgattcccctaaactcttgctggttttgttatacaaaatataagatttgcattggaattgaaaagtacatacagcgctggtgttctttgttcctttcaccaaaattacatcatcatcagcaattctttcctcaacaacttcatcagcatgtccaaggaacgatgaatcgaatgtctcttcaccttccatatcagcaaatgtagatacctgcaatttactaccaaattaggacagcaccaaacagtttgtgtagcattaatattaggactagaagcaacaaacttaagactaaaattacagtggtatcgcaagggaagttgcttcatcatttattaattctattagtcatctgcacaattatgtattccaatgttgttacaactcgataaacaaaaggtgaggcataccatagttgcaccagtagccttggcaacatggcgcaaatcctccttacgcacacgccttacagcaattgctccagcctcaacgaagtactgaaatgatattccattgaacagtcataaagcagatttaaagacagtagccaggaatcatcaacatcatacatatacaaagattaacacacaaacaccacatgaaccaagtagctctttcaaaataatcaaaaccaattcaataatgaaacagctctcttcagagtaaaaagaagtctaactaaaattatgaaacagaagctcagtttggacgaccaaaaagattcaatgatgaaagaagtttcctgaggaaattgataatgaataccccacaaacacccacgctcaatcaacatcaacacaataccgtccatgtactagtattcaatcaataacagagctcttaccagtccaaccgaagtcaatagattatatttaggtaataaaagaatgtttctacttgaataaaacataccttcagtgacatatcatcaattcccttagtggtcagtacaacattagcaccagccttcagaattttctcaattcgctcctttgttatgtcagattctctgccatgaaaagtaagattatgttttacaattggagaccataaattataatagaattatgtgtggatccaaccacattccacaaaacaatagaaataaaaaaacacaataaaaatataaaaaaaataaaatgtgcaaatcagataaaagagaacaccccaattgttgactcattaagtatacaaaacaaatgaatcagaatgcgttggaaaaagtaaatgcacatacctctgacgaattttctcaagttcccttggatcagttacaaggacttgaacacccaattgcatttttgtcttctgaaggttaaaatcaagacatgcaattcttgccggggttactctagtaggcattccttgagctgcacggcctgtgtttagtgcatacccattcagcaggtaactgtccttggcacttttaccatgggctttcaaaatattaatgctctgcagatcagatgagctatagttaccagcaaatttctgtcgattttgttaatataaaaatcaaaaaatggttattgcgaagtacttttagagaaataacttgaatgccatgtccatacatgaatggttattggttaacaagaaagtcaatgacataacagcatataattaaggtagaagttaaactttattagctctcaaggtgtccaatatgttatacataaccaggagaaaagaacaaaggtcacatgtagcaaagctcacaaacaagtgtaatactctacaatttccaaacaataatagaggctacagaaagagaacaatcagtgaagcacaagtgcacaattcaatatatctcattcagtgtattgcaattgcacacaacaaagttttgctttgatgtataacaagaatcacaagcatgtaactcaccttgataggatacttcacttctcccttagcgtttgtggtcttcacagcttggactgcatcgacaacctattaaacaacagccatgttaattatacagcacagtttgaaggaaagcttacagaaagtgaattaaagcactagcatttggctacggatatgcctaactgtcagatagagacttaacagtgaagcattatagcatgctacgacattggaaagaaataaattggactgcctatatatacagatatagagtatcaactaaatatttatttaaatttaaaaagtatcactaaaatcaaacttacagctgaaaatacaaatgtatatatatggcaataggaacttaccagatttgcgaagaaatcactgtcactattaatcagcttcgaggacatgcttgtcttcgcacagtttataagagaatcctttccaagtttatcaacctgaaaatgttgatagatactagtgtcaggtgtcaagaagtaatctgctgctattcattaagcagatagtattctcttaccttgacagccaacttttcttcaacatatttgcaagcttcacgcatagcaagctggtagtaaatgatggtaaaacatgttaagcaatgtgggtttgcagctggaacattcgttttaaatctgaaattgtactgcagctgaattatgaagtgcaaaactcaccctgtagccactgataatagatgtcggatggattttgtttctcacaagatcattgccccgctggtaaaaagaaaaaaagagtgtcataaatgcatatttagaatggtaggcaaatacatagggaagaaaagactgacacgaaagctccatttcattacctttagcaattctgcggctattatcacaacagatgtcgttccatctcccacctctctgtcttgaagctcagccaactcaacaagaacctaacaataacaggaccaaaaaacaactaagcacaaaacaacaaccaggggaaaaaggagatggcacctttaagctgcctgacatcaccttggctgctggatgctcgacttccaacatcctcaaaatggttgctccatcatttgttatggtaacatcaccaatatcatccacaagcatctacaagaaggatatgctcaattagctcattccagccaaccttttggaattatcagggattggtgtggtgcagaactgatctaagtctaacttcattaatcctgattaggtttagtgatactgatgcacatactgttgtaatttcatgatttcataaaaagtttagtgatactgacagttatttcgagcacataacaacattagccgcacacatattacaccgttgaatcagtaagcgactgaactacatctggatcacaatgagcagctcataaaggagaaaatacgtcattctaagtagcggatcacacaattttgaaacctacaagttcgcatccttcacacacagtaacaatttatgcgcaaccaagtagatcaaatcgcaaggtacaaaccttgtcgagccccacgggcccaagcgaggacttaacgatgttggccaccgcctggcacgccaccactgcaatcagagaaggaaatcaaatccccgcgtccggacggcgagtcgtgccactagatcttacaaaaacccgccgcgactccacggaatctggcggcggggaagggcttgcaggagggggagagacgagttaccgttttgcgtgcggacgtcctggccggactggcgctcgccgaggatgtcgggggtctgggcggtgatcgccatggcgacgacgacggcggcggcggcgaggcgaaaactgtggaggcagcactggagagttcgaggcgggggtcggcgtctgcaatggggggttttgctggaggagccgcgggggttagggttcgatgcggttgtgaaatggaccttggacttgatgggccttgatgagcccagcccattataccggcccaaactcctcacgaaggcaacgcgagctcgcctccccttccccccgtcaccgccaccacccaaaccaaatcctcgcccatggcgccactagtctcccacgcgaaaattctcgcgccgattccgaggggcaaccgccgcctcgcccccgcgccccctgccgccggcggcttcctccgcgccctcttcccctcacggcgctcccgccctccgccagagaaggacgagctcctccgcctcatcgccgaccaacgccgcggcctcgacacccagtccgacccctcccgcctcgccgacatcgtctcctgcatcgacgccctcgccgccgctgctcccggatccgataccgtttccgatgccgacaagctttccggtacgtggcggctcctctggaccaccgagcatgagcagctcttcatcgtgcgcaacgcccccttcttccgcaccgccgccggtgatgtgttccaggtaatcgacgtccccggtggcgccctcaacaacgtgatcaccttcccgccctctggcgcgttcgtcgtgaacggctccatcgagatccagccgccccagcgagtcaattttaggcaggcttcctccagctttttgtttaggcttaacataatcatctgttctttccaaaaagaagacatcatcgtctgttgtttcatcagcttgtggtaattagagcaactgctgattgttttattttatgtttgcttgttgcaggtttacacgcgctatgttgagagggagcaattgggaggtcccgtttccgccctttgggaaaggatggtgagtggaagatattcttcaattggtagtatcatgcacttcactcgaataatcttacaagttgagttccaatgaaatagcaaaaacaaaggagacagaaaaaaatgtggaagcatagcacgagatattgtgcattgtttgcaacaattttcaaggaatgaaatcgtatctagcattcatggattgatattgtgttcacgtaatcgtaaaccatttcattaaatcaaatacattactctcgcagtcataattattttaggtaagataagaattggtcaaacttttaaaattttgaccataaattattggtcaaatgcttagtttaaaagccaaaaaaggggtatacttagatttgactcaaaaatatatatatcataaatttattctaatctaaaattaatcatccgagttttaaaagtttaaccgaatcttgtcctaagtgtcaaatatgtatgaccagaaatagtttttggaactgtgctgcataatcaacaatttataagtctaacaaacttttcatttttgttactagatgaccaaatcatcatctacaagggctttcctttcccacctccatttttagggatggtgtatatgttttcttcacctgatcagtagagagtgaatgtaaataaagctggactggaaacacatttttaccagttaggtctttgacatttgttcagtttatcagttctgtttcgttttatcagtttctggtttgacaccatctatttggaaatttggcttgtatgtgttaggtcttttgacatttacataatatatgcctctactttcaggtttgacactgtctatttggatgatgacatccgcgtagcaaaggacatacgaggggactatttagttgttgaacgcgctccatattcatggaatggatagttgttaaaattcaaagttgattgaatgcatagccagtcttgtgatgtgccttgtgaatataagaagcagattgtcagagccttgtgctttctcagcaaagtgttaaccatcgtgctatgacatttcttttcctagacaatactatgttctcccggaattagatggtaagtttgattagtaatgcatgtgcagcaaggttcttcttccaaggaattgtctaggttaaataatacctaggtatcccctatgtgagagaacacaaacttgccaagtatttgatgtgcttttggacatatgaaaaagatgctgcccattacggtgaactacgttagcgaacttgacagcatattgttatggcccacgatatcaagagccatgatggaattgttgactgtttcagtaccttttgttagtattgttttgcctgttgcttccagctttaagtagtagtttttcacattgaagcaagttctcagcaaatcaggtcaatgaatgccatcatctgattaagatagtaaactatgtatggtcttgctttatctgtatcagggttccttttccttttatactcatgaggagtcaatgagatcaaatccaactttgctttgggaaaagtagcattgtagtgtcgcaagcttaatgatatgaaacattagattcagtttctgtaaccacttacccatgatttctaattctaggggtttcagatacagtgttatgtttcattccatctatcaattgaccactgaagatcagatcaactttttgcagggatcggactctatccttctactgcccccttggaatgctggcaggatttgtagtgcaatgagaagagaattcaatttgccatgtctgaattttcctggttatttttgtttgctcgtttctttatctaggaaaaattctgctcaatacctggtttaatttttgctgcatcgtcaatgctccctgtcatttaagaaaagtaagtgaaaaggtatctatgtgatagattgattgaacatcactacttctccatgatattccaggcctgaacagaagcactgaagcaaaatacttttgaaatgctttcgttggtcctactgttgaactgaatagcaagttctcctttcaacagcttgtttcaagtgtctagtctgataattgcttccttgtactagactactgcaggttctagtcgcagtcgaacaacatatggtgaggctttaggaggacaggttggaccatggccctgggccagactacattgtgtgatgttgggcagtttgtgtacgctacgtgtgaactcatcagctcatcacgaaccagcatagaattatttttcttagtttgcttttgtttgtttggataccatttccttcaccttgagatatttggttaaggtggattgaacttagtaatgaagcaattcttttgtaatagcaggccctccctgaccaagtactggagccacttcaaaggatagaaggcaaaggctccccatgtgaaaaaggacgctccatgaccctgccatgtgtggtcatctgcgatttggtgtcccatggacagtgatgcactgattccacccttcgagtcttaaaagcaatccaaggttagtttacataccttttgcagcttagaaatactgaggataaaacgaagatagtatatcgtacacactgctggtctatagatgatctgctggtggccacaaacctttgcgtgacacttaatttggtggagtagtattttgatcttactggtatccttatatatatttctgaataaactagtatacaatggacaaagtcagttgatgtttccaaagaaaagcttgtgccgacatcaattaatcattttaaagttgcaaaaggagctataatgcttgagcatatctggaaaagtatgattaaagtatgcatccatacaaatcaaccacaatatattcaagattgaggatatttgaacaacatttgtagcttgtgcatgtttaacgggagcagaattattagtttctcttttttttaaaaaaaaccgaaggtagccatttgaatatattaaagagaaaagctaaaaaacaaagtgcatgcccaagcaccacacgctaaccacacaagcataaaccactgagagtttagagcctaacaccaaaacgatccccactaaacgtgaccaacaacaccaaaacaagaccggcttcactccacctcctcatgccgaggtggttttcgccgagctctttggcctcgcagccaccttcccatcttgccgctagcttaccatcggcatgctccagcggcggcgaggtggaagaggggtggagatgtggcggcacgggtggctagaatttcgccccgagccgcccacgcgaggacgacacaggggagggagtagtagattgctagcagcaaccattttttcttttttatattagttctttaggaatgtgagcaggattattagtttttctgtttttagatgaggatcattactcgtttttcaggaacgtgttcacagcttttctttcttttctttttctttattttttttgcatgcaatacggatatgttcgtcagagcgaatggtgtcatcctataatccgtgctgcaaattcaatgatccagttactctagagacggaaggcacgcgtcatagtatcatactccgtactttgtttacactgtctctatactctgatagacgaaaggcacacagcacactggcatatcgttatcctctgtcagtatagtacagtaaagcaacagccgttcggcactgcaaatctactactatcgtaggagtatactgtatgtggattggatagatgtacataatgagatggaacggctttgcgttttgcagccgcccggatggtagccagcagtccagcaccaagagctccaagacacggcggaccgagccagccggagggaggggatgattgagacagcggcctctgcggcgacgacagtggatcgtgagcagatttatcctgccacgagataagtacattgtactgctgactccgtttcaaaatatagctatttttagcataatactttgttctaaaataaagctatttcttcatctacgttctcaatcaatcacaaccattcttttgcatctaccttttcttttcaatcaatcgcacactttctctaatcattatccctaattttttaatacccgtactaacttaaaaatatttatattttaggatagaggaaatagtagcagataggtgcggctgctgcatgctatgctgtgcacccctacgcaaatgcgtctctccaatgatccatctatccgcatccgtctccatccgcggcggcgactgggggagcatggcgtggcacggcaagggggccggccgaccggcgtggctgtcgtaccccccaagaaagggaaataaaatccaaactggcagcggcagcagcagcggcaggatcggatcggagcggccatccatctatcgtcgccacgctcgctgagtcaggtccgtgatgatatgatatgatcgggcccccggcccggggtctctccgccctttttctttccttccttttctctatgctgtttattgtgggaactggccagcggcagccgcagtggtggtcctggtacttgcgcacgtacagccactagctttccctgcagcagccacccactgcacctgctgctctctctctcttcccctctccctgcccatgtccatcccgctttgggctaccatctccccgcttttccatcgccacaatcatgaccgcacgtagccacctaattacgccttggatcacctccaaattaatcgcccttaatgtgctctctttttcaatgacttagggggtctgttcactttgatgttaaaaaaaaccttaccaaatattagcatagttgccacagaattttttatatagttattaaaatttggcagcaaactaaatgtagccacttttttagcaactttaccaaaacttgttaaggttgaaaatagcatcaaagtgaacaggacttttgatactctgatacgctacggctggtggctctcgtaagctggatggccccagctttaattagatcgagacgagtaaaccggttagagtatgttcttatcaggttatctgctaaacaggtttcaattctgaagtatcgtacgagaagttggagatctctaattagctagctactactccttccataaaaaaacaaatttgaagggatataacataacttaatagtgcaatgaacatctagattggttttttagataaaagagtagctaagaacctaattaatctgaaacaggagtagctccccgtttttaggcacacgggaccatgatatcctcccctgtctaggacgtcgacgtggttcaagacgaggatcgatcaatagtacacccgtcaataatgtcatgtacgtacggcttatgcctactccctctgtccaaaaaaagaaaaatcctaggtttccgtgcacaacgtttgaccatacgtcttatttgaaaaaattataaaaaaaattaaaaagacaagtcacgcataaagtattaatcatgttttatcatctaacaacaatggaaatactaattataaaaaagtttcatataagacgaacagtcaaacgtacggaaatcaagggtttgtcttttttttggatggagggagtacgttaagtaagcactcacgcaggccggcaagtacctactccctctatccttaaaaaaaaccaacctcgtacttggatgggactcgtctaaaaaatctagtacgatgttggcttttttggacgaagagagtacgtataacataacagtgactcgcccatacttgttttgtcatagtacatgagatatacctcgtttatttacacattatttaaatattttttaaaaagaaaatgtattgatatgtaacattaccatacatgttacaatttaacttctatatgtaaaaataaatagattgtagctaattaacgcatattcagtcaaatttgtttttttattacaacatgtagaaattaaatttaatcttacatatttgtggagtgatttatcacactaatttatcttattagaaaataaaataaatttgtaactgctccatccgtctcaaaataaatcaacttatggaatttaaactttatcccaaaataaattaacttctaccttcttatttactttggttcacaatgaaataagagaatttcttccatacccctgaaattttagccgatcccttctattttcctgaattttcttcactcccttgtatacctctgaattttgatttggatccctttcatacccttgttgtcagttgaccgtttaataagtatcaaaaagtcagttttacccttcaatacgtgaggaatatgtagaaatttgtaaactatattgttgcaagtatagaaatttgttgtgtgattataatatttgtaagtttgttgtacatagaaattttaataaatattaaaaaagtatgtgtaccattttctttaaatgataaacatagttttggaaaacattcctatatattatataggacatgaaaaaacacgttgaactaccataaaaaaaggatacatatactcttttaataagtaaataaatattaggtttttatgtcattatcttaaattaaactttgccattaataagttgcatattactccctctatccataaacttacacctatttcatatttgagtttttccaaataagttgtttctatttgtagtctttatgcattcaagacttaaatgaagatataaataaaatgctttattagaacccaatgagtcatctaaatactcattagttgcatacttacattcacttcttgattttgtaacatccaaggtgatttaatttctccttggtcttggtgtcaaaagtaatatgtgtaacttttgtggatggagggagtatgatagtttgttcaatgataaacctactagtaacatcaattttatctgattgatctttttagggcccctttcaatcaaatgaattatgaaggaatttcatagaattgaaaccctatagaaaattttcctatgtaacctttgattcaaaggattaaagttttctaaaacgtacaaaatttctatggaatggcttatttcatatagtttttggagaaaacttagcaagaggtccaacctcttggtaagaatcctttgagtctatctcatccgattcttgtgttttttatatggtccaatcaaacgatgattcatgcatgtgtttttcctgtgttttgcaatcatctgttttatatttacattcatgttagaattctatatgttttctatttcttcgtttttttattctcatgattcgaagggacctttaatatttttgatattaaaagttaaaaatgtttgggactgagggagtaaagctaatggagtactcctaccttgtagcaaacggcgttgctgaggccatcaggccaatcgtctggctggccgaccacgatctacactgccctagaagttagccctgtcagtggagtagtactggtagttaggccgcgcgcgtgggtcgccaattcaccctctctatagctacaggtgcgttacaggtgcatcgccggccgtgcagtgcaggctgcatccatgcatcgtacacctcgtggcgttcgcgtggcgtgcatgtgatgagctcgagctgcgctaacgagctttccagagcaaagcgacgcgcgcggccggccggggctgcgcaggaaaaccccgaacctccatcagctgattctctgagcgtaaacctggagctacctggtagtagtagtattacgaatttaattacgatacaccgtcgcacgtcgctcacagccggcgcacacagctaaccagccagtacataccagcggatagatcaggcgaacggcatatactacgtgccttctgtatagtgttcacgctgtgtttagatttaggggtaaaaatttttatcgtgtaatattggatttgaagtattaaacgcactctaataacaaagaaattatagaatccacctataaactatgagatgaatttattaagcataattaatctgccattagtaagtgtttactatagtgctatattgttaaatcatggagtaattaggcttaaaagattcatattacaatttacacataatctgtataattagtttttttttctatatttaatattttatatatgtgtctaaacattcgatgtgatatgtgaaaaaacttatcaagagatctaaacatgcccataccttagtatatgcgcccacagaaaaaggcaaaggggaattaattagtacttgaatacttgatctctagatatatgtatgcatgattctgcgtcgaatcgtggttaccgaaaagatatgatcgagagctaggagttaactccatatagtagttaattatgttagctaagagctaggagtactcgtacctttctgatctccttggaatgtctttttctcgatgaccttacgtgaaagcgtaacgcgatcgagaaccgactcagccgagactcatcgttgcgcacgtacacgcgcgcgggggtggacggccggcgtgcacggttccgctgacacagacctgcacaggcgggcaaacataattagatcgagtagcccatgcatgttgattataccagtaagtttcacgcacgcacaccggtccattgatttctcgccgcgcttaatttgtcctccgatcctctcctggtctcgggtctccggaagttgaaattaaagcttcttcgatcgcgtgcgccgattgattcggattaccaaacttcccagagattttagcgatcgaatccctgctttgagatcgacgtgtactctccctccctggtcactggatttaaggttgtcgcgtgccccctccccctgcgacgactgcgagcctctccttcccttccaccttttttcttcctctcttcgcatgcacgcacgtacacactcacatccccccttttctctctccagatatctctctcatactatttaataaccggactcgtagtccctacctttccatgattccatctcctccattcccatccgcccgcatctccactcctcctctccccacctcctcatcaagctagctaagctagctctcccaaccatggctggcgccggcaccgtctgctccatgtgcggcgacgtcggcttccccgacaagctcttccagtgcgcgcgctgccgctaccgcttccagcactcgtacgtaacgcgcgacccggccggtgtactctctaccactgtaatctcttctctatctagagctagcagcgaacacggggtgtgtgtgcgtgtgtctgtgcggtgtctgtgtatccatgcatgtctgatagacttgtggcgcgcgtgcagatactgcacgaactactacggtgacgcggcgcccgccccggccggcgccgacatgtgcgactggtgcctgagcgacgtcgccgggaaggcgaggtactcgtcggcggccgggaagcagcagggcgccggaagccaggagtcatccacgacgacgtcgagctcctccgccggaaggggtggcggcggcaagcccggcgccggcgagcaggagagcgggcggcgggggaccaaggcggccggccgaaggtacaagctgctcaaggacgtcttgtgttagtttgtttgtttaggtcacccatgccgtcacccagtactagtcgtcatcgcttaggctatatagactcgttagctagccgctagtttgatgatcgatgtgcatatactacgtgcgtactccatattgtatctagttgtgtgtgttagggtcttttaagggggcctgttacctgaaatgttgcactcttggcttgtgtttctcttgcgttatgcttgcatgcttttctagtatcttggataatttactgcatatatatctcttgttatcttcccgggttctttctaacagcgatttgctagtagctcatatcacatgcatgcatgtaggtaatccctacatcttttgatcacaccttgtgtgtggtggaatatttcagatgagctattaatttctcctgaacttgttagaaacaacaggatgcatgcatgcattttctttatctttatacttcatgtagttttggggccggggaactgaggagcaactggccatcacgcacgttgcatgctgccaagccgagccatgtcgatgtaggggtcaacgaatcgtacccaaagacccaaagtggccgacaaagacatgctcctacacaaacctcaagctctgcacggcctcctctctacgagtagctagcttgtggccaagatccatttagcccctgcttttgcctcgattggatggcaatgcaaatccttctgctacctatagcaacaaactgcatgcgcacaacagcccagtatcagcaacattgctgctccagaatgccatcactgatcatgttctcccatttgtcctttcgttgatactcctaaatactctgaatctctgatcaatgagcctgttgatacagcactgtccgttattcaaatattttagtcagtcttgccgtacctgatcacttggcgattatttaattcctagctagtactctatatattgattcagatctctactgggatgaactgtagccataagacaaaactttaattatgaggggaagtttagttaagtggaattaatagtagatgacggcaggaccaaattagctgtgtgtggtagctagctctagctcgcccacagtaccagcggtgcagctgaccctactcttgtgcatatgtacaccatctggtcctttttaggtgtcatgtagctaaacagaccagacatcgcgggatcgtagctaggtttctttctccctcgtcttctacactgtatgtggagttatctttcttctccctagcctagctagctacctatcttgcacgtactactaccaaacaagcgttgttccttaatcataaccgaagtttaattatttcttttgacactgtttgctagctagctcatagcatctacttcctccgtcccaaaaatatgtccagatttatctctagagttctagaggagtactaaaaggactactcttttcattccaatttgatcatcacatatgatttttgagttatccctaaaatgatcgtactcctatataataagtgcctcttcatttatttgtgaaaagagtaaatggacatcactgaatgtgttggtatgcatgtaactagttaagattaatttctattggttcaactccatgcaacatttatagtgtgatgcaagctgtgggacacaaagcgatggaacacattgattagtgataattaattttagagccatcgaggttttattgtctttggactcgatgctctttgctttggtgataatcaaattggaattgagagagtattatataagattgtagttgcaagtatagctttaaagattgtaaacatactgcaagcagctaaacactacaaataaaaggggtctattgtgccggttgtgaaccctcgtctattctgggttcccaaccagcacaacaatcgatgcaatgatggcctctcgacctcattgtcgatgtagagaataggcactaatgggattgacgagctaaaaaaaggttgagccagcttgaattgagatgacgcggtccaaatcacatatcatgtatcgatgcccagatcagcaattgaaaaaaaaatcaatttagacagattgatgcatgaatcaacaaaattgtgaaacacagatcctaacaaataagaaaattagaaaaaaaaatagaagattgtgcatccatctttttgttgatatttggatttcgttttcaaataaagtcatcttctagttttaaatcacctttagaatcattagcctctgtccctacactgactcacttatccgggatcgatcctcactacggtcctttatttcgaaacgaggatagggctctcgcggaacgaggtgtagattgagacgaaagatgagcgtatggtccatactcactcgggttcaaacttattcttcttttttttttccattcattcaaccttatatatttgatccccttctcccaggtgcgagtctattattgaggaactgtgagctccttttctagagcttccttcccatttaggcggggtgttcaaaggggttccaccgtcaacttaagttaaggaaccccaactaagaagaaaaataaaaaaaaagaaaaatatgtgaatcacagatcctaacatgcatcatccatgtcccaacaaaagaaattgctcgagttctcaaatggatagcatgccaaggtcggcgaagccgttgtttctcgctgaaggtcaaggacgccacagctctcactgcttgccgaggctaaggctgctgctcctatgattgtggagatcgagagagaatggagacaccaagagggaagagagtgtggttgtggggatgtatatgtagaagataaggtagagagagagagagagtggatgtgcaggagataagggagatatcaactcgagtaaaaaaccattagctcggttggctcaagtaccagttttacttaaagaccccacactaatgagtaatgactaatcatcagtgacgatttataatagaaaatgacactcataagtagactacttatctatgtcggttcttagctatattgggcacagattgggtgggtggatgcgaaactccttatcagtgccaggttttcttcatccaatagtaaaaggactgtacgaataagttgttctgtagtagtgtaagtagctaatcatatccatcttgtatacgttgtcatacaataaaactagacaaggactctagccagacattccactcgtaggtatcgcctacacgggtggcacatgggtgaaacctagctactaatcgttgtcaatctccaacccgaccctcatagtctcagctagccatgggcggcatcccttttgttgggggtgtgttgaaatcctcggtcgtgggagtttgtcaggcctcctttatcatccgtgggcggacatcgatggaaagatagtccagtgtacctaagtagcagtggatgcggagtgcgttttttggatcttgtagcccaaacctagatgtttgttgtcttctattactctctccattattgaataattgacattttgaccatagcatataaaacaagacaacaaaatttatggccaatttgcccttggcaattgttagaagatgacgctaaaaatgaataaagttgaggtagggaaaggaattgagggaaaagacaactatctagatgcttactctatggtggaagatttatttaggcccaaaagtgtagatataggatagtaggggcaaaattgggattttagtaataaaagtgtggtggtgacaactattttgaaacaaatggtttgatcaaaactatcaattattcaaaaatagaggtataggatagtaggggcaaaattgggattttagtaataaaagtgtggtggtgaaaacaattttgaaacaaatggtttgatcaaaactatcaattattcaaaaatagagggaatagctattcttcagcagcaaaccggtagcatcactggaattgactggaagctatgctaggtctacaacaagcaggcgcccaggcaacgaatccatcatcttgctgacgcgggtcgatggagttcaagtgcgcttagtaattggcgtcagtggggattgtattctggactcttaagaggatatccccttgtttctcctatgtcatctatatagttatgaaagaaaaactcaatcatgttttttttctttttgcatgttgatcttggatgctcaaaactagttggaaaacgactaaagtgtcgtacattaatacaaaagtagtatttatgggagggttggtgtgggatattaaaggaatcgaactcattgttttgtggacttggaataggtgagaagatggaaataaagttatttttttgtaaaaatgaaagaggctaaaagcatgcttattttggatggatggagtatgcttgtagtaaaaaatcctagtctaactgtccaaacaaactcaacctaaaaattgtttcccgtgttaatggtggtgcagtggatatcttagtatcttattactactagaaaacaactcgttgtggctgtcgcagctggtggatgcgcaattgctaatctctacgaacgcagtttctaaaggaaaataatcctaattaattaagagaccgtgtatttttatgcagttgggatagagacctatctaaagatgtaaatattagggaatgacctaatatcaaataattagaaaatgttaggcttcgagcctaggtcatctagcccactatcctgtggagctgcccaaacaccctagacgtttctcggatagagacctatcttacaatacatgtttgttttgtttctatagatttctccatccatccgtgatttcaattctactgggtggtgagtggccgggattacattaattattttagctagctgccatgacaatttacttatggctcattcaaaatacatgaatttcataggatttttatagggtacacttcattcttttaaaattccgataaaattgctccaaaccaaataagcccttagtactccgtacgtttgtttttttctcaaaatgtgttgttgattacttttgtaatggcgtttaaccatccatttcattaaaatttagtgcaaataaaatgtgaagtcatgcttaaaatacttcgtaaaaaaacaagttacaacaaaataaatagagctcatataataccttaataagatgaataattaaaagtcatatttaaaatgtgtgatcgtgtcaaataattttaatatattatgtgtgtatgtacgcaaacctagcaattaattagtttttttttataaaagagatcaggaatggatcccaagtgtacaatgtgtagtgaactagtgattactacatgtgtcggccggagagagccaaagacaatgagctttaattattaatttgtttctaagcagttaataggaaggatcgattttttgaagcacttgctagagctatcctagcttgctcccttatattagtttgagcagataagaatcgcagctacgccgggcccaacgacgtggacggaagatatttgcatttgtagatacttgaatctatcgtttggatagtgctcccctgcactatgccatgtaccatatctttcatagtgtcaaagcatggggaacgatgtgtccctgtccctgataacttcgatcgagtgccatgctcacattcatgtactacgtgttcattcattgcccgttggagattttttttaagcgttttggcaagctaattaatcaagtccatgttgtgcttgttcttgtggggtcgatgatatgccagtatgcacagcatgcatgatagaacaaatagcatgccaatacccatctctatgcatgcccgttcaccactttgaatgtgataggttgtggtggccaaatggcacatattggttgctttgtaaacagttggtaaggcaaacacaaatggctagtcatccattcaaataacgttgtggagtagcatgagaatgccattagtcacaataatatggtaggacattgtgtcagaaatgatactagatagcatcaaccttccatgacttcgtatcatacactgccggagaaatgctttgtactctcggattgtaatcctctattgttccggttatgcaaccgaaactagagatccgggaataaagatatccatctttagtcccggttaaaataaaccggactaaaaatcattgttagtcccggttggtaggactaagggattttttttctgtttccactgttgttttgttgtttgcatctcgtgcacaatcgcacaaaaatcacacaaatcatacacaaaatcacacacataaatcatccacaaaaatcatttacaaatcatacacaatacatgcccatccacaatccacaaatcatcacaaaatcatccccaaatcaaaaaaaaatctacacatcaattcactgtccatccacaatccacaaatcatcacaaaatcatccccaaatcaacaaaaataaaaacctacacatcaattaaaaaaaataaaaaatgctccacaggtcgccgccggcctcccgccttcagccaccgcccagccacctcccctcccggatccgacggaggggaggccgccgccaccctcgcatcgccccagcgccaccgcagccgccgcctcccctcccggatccggcggaggggaggccgctgctgccgccccgccacttccccggttgcttggctcgccgcccgccggctagctcgctccgccacctcccctcccagatccggcggaggggaggccgccaccgccgccgcccctcccggatccggtggaggggaggccgccgccgccgtcaccgcgccgctgagagagagggagagctgaggagccagctaagagagatttttctaagtgtttgttatatagtaacggggcggggagaacgatgcggagaggctgatccggatttttattttgtcccggttggtataaacaaccgggactaaatattgatctttaccaaccgggactaaagataatgtaagcatgacgccggcctgacgatttgtagaactgggactaaagatcaaaatgtaccctggctttttgaaccgggactaaagttattctttagtcctgtttcttacttagaccgggagtattgtgaattttggtcgaccgggcaaagatggtttctccagtaatgatatctacacatgaactctcgaaaaagcaccctaatttaagagatatcatattacaatgtcatttgtatttgggacttgcatacaaattaaacattgtcaaaataaacgtctgtacgtgctaattaatttttttcttatatgagggcaaaatgttgtatactcctaataaattgcgaatatatagcccagcatggatgcttggtttgagctacgggagcaaagttggaactagctaggttgcctcctatactaattattgatcagccggggggggagggtttgttttttgtttctggaaaagtcaggggggatttgttgcatgtttgccattataatgttattatagatgtatgcaggctcaaaaccatactttaatgccctttttcagttgcacttttaatgaatgaaaaaccgatggtgtgtgtgtgtgcgtacacatcatatggtggttatttaattgggtgttcaattataacatgcatgaataattcttatcttgcaatttaacatagttatgttaatatcacatcaatgcacatatctcaagctaattttagagagtatgtgcaaaacatgcaatagttggagcatctctatcacctctccaaatatccatctggccagcttgccaaatttatctttcattccaataaccttttcatttcactctcaatccaacaatgggtatcacatgtcaccctctctttacttcttcctcccttcttctatctttcccatcccaaccatcttccctctccacccgacgacagtagggggcgacaacgacgaggtggccaacaaggggaagcagggataagggcggggcaggtgaggggagataaggcgtcatggtgttactgctgccgccagcagtgggaatcgacacagggaagagcaagaaggggcggtgacgcacgcaccagcaatggagatgcagacaatggcaatgcggcggaggttggggaaaacggtggcaacgacgggctatggtgatcctctcatcctttgttggtcacctcccttccgagctcccggctcccgcttctgccactctgacacccttcaccgtcgcgtgcaggccaggccaagccaggccactgcctccacgcggcccttgtggtgggagttgtcggtggcgtggggaggtgattgccgagtgaggagtcaagcttagggatgaggaggttaaaggagacattgacgattggccttcttcctttacagcgatgcatcagcgcgagggtgggcgttggcagagaagagaggagacggagaaacggattgaaggtgggactgataatgcgacccttcgtttggtaaatagaggagcctggccacatttggccacccgaggaactcgtttggaagagagttttttcactgtgttggctaaaatttaatttgaagagccatctaatgtggtgacagttgacagaacatactgttgtattccggagggctgacgaacctgctgatctgtgccaagtgtagccggtcttagggtcactggtacaaatagctaggccaggagcatcgatctaagacaaagatgtgttggtcttaggttcctgaaaatatcagccggtgcgccgtgcgcgagctgttaatcatcaaagcaatggccgatgtgggtagcacaaattattcggaaccaactttgggcccgtttagttcctcaaaaatttttcccaaaaacatcacatcgaatctttagacacatgcatgaaacattaaatatagataaaaagaaacactaattgcacagttatggaggaaatcgcgagacgaatcttttaagcctaattagtccgtgattagccataagtgctacagtaacccacatgtgctaatgacggcttaattagtctcaaaagattcgtctcgcggtttccaggcgagttctgaaattagttttttcattcgtgtccgaaaaccccttccaacatccggttaaacgttcgatgtgacacccaaaaatttcctttttcccaactaaacacacccaaaatgttagggacaagagaacagtaaccaaacgtactgtcactgtttggttttactaatcagtgactttgtagtccgacatgacatccaacaaaccccgcctgacattgccgccgatcgagaggatctgggggattcgctctagtaggcactatcgcacagtgaccgcgtctctgtcttctagaacccaatgcgacgacctgataagatcgcattatcacatccatagttttagtatctgtcacaatacacgttttgtcactgaagaaaaccgaacaaatacgtgactatcacgggagaagcgccatgtagttttagtgtctggcgccggaggtagcatcggtcacaattcacacgtcgaactgtgatcatgcggagggctttggggtctgcagcttgggttggaattcccctcaagaggagaacagagaacgacagcatttcgtcgctccccccacgacatcatggcagaaacacgcccgtgaccaccaaataatgtccacccaattggcctctaatccatcagaaaagcagagcgaaaaaatagaacattgctagctagtggcaccaccaccaccactgcaccagtactgctacatcgggatagattgctacgagacgagacactattgtccaacgaactcaagttgattgcacggctgcgcgcggcgtcgggacagagctccagccgtgcgcgcgcgcccaccactgatcgatcgcttcccacgcccagctgacacgggagctagggaccgtggtgcacgcgcggcgacgtcgcggctggcaggtcggacactcagaccacgcgggcgccctccatgggcgacggcgtccacgcgtcggaggtgcagccggcgtcgccgccctccttggggggcctcgctggcacgggccggaacggcgcgccgctgcctcctgccgcggtggtggcctgcatgaggtcgagcgtcacgtgccccgactgattctcgtgctgccctccggcgccgggcggtggcggccgcgcctgcaggtgcgcgtgccagccaccggccgtttcggagcccgggctgcggcccgttggacggccagctggtggcggctgtcggtcggagaagaattgccacgagaggagggccgcgcggttctcggcgatgagctcgtcgagcgccgcgcttgagcgggcggagatgtcgggcgtcggcatcagccatgggccggtggctctagccgatgacagaagagagagagcaccagccgacgacgtcggcaggccgtacggcgggaaaccgtgtcccagcaccggcatacctgcaacaacaacgtcgacacgttattatgcatatcattgtgcctacagaaatgtggccatctgttatagtcatatcaagaaagcataatgcacaccatcagtcctaataacgaagtggttactcaaccgcaatcatttttgcatgcttgccctgatcatttgcaaccaaatttacaaagtttaaaaccaaccaaccatgcatgttcaccgggtacaactaattgatactatactatatatctttacacaaactgatcgctacctgatcttccacaacatcatgtctatgtgttgatcaaataacaggtttcaagtggtcaataatgctgatgggctttgggtcactagcatagtaaaaacgtgcactcgaccttgatgtcaagtttaggtccatggtaatacgtactaatgttattgttaaccaagataggcccattatgctgttgttgattatgttgacacgaaagtttgtggtggttacgattgttaatgtctttattgtttgaggcaactaacttaaatcttgcattccataatatttctctgtaagacagccagaaggacctactccaaatcaaagtccacataaatactggagtacataagttatcacagaatataaggcatgttcatctacaggatctatgtcagtgcagcaggagtaccatgtactgtattttctactgcaggagtaatagtttctcagaacaagagaaaggtagtggtagactaaaaggagtactccctccttcctataaaaataaatctatgaatctggacagatgtatatcaaaattcgtagtattagaataagtcatatctgacactatattgtttttttatgggacaaaaggagtatacatatatacaaggtttctgaactgcagagccgtgcttacctttgaaggtcagtagtacaactatactcatgaaagcatatcaatatcaatcaatacacgcttgaatatcctagaatgccgctatgaaattcgaccgccgtatgtccaagtctttcggccagtcccgctatagcactataccttcgtacagtaactattcgtaattaactgtacagttgtacgcgtatgtatgtacatgcgtactggagtagtagtactagtacgtagtagtatagatttccgtaagcatacaggctcttgataaggagtggaagatggatggatgaaaccactgtttgccgtgttgcgtgcgcagcgaccacccggcgcgcgggttcctgttgatgccatggtgatcatatgcacggtcggcctggccagtggccacgcagccactgccactccaagcaagcaggctggctgggccggccaggcaggcagcgcagtgcacataaagtcgtgcattaaaatctgtgctctcagcgtctcacacatcccgatgagctttttggtgcgcacctgcagctctccccttgtttcccggcatcaaaccaaccagtactcctactactgggagtggtacgctcctgtttgtgcagctaacctgcctctccattggtctccctaactattactgggagtagtacgtacgtactacacgtactagtagtatgatgattaatggaactgttacggccgggacgggaggagtttgttttgtgtataccgtgtgggtgcgcagagcccctggccatggcctcgctggcgttgctcctccgccgcctctcgttgtgcccggccagccgccgccggcagctcttcttggcgtcgtcaaactccgcgagcacgtggaacctgcgcgtacaagtgaaagaccgctatgagcacgcgtgtagcagagctagacatgtgacgtagatcgtggtgattgacgcaccggctgcattgctggcagaagcgctgctcggtgccgtgcacgacgaccctcggggccttggcgtgcacctcgcacaccttgtgccgccggtggtactccttgactccctggagcgtaatgtcgcacccctccacctggcaacggggcaccaccggcaccgccgtcgccgccttctccttcctcttcccctgatccgcggaaccaccaccgcctccgcctccgccgccgccgctcccctgcgccacctggccggcgccgtcgccaccccagaagcacggccgcttcccgagcttgaggcaggtcagcccgccttgctgttgcatctggacgtcgggcctgcatggcgccggcgggaggaacggcggctgcgggctaggcggcgaggtgacgacgggagcccagtgcatcccaacgacaccacgtggtgtcgccccgcttccgccgcagccgtttccttccatggtggcagccgcacacggacggacctatgtgtaaacgtaccgcagctaagctagctagcgtcgttacacagcagcagccacctggtcgcgcgggcttggcttcgctccggccgacggcggcggatcgaaaactagcgccgattgggaaaaaggctgcggcggcggttgtaagtacagcgagtaggtttgccgcactggcgttccatataaagcgaagcagccaggcagcgagggtttgtgaagcgaagcgcacccccggggaggagcagcctactggcgaggaagcacgcgccgtactgacatgtgggatctcccgtcaggattggggtgtgtggtggggtcacgagcgtggctcgtgacatgtggggccaccgccacatggagctgtgtcattgacaggttcaatcgaaggcgggccccccctcgcccgctgccgctgcctctgccgctgctgctgcgccgtgacatgactgccacggcattaaacgccgcgcgctgtgtgacaatacgctcatccgcgcaccgcgcgtcaaccaaccaaccaatagcgcgcgcctcccccgacactgacacgccgggccaacacctctggtgccaccggacgagccccacctgtcggcgagccgtgccccgcgtccgtacggatcacgggagccacttgcgcaaagatcccacccatatccggaaccggacggcacgatagattctcccagccaacgcaccagttgacaaccgcgcagcagcccacctgtcgacgggcccattctatccatggccccacatgtcatagaggcatccacagagctacgcggtggagtacatgggacatggggtacgtacctggtgggcagtgaaaaaaaaaagcctgcgaggcaggtcgtgggtgtgtacatgcatgcagcgcgacgggcgggggtggggcccagtacggcggtggtccagttgtcagtgtcagctacagggcggcccagtgcctattggctggggaatggggggtatgtctgtgctttgggggaaataacatccccgtgctgggcgttggggaggatacggtgcagcacgtacgggtacgcctattttggccgcttcctgcgccattccctgcgacggtgctgctgcctttggctgcctcacctcacgtccttggttactcgcgcccgcgcactgtactactgccgctgacaccagtgttctgtttcctttcttcattttacagtactgtactatacgttttactacccctagatgttctctttacttttacgcatgtgcagcaatgcaggctgcaagaactccgttgcaagttgggtggattcgttgcaagttgcaagcggctgctagctgcctccggtgcctgctgttagggtggcagatgtatgtgtgcccagacgatgatcggaacagctgtgctgtgcactgcatgcgtatgcatcgctttttcagatggcagatcagccttcgtgacgtgtagtaacacgttgtgcagttactagtgggagtaggacaagaggcgtggtgtagaagtgtccaacaggatgagatcgtagcgtataataaagtggatacctcctcccatgcaagcatatcgtacgatcgtagcgccctcctaaagacgctttacaccatctaatgcaaatcctctcacttttgcttggtttcctagcgtctaaatataggcttgtccgtattattgtcattttgaccgtatcaaattttgataagacaataaactaaacgcaacgcaagaatcttcaggaagattgcatggacccctcaaactctaatcacaaatataaaagaggaagcatgagcctagtaaagcaagggcagtaaaattgaaagacactacatagaaaagagttcgatggcttggaagacactatatagaaaagtcttttatgggcatggttccctttcccatgcgggcatgcccactacattgtttcattttaagcttttattcaccatctctattataatatataagacaaatattcttcctttccttaaaaaaaaactaaacatgatatcaccaacttcatcctaccaaaatttggtagttttggaattccctctcacaaaaaaactatcaaaaaattagaaaggtatcaaactaacgcacatcctacgctaccacaatttaataataccaaaacttgagaaatgttggtattgctaaaattcgataatgttgattttaacagcaaagtgaaccagagccctctgcatattctacctgtctgccgtgatgggccaatgctgcaacagcgactaagcgcggtttgccgtctgcggagtgctcaaagcgaacggcccagctcgcgttctagcctaacgttttcggtgtggattgaattaggcccatgtagaatacacttgggccgtcacacgaaacggaatggaaagggcccaaaaagcacatggaccttatcgctggtcctcccgtccccgttaacaccaccggccgcctcgtcctctcgccatggccgcaccatccgcgagctcccgtgcctccgcgatctagcgcggcgcggtggctctcgcacccccggcgtcgacggagcgcggaggaaggcgggcctccgtacagaggcagtcgaggggcacgggatttaggggagaggggttggggggatggggaggaagcctgatccgtcgaagccacactacggtggcggcgcctcgccgagggcagcgaggaggacgcagccgtcgccggttttcctgggaacggcgctgttcgtcctagggtttgtgtccctcttcacgggacacatcgttacggacgccgactggtcccggatccggagccggtggcgatccaagcaggtaattttctgacaacctagaaggtctgtactgtataatttgacgggatttatcggcaccacttagaattcacgtgatattcgagtgcaataggagtaaatggacgtagtttgtctgttttctggggtgggcacgcctataccacagcatcgttggaaactaactgaaagctactgaacggaaaaaagtttaatttttgggatatatatatagttgttgcatacggtttacctggaaatagtatgcaagttgtgggtagtcagaggttttacgagtcactacgtgagcacctgcctgataagtccttaaattattgtttactgttgtcctgtcattatcagcatgttatttgtctcagttcttggtcaatgcttccttacaacgttggcaatgtgcaggttagaaataacgagcccataaatatttggaaatcgaggtattccaacttgtactatggatgcagcaggaggagcgtaaatttcagatgttagtttgcttattaaatcatcctcccttttggacaattataactagatgagtggaagaatatttaacacagtgattccatatgttcatctttcagctgctgtgccggagaacagttctactggttacttgctgattggtactagcgggggactaaatcagcagcgcataggggtacaactgtatttcaactttttattgcgttgctttgtattatccattgtattaccattacgatcttcagtttccagataacagatgctgttgttgtcgcccgaatattgaatgccacacttgttgtacctgagttagatcaccactcattctggaaggatgataggtaagttgagaccttaaaattatacttcctccatttcatattataagactttctagcattgcccacattcacatatatgtcaatgaatctagacatatatgtgtttagattcattgacatctatatgaatgtgggcaatgctagaaagtcttgtaatatgaaacagagggagtaggacaacttctgaagttcatcaacccccttgcacgatggacttaccctgatatggtacgtgctatatgcagcgacttctctgacatttttgacgtggactggttcatctcttacctatcaaaggatgtaactattgtcaaaagaatcccttatgaggtgatgatgtcaatggataaactcccatggaccatgcgtgcgcctaggaaatccatgcctgatttttacattgatgaagttttgcctatccttatgcgaaggcgagtaagtaatacattgcttcatattgatcaatttatcatctgcttgtgattgtttcctcgacacattttaatcatattgtgcatcttggaagaacatttgaattttttttttacttgaacattggaagaatcaattgtttgtgaggtatggatagtttggtagcttcatatgtcaattatgaagttacctcctgattttctgttttcaacactccctccatcccaatataagtacaacctagtgcagatgtgaaatatcctaggactatgatgtctagattcgtagtcctaggatatgtcacatctatactaggttgcacttttattgggacagagggagtatgagtttaggagatgcaataattggaaacatctatatgaaatcattagacacgtatgtggaatgctcgtgatatgtaaaagcaaagaggtttgcctatgcacttaacagtttaattttgcaggctttgcagctaacaaagtttgattatcggctcactaacgagcttgatgaagaattgcagaagttacgctgccgagtaaatttccatgcattaagatttacaaattccatacaaactctaggtgagaaattggtgcgcaagctgaggagcatgagctcacgatacgttgccgttcacttgaggtatgcttttacttgtttcttttgatttagtttctttgaaaatggtactactgagtttttttcccctgaaagtactcatatggagtgttttgaataacctctttacttttgcttgactcctcaggtttgagcctgacatgcttgcattttctggttgttactatggtggtggtgataaagaacggagggagttaggtgaaattaggaaaagatgggatacactacctgtaagactctgaaacttggtgagcttaggatctggatatatttttgtcggtattgcacttcctttttgtggattatttcttttgcactgataaggatgtgttgggtcagatttcccttaaaaactattgagtgataatggctgctgttagttctgagtgtccatgtattcttttgatcaattagtaccgatggatcaatatttgaatgatgaaatgatttagactgattcctagcaggagttgagcgctgaggatgagcgcagtaggggcaaatgtccactgactcctcaagaaattggtttgatgctccgagctcttggttttagcaatgacacgtacctgtatgttgcttctggagaaatatatgggggagaagaaactctccagcctctgagggatctctttccaaactactacaccaaagaaatgcttgctgggaatgatttgaaaccgttccttccgttctcttcaagattggctgcaattgatttcatcgtatgtgacgggagtgatgtttttgttacaaacaataatggaaacatggccaaggttttagctggacgaaggtatgcatctatcttctaatggatttgctaaatgttctaaatgtaaagtatagttgaatgtaaacagataagccttcaggtatgatgcaatccacctgattatactatttttctccctagtgctacgtgtgaccctttttcatgtatttttcgtatgtgtctatcgttggtggttttgtttcatctaatggtcattcatctctgtctacttgtaggcgatacatgggccacaagagaaccattcgcccaaatgctaaaaaactcaacttactatttaagagacggaaacagatgggatgggatatattttcacagaaggtaaagaaagtgcagaggggactaatgggagaaccggatgatatcagaccaggaagagatgatttcaatgaatttccatcatcttgcatctgccaaagaataccagtcaatagatcagtcacagcgcgagctgaaaacttgtgagctctagtgtagtgaggcagacaacttgagaacggagaatgctgggtgattgagcacgtcccttgctgcactggggaaaatacatgtttgttaagcaaagaaaacagggatgtaaacccaatcagacagaagcagacgtggtggataaatactcttaccggctttaactcatggcactctggtagtctggtggttcagacccagcagaactggttagtgtgcagcgatgacagacaaactgctgatttgcagcttcagtttggttccactaattgttaaaactgtggtaaagaatctgccacgataattgtagtcattagctcgatatgctatccctgtaaattgtacggtatacacgatcaattatttggatgtgtgcttcaatcgtcccatcttctgtctggtagaacctcacagcaacgaacttatttgctgaagggaaatgccattgtaccagaaacttggaaattgaaaattgcggtgattacgtgtaatttatttccttttaacgagccagtctggttcttttgaagcaatatgaatgtaacgtctttgttgcatggctgtgcagtactaatcaatgactcagcaaatctaatcaaatcgtcatcaaacataaatttcatgggattgctattcaccagtcaattgatttttattttcttaaatatcagccactggggtagatgacaacaagtgcattccttgttggctgggtatacaacacagatgggggaaatttcgactcacagatgtaagtatgcaacatcgatacacaacataacaaatgctgatgaaatcatgagatgcaccgtgatagcatcaccagctaacaacaccacccatggatcatcgggatcatctactgcgtgacaatgagaaacatcactgacgaaacccttgcaacgatttctttttagtaaacattaaccgaagctctgcttcggacctcggttgcagttcagatcagagaaactcataagcaatggacttctcttccttgagctcggtcgccgaggtttccatcttggagcgtgcaaagtcgtcaatctcaagacctggagtgcgaacaaagcgaacattcttaggctgatctcatcctgcaatgtatctgaatcacaaggattccatgagctcaccctgcacgacagaccactcccccttctcgcaggtcaccggaaacgagaagaagacgccctcggggacgccatagctgccgtcagagtaaacgcccatggacacccacgtaccctgatgaggagaggacgagcaaatgctggaattattagatgtgatcgatcggaattcggaggaaggtatgcaggggaggggatatggacctttggggttccaaggatccagtctctcatgtggtcgcatgccgcgctggcggcggacagcgagctcgactgcttccgcgccttgatcaccgccgcgcctcgctgctgcacgtcggtgacgaactcctccctcagcctgtcgacacatggtggtggagccactatcagaactcgttaccacacatgcatttttacttgacgagttccgtaccatatctcgtcggcgatgagctccctgacgggcctctcgccgcggtcggtcgagacggtggcgtggctggcgtcggggaactgcgtggaggagtggttgccccatatgatggcgttcttgacgtcgccgacgtgcacgttcagcttctcggcgacctggccgagggcgcggttgtggtcgagcctggtgaggcaggtgatgttcttggccgggattgccggggcgaactccttcaggacgagcgcgttggtgttcgcgggattggccacgaccaagacctgcaaactccggcaagatcatgctggtttgactttataatagaaatcctaataggtacttcatacgtttcatacgtttcataatgtaagtcattctaacattttccacatttatattgatattaataaatttaaacatcattttctacattcatattgatgtatatatctagattcattaacatcaatatgaatgtgaaaaatgctagaatgacttatattgtgaaatggatggagtactagttaggaacccaacataaatatcaaaagttttaactggcatccgttaggcagcaccgataataatagtcatcagtaccgattacacaattgaaacctatatcaacatataggtgcctgtttttaagtgagggccatcaacaattacttcgtcgtgataaccagtggacccacaccaagatgctagttgggtgaaataaccggcacctataatttgcgtgaagtatagtttatttgttttttaccgtccaatggccggtacttgtaccgggcggtaccaaattcctagtcgttggatctggcccgatccaacggctggtagagtttgataccaattctgtccctggtacagtaccgacctaagaactaaggtggaagggcaaaaatataattatgtgcaatagatggatgtgagtcgggcagatagggtgatatggttcccaccaacaccactgccgccaagagtgtgtcaacctcgtccacgctgcgccgtgaagaactccgcttcgtccgcccctcaccgccgggaaggactcctcctcctcgccccctcggcgccgggaaagaatcctccttctccgcccgtcggcgccgggaaggactccttctcggcccctcggcgcagggaagaaatcctccttctccgcccaccagcgctgggaacgacgactttaactctgccgccctgattgagcgcatccctgctcattttctctcccgatcctacccatccgggattgaacggtcggatgagttttggtaccgaccaattccagtaccgggcagtacaacttggtggacggtaaacatgtaaacatgctgatagtttataggtgtcgttttctattaccaaccggcattatgtatgaatatgggtgctaatcgtctcaaacagtacctcgtgggtgcacacttgaacggcaaaatcactataaatattggttctagcccgtttcttttttactgttccgtagtagcagtagtgttttagcatagaaattgtgtacttgcgtatacgtgatgcgtcgtcattcaccttgcagtttggggcggcgtgctgatggagcgcagaggcctgggatttgtagattgtcacgttcttgctaatcaaatctttcctctccatcccgtctctcctcggccatccaccgatgacgatggcgacgttgacgcccttgaacgcctcagcctcgtcactcgtcgccaccactcctacacaattgaagcatcatgttttatactcgggcgaccagcgcaacgagggaaacttgaaggtacaaggtcacgcacctctgagcagcggcagcgcagcgtcgatcagttccatcctgacgccgttcagagcattggccgcgaccggcagatccagcaggtggagcaccaccggctggtcggctcctagcatgaggcccctcgcgatcatcgcgacaatggcataccctatttgccctgcaaaaaacagcacaaaatgtcgtcagtgaatttgttttctcgacttctggtcgtatttttggtttagctgcttaagtgtttgattagcttccgagttctgtattacctgcggcgccggtgacaagaaccttgacaggcttcttcggctcatctctcagtaaccacgggcaccattttgccagacgctggaagagggaattggatgacatcatggttttttctctgtgaaatttgtatgtggatgacaaattttaggagcctagctttgatatgggttcagctgaagcaactcatacaaatagcaccaagtaggccatacaccatgataccttactggcttaccttgatgaacttgatgctaaaggctcagattccatgctgatttctgcaagaaatggagcttcctggtgcaaactgcaaagcttggtataatgttgagaaggtgaacggaactaccaaccttggctgatgtgaattcataggaagccatttggcttattttaagcataagcgaaacggcatatttgcaaacaaaagataatttatgaataaaacttttatatatgtgttcttggcgatttaaaagcaaaagctgaaaaataaacttcaatgaaaaaactttaaaattaactttaaattttagctaataagtataagtataagcaaaaagatgagaccgatagtatgaacttgatggtctcaagtgattttgacaataataaattttacaaaattacagatactttgggggtctaattatcacaaaactacagatttaagaatgtttatcacaaaactacagatttaacgtcaaacttttcatggaactacagatttaatgcaccatatcagaaaactatagatttagtgatgaagttatcacagaactacatattctagacttggatcatagtattattatttattaaaagttataaaatctgtagttttatgataaatagtttttaaatgtgtagttttgtgataaaatagttgttaaatctatagttttgtgatataatatcttaaatctgtagttccgtgataaatttaacactaaacctgtaattttgtgaaacacgttcttaaatgtgtagttttgtgatagtttgatcaaattatatgtagtttcgtgaaatttactcttttggcaattaaggaagatgtgcgaaactgcatgcttttcttttctttggtaaacaaagtcttaaccctaatactgaactgatacaagtacacaaaagtttaatctgcactggtacgcgtagaccataacagcaagcaataggatgcctgattcaacaatcaactcagagagaaagacaagggtttaaaggctgtgtttagatccaaagtttggatctaaacttcagtccttttccatcacatcaatctgtcatacacacataacttttcagtcacatcatctccaatttcaaccaaaattcaaactttgcgctgaactaaacacagccaaagatttatggagaccgaagagcatggccttttgtagtattgtaagttcaagtgccttaattgattaatgacaaatctaactatatgagactaatcgtttcatttttatgagcctttctttgactagtctcatttggatacaaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggagagcttattttatatttttgtttattataagatttctatcttgatttgaaatcatttttcatctcatctctctatattgtttatatcgaattattatctatcaccaaagagagaaaagattgaaagatcttggattaaacaatttgcgtaattgttactttggtgatacatgataaaccgatgtttatgggattaacctctcttttgcataagttgtctactaggttatttcccgataatgagatgcggaagacatgcattcttttgtgatgtaccttaatcatgacaaggatgaaatgcatggagataaaacgatatgtaccacttcttatctcctactttttgataggttcatatatatgatttccatgtaattgatatataagtgtgagactaatgtttactcgaatgttatcttatttagtctcatttacattgagaacatggagatcatgaaggtatatgttttatgttggtctacatcattacttcatatgccttctctatatgtataggataaatccccattggtcattctctaattatgcatacacttgcatctcttgtatatttatttgtatgcatatatttagggggagcaaatcctatacatttattgtgcatgttctagatctatgttgttcacctattatttatatcggatatttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcacaaggcaaaggtataatgtagctaagaatgttttcttagtcttttcccggtcttggtgtttggtgtagaccggatttgctagataggcgccgtactatcaataggggtctatgaagcgagcttgttgatgatcttgtgccatattagttcatatgcatgtaggtgcattttgtgggtttgtctaaacaagtgtgatgagttttctcaagtcctaaaccaagagagaagtaggcatgtccaataggagtgagtgacatcttgtgggtatgtccggtggatatcctttggagtgtgagccctttatccttgactttagttgtttttcttggatggatttttcatgggttggatggtcctttgaataagctttccatagagtccaagaacgccaaattccgagacccgagtcaagagatatcgccgttttactaacggtcggttgagctgaaaagtgacatgcggtctgaccgtgggccttaggccggtctgaccgggtctgttagccggtctgaccggtgtggtaaggccggtctgaccggccccactggtctgttgcactgatctggtttttggtggcgatacagagccgctagagccgcaaccggtcagaccgagccgacggcggtctgaccgagccatggacggtctgaccggccactacactgcggtcagaccggccaggttgagtgggcccaataatttccctgttctagccgttacaaagtggtccggtctgatcggcctcacaacggcggtctgaccggcagagcacaaagttggggatttcggttccaatggctagttttggtggttgggtatatatacctactccccagcagcaagggtaaggttttggcactccattgcattatcttgaaccattgcaagagctctcacacccttgtgcacttagtttatctagtgaggtgttagagagtgagttaagccaatccaagtgcattgcttcattgctagtgtggcacctgatcatcctcggcaagcatcctagatttgttactcttggaggttgccgcctcctagacggcttgtggaggtgttgcccggtgacctctccgaggagattgtggaggaggcccggcgccgtttgtgagtggtttggagttcaccaccttcggagtgaaggaagaactaccctagtgatcgaggcttgggtagtcctctccgtgggccggctcccaccttgcccaccccttgaccaagggggcgtgcggtggcttcgtggttgagcggtggagttgggctcgcctcaacggggattaggaaaccggcgagtttccgaacctcagtgaaaaattccttgtctcttgtctcatttatttgttgcatttacatttgtgcaatttactttcatagagacatatttgagcccatatcacctatgtttgcaaaacttaacttagttgcttagttaaccttgcacctcaccttgcctagcaacataggttagttttgtttaagtgccattaagttttaaaaccgcctattcacccccctctagtcggcctccttgatcctacaagtatatggcaccaaaatcttccgatggaagcaaatgttattgaattttttttcattccctaaaggtatgtccccacgtttgtttgtaagtatgaaatactaatcaaatagttatagaacactttaaaaataaaactattggtcaattagttatttatcatcctgcaaaaaactaatttcaaacttgatttacaaaatgtgaaaaacagaaatacacactgaatactactagtcagatttgtattccaagttgtctagttcgatttaaatttgcatgttggtgtaatgatatctcacacaattatttatgttataattgtttttagaatttttcatagccaggcagtgtatcaggtgaaaaccaagcatcctgtgcaaacttggaaactctcaatcaagtccacaggatgctcatccgatggctagggacagaggtgggctaattttgcacttaaccgcccgcaattagccatagtaatctcgttttttttgcaaatcaccccccgcccaatcccagcgtcgcttcgtgtggccggttggccgccgcgggcgtcatttcgtttggccgccgccctccgcccgcgaatcgctccctcgcgcctggccacgaatgcaggcccgcccagccggctcaactccgtcactagcccgctgaggtgcgccacgcgccatcgtttcgtgaggcccgccgaggtgcgcctcacgaaaccgtgatggagtccagcgtgtgcaacggcatggagtctggcacgcacgacatcctttctacgcacgcacgaacgcccacttcggcattggcagtggcagcccttcatgccgtcgttagtcgtttctcctataatgctttcatcttgactttgatagaaattattttgatccttgctaacgtgcctgcatgcagtggatggtgaacctgtagtcactgttgattctgcctctgttgaggctaccgccatggatcatgccgtcatcaccatcgacgccggagttggagtccaccttgaacatccaagcacaccacagccaaaatcttctctgagtataatagtaagttgcaaagaacatttgaacattaggaagagcaaggagaagaaggctggaagtggaagtaaggatacaaataaacggaagtgtcaaaatgtaagcaagcagtggatcatgatgcacgcaattgcccaaacaatgttgttggctgatatttcaagttcccgtaaccttttaagttcaattgagcaaagtactattataaacactttttttactagtggcatcattcagcttattgctgctaattttcagatcaattgtgctaaattttgagttaatcattcagcttttggattttcagttcactgcgatgttgaaaaagtttgacccaagaaggcaaattgaaaaagtttgtctttcaaaggacaatcttcactgtgactgtaatttgaacacttgaaaatattactgaatttagaccatgcccattcacaagaagttcacagataacaacattcatattcacagagctgctcacaggtaacaacacagatgacacaattcacagaattttgtatctcttgctaggacagataataacacagataacttgctaggacagcagcaacagattcctgtcaacatcttcaatctacagcaacagctcccaaatgccagaaaatgactatgcagtagcacggctggggccggggctgttgcggcggcggcgaatcgcggacgagggagcggtgactcgcgggcggagggtggcgaccagacgaaacgacgcccgcagcggccacacgaagcgacgatgggattggcggagggtgatttgcaaaaaaatgagattactatggctaattgtgggcggttaagtgcaaaattggcccacctctatccctagccatcagatgagcatcctgtggtcttgatcgagagtttccaagtttacacagaatgcctggttttcacctgatacactgcccacataaaaaggatgagtgcacatccccttaagggacaaaatgacattcccaatgtcatggaactggtttactgatgaaacaccaaaccaggtgaaatgttatgacctgtttaggtgcctatctccttctgtaatgttggagatatctaaccatttccaaaaagttatagagattatgtgagcacaaggttgtatggctcagtgcagcttgcattagaatatcagagggcttgattgtatctgcagaaacaggtcaggaaatgaacaaagaaaacatccaccagtctctgaaatgctgggtattctcaatgatatgcctaatgagataagctaaagaaccattaaggcattgtttaagcctaaacaccaaatgaagtttgcataatgaataggggcatgacaaagtatctactctttctctttcttgcaaggacctaatctatgccattattggcttgagctcgtatgaccaccgccagaagtgctaatgacattgattagtaatttggtatgaactaccagaaaccccattcccatttcagaggaaactcgtatgaattcctgattatctgtggtccataaattttttgtttcatatgcccgaagaacaagttttgtatgaaaaaattgtgataataaggagagacttggtatcaaatactactcttttttttagctttgagagagaagaaaatggtgagatagggactcgaacccaggccagggcttgctcctggtagctccctaccagtaccagatgagctatccaccgttctgttttgtatgaaaaagtgaattccaagaaactctgcacaaatgctgactgcacaaataatgagctgagcaactacagaggatagcataaagaagtttgcctggtttggtcgtctaatcatctccttcatgccatgaagtcattaccactcattctagcattatcatattgttgaaacctattatttcaattgccggaccagccacgaactcaattgatttaattgctagccttacctactccagagtgtccattggattcctgtcacaatcccttttccgaccgctctttgaactgaaccttcggtcataaattacatgaatgattggtaacaacaaaattcaggtttgggctaattaattttcgccaggctggcaaagataaccggccaagttttgcattaagaaggagagagttttacagcagcccctaaaccagaaaaggcttaggttacaaaaaaaacttcacaacaataaagacaataaacaagcacagctgctaaaacctcaggaaattaaccgccagcgattgcgctcagtagcccagcagccttccatgtttcccattcgtcgacaattgtggcacaaaggtgaaccgctgaagtagctcgtccatcaaacacacgtgcattcctttccttccagactatccatgttaccaagataaccccaacatcaaaggtcctccgatctcttgtgaactgatttgcgtgcttcacaccaccaatccaacatgtcgtccgtgggggaaacacaggagagtcccaggcaactcctgattctcgtccaaactgccctcgtgtactcgcaagcgtggaacatatgggcacatgattcagcatccttcccgcaaaggtgacagtatggagccaagtgccatcctcgccgctggaggttgtccgccgttaggcatgctccacgtatggcaaggaacatgaagaacttgcaacgggtcggcgcgcgagacttccaaatcagcttcccaaccgccgagcgtgtcttcccagtgcagaggagtgaataggctgattttactgagaaaccaccatctgtggcaggcttccaagaaaacaaatcaggctgagtagggttcaaggaaacggtggcaacaaggtcccagatttggaggtattcaaacatcgcttacagtgaaagacctcccctgatgtcgccggtccaggcatcatcctgcagcgccgaatgaaccgttctgcctctgtttttaacaaaggaacacaggattggggctcggttcaggatcgaccccccatctgggagccagtcatctgtccagaagaaggaactcttcccgtcacccagcacaatcctgcatccggccgctagacaatgttcggctttcctatcttgcggcaatgtgaaggacacccagtggcgctccggctagacacgccgcagccaaagccaccgcgtccgaagggcaatgcccattctgccaagattgatgatgcccaacccgccattttcgatcggcagacagagcttatcccaagcaactaggttgcatccacccagtgcatcctcatcccccttccacaagaaaccaagaaaccgtggtctcttgttcacatactcttcagtggttgtcttttgtaacttccattgcagggaaaacttctactactattcataatgcaatacctaagtaaagatcaacaaagtatatcacttccaatacaagattgcagaagttcctttacagccaagaaaaactgttgttcaagtaatattcagaaatttgatttctcctacatttaggagtcaaggaagagaagaagataagatattagataatacatcaagaacatgacccaacaacagtttagtcattacaatgctccataatgtttattagccaatagataagataatacatgacccgatagcttctttctaattgtcttgtggtgtatcctaacgtggttcatgtctaaacaatcacaataaacacaaagttcaggcgttcagcagaacagagtggttggtcggccaatataaaccacaaaacacgattagtttttagattatcaatcttgtggttatcatttcacgccacccataatattgtagtgaacatttaggactgtccatcaagtcattacagtcacctgttgtgtgtataaaagggggcctgaagaagggctttacctgcatcagtgtgatcaaccatctcctttgaagtcctagcctaaaagctcttctactcgcataaagaaagatggtgaagcttgcatttggaagctgcggcgactctttcagtgcctcgtccatcaaggcctatgtcgcggagttcattgccacactcctctttgtgttcgccggcgtcggctccgccattgcctacggtgagctccttatttatgtttcaaaaaacttccatcccaactctgcttgtaccacttagcacagtgatcattctatgtttctcatctaaatctttgttgtgcagggcaactgacaaagggcggcgcgctagacccagctggtctggtggcgatcgccatagcccatgccttcgcgctgttcgtcggagtttccatggccgccaacatctccggtggccacttgaaccccgttgtcaccttcggcctcgccgtcggtggccacatcaccatcctcaccggcatcttctactgggtcgctcagctgctcggcgcgtccgtcgcgtgtctgctctgcagttctccacccacggacaggttggtttccatcatgctgccacgttgttgtgctttgtacttcgcacttgagctaagtgaatcgggcttgctaattcgcaggctatcccgacgcacgccatcgccggaattagcgagatcgagggcatggtgatggagattgtgatcacgttcgcgctggtgtacacggtgtacgccacggcggccgacccgaagaagggttccctcggcaccgtcgcgcccatggccatcggcttcatcgtcggtgccaacatcctggcggcggggccctttagcggcagttccatgaaccctgcccgctccttcggcccggccgtcgcggccggcaacttcgccggcaactgggtgtactgggtcggcccactgatcggtggtggcctggccgggctcgtctacgacgacgtgttcatcgcctcctaccagccggtcggccagcaggaatacccatgaagatcatcgaatccgaaccgtcgctgctgttgattccaatttccatccatgtcacgtctcgcttccttttgtatatggtcttcccgtttccttcctttttcgtttttggttttgaacacaaattctcgtgaagaagatgtaagatcaatgtgtgttttaattcttattctgtgatgaacaattggcatctgtgattattggttttgatatttggagattatcgtcgaagttgttttggagataatcaattttcaggtgatgatcggattcactgttattttatgtgaccggtctgaccaggctgtgtatgccggtcagaccagcggtgatcgagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgatagcttggtctcggaatatagtttctttatttgtttcatgtgtaggtgactcgatgcctagggagagtatttgcggtgatggaccgggagtcggcttggtggtaagacgatgtccgtggtggtcagatattatgcgggatactaaggctagagttgatgcacgtggttggtgaagattccatatggcatacgatggaggtattgtgtgcgtttgggatgcggagtcgaatttggaaggagtccaaatttggtacaattggttatgtaaagtttgtgtcttgtactagagagtttcctaaggtgtttaggactcttagtatgagtttggttcgtggctttaggctgcctacctcatgtataaatagagggggagcgtgaggcttcccggtatcgcttttgtattgcttttgagagcaattgagttgctagtttagttagggtttcgagtttggtcaaaatttttataaggagtgctgttggtgcactttgtaaacacagagagaatcaataaagttgtcatctattttaagagttcttcgatttgtgtttcaccgggtttcggcggtctaaccggcaactcaccggcggtcagatcgacggcattgcggtggtcagaccggcgggagtacggcagtcagaccggcagcagcgacagcgagcggcaggcgacttcggcggttcgaccaatcgttctacatcggtcagaccggtggcatccactcggtcagaccaacagattaatctcggtcagaccgatctccgtctatttcgagggtaacttttatttccgctaaaagtttttggtttttgggtataccaaccattaacccccctctggttggcttagttcttgtgattcgatcctacaagtggtatcagagctttttttgcttctttggattttaaccgatctagagtttttgccatggctgcttctaataagttttcaactaagcctcatgttttcgatggaacggatttttctcattggtgtagtaggatgcaatcttacattatggctgagaattatgatatttggagaaaagtttctcttccttatgtgattcctgaagttattaatactgctgctgaaaaaattgcttttgaactgaattgcaaagctcgcaatattcttttgagtgggatttcttgttcggattatgatcgtgttgctcatcttcaaactgctcatgagatttgggttgctttgaataattttcatcaaggtacaaataacattaaagaatttcgtcgtgatcttttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacttctattcaggagtccgtgaacatgtctactttgactttggattcgctttacacaaaactgaaaactcatgagatgaatattctttctcgtaaaggtgattctaagtctagtgctttggtttcgtcttcaacttctttggatgttggtgcttcttcatcgaagtcttctgttcttgctttatttaatgccatgtccgatgatcaactcgaacagttcgaggaggaggacttggttttgctatctaacaaattttctcgagctatgaaaaatgttagaaacaggaaaagaggagaaccaaatcattgttttgagtgtggtgcacttgatcatcttcgctcgcattgtcctaagcttgggagaggcaagaaggaagatgatggtagagtcaaagaggatgacgtgaacaagaagaagaacatgaaggagaaggagaagaagaagcattgtatcaagtggttaatccaaaaactcataaaagtttttgatgaatcggaagatgaagatgagagcaaaggtaagcaagttgttgatttagtttttattgctcgtaatgcaagttctgatgttgatgaatctgatgatgataatgaagaaaagcttagttatgatcaactagaatatgctgcttacaaatttggtaagaaacttcaaacatgttctattgtgcttgatgagaaggatcatactattgagattcttaatgctgaaattgctagattaaaatttttgattcctaatgatgataattgtcaatcttgtgaagttttattttctgaaattagtgctttgcgatatgtcaattctgttaattgcaagaaattggaatttgaaattgaaaaatctaaaaagttggaatcttcttttgctcttggatttgctttacttgctcgtgttgttgatgagttgattttgacaaagaatgttttgaaaaaaatacaaagtggctttttgtgcaagttctttagtcaatgtttcatgtgcaaataaggcaaaacaaaacgatggtgttttgatttctcaagattgttcaaagatgacggagcgtggggctcctcaccgggagaccgcgcgggcccccctttgctggttcggccgggggcgctaggtgagattctaagccctcgatttgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagagaccctctcactctttctctcctctacgagctccgctcttccttttacgagctctccttcttttcttctccctttcttctctctttttcctccagtcccctctcttggtaggcatggtcctccttttatatctcaaggggataccacatacaccatttctacctacccttcttttgggtggggacccatcctactttgaccaaaacttggctcgtaccttcgcctgacaccgggataaccctgtccttccttcattaatgggcggagatttgcaatggctgctgtccgaatgaccctccgatgggatgggtcataccaacctccactccgccggaagcaggtgcaacgtgggagcacggttatttgctgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgagaccgatgtgctaactccaggagttcccacgccggctccgtctagggacgagtgcctagaggctctcatcattccgacgggacggagcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgtggttaggtgagggccgctttgctcacctaacccacacacgtggcgccgacgccacagggggtcggggcgccccagccctcggggccgaaacgggagcggccgacccctcggggagacagagggaggggtggccatgtcaccgttgggcccgacccccccgagggggtcgggccacgtgagtgatcgcggctacccaagcctctagtcacgatacccctggccccatgtcaccgacagtagccgccggcgtcacgctagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcgggctcttcaagaccgctacattacttgagtagcgcgcgaatcgggacgaaccggttcgtttcgcctagagatgtgatgatggtgcatcggtcggcgagcgtagttaacgcgcgcacgatatgtcccatctcgactgccacggccgcacatccgcctcgtgcgccgcaaacgggcgaacgggattagtggaggagtgggcgcgagaaacgagggggcgagatagtgggcgcgggaagcgaggagccgggcatagcgttggcaagggtataaagacgccgaggaagagattcgtttccttcctcttcgccattattccccttgccttcgccgcttgcgctctaacttctcgtttcctgtgccctaccctcgccgcactcactcgctctcaaacccctcctccgccggtgtcatggcacggggctccgcaccgctcgacggtagcgtgctgccgccttctcgcatcgtgagcgagaggcaagccgggctgccgcgccgattcatgccggaatctgccaccggccaggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgatcccaggggctcacgggggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggagtcgtgcttctgggccccgtgacgggggcccggggggcagccgccctgccgacgcccgggggaagaggaaacaggaggataccccctccccatctcctccccgagggggcggggtggtgcgtgccagcagcaggcgcccggagggtgctgtgccgacgtcgtagcccgagggggagcgaaaaaagaagcggctccgcaagataggggggaccgaaccatgccggggaaagctcatctccccccaaggtggtcgtttagccgacctcctcgcaggttcatccccgcgcccactgcggccgtattcattctcccatctcccaaggcaagttttcactcacccgtttttcgtcttctggtttttcttctgcctcagcgagatcccgtcgcgcccttcccgccattccaagtctggccggtctgaggccgaggagacggcgaccacggaggcccggaggcgggaagctgaccggcgagaagccgcaaaccgcctccgggaagccgaggaagctgcccaggaggctgtccgggctcgccaggctgaggaagccgcttgggaagaggccagactccgacgaggagggcggtgacggtggtgcggacgacagcgatgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcagctctgtttgttgtgtgtatgagatgaggatggtctgtgccgcggtccttctgtgtcttggcttgaacgagggctcgtgcccaggtcccagcctcaaatggcgcgggtcggggctagtgcctggggagatccgtgtgtcgagactggccaggccgggaacgtggtgaccgaggattatggatgacccgattgtgggcctttgccgattcccccccggagttcaccacgccccggggcacggctcggttctgggccccgtttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaagataaggatatgcatgtggtagcccccggccaactctgcacgcctgggagggcgcggggttggcccgagcccgagacctgacacctgacccctactaggggtagaagcgacgaaggtgttcgatgttccacggattaggcagctctgtgccgtcggccgtggccagccgaacggagcccggccgggggacgccgatcactcgatacggaccctcccacattggtgagagtttgctcagtccagcacgcgtttggacgcggcgtagtacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcaaagctgatcttgatcggcctcgcagtacatggtggcccgaggggacctcagggtgagctcgaatgggagaactgcctccgcgccgtagacgaggaagaaaggcgtttccccggttgctcggcttggcgtggttcggttcgcccagagcaccgctggtaactcctcgatccacgagtcgccgtgcttcttgaggatattgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcaccccaaaccgagcagtaatgcccctgatgaatttaagcgcggtgtgcttatcgatcttgatgaccgggtaagcctcgggccacttagtgaacttgtcgacagcgacatacagatactcgaaaccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccagccaaggtgcgtgaggcggagtgggctccgcactcgccttcatggatatcggcaagaagctcgacgccttgttcctgaggaatgcacttcaggaggactccgttagccgcgcgccgatagagggtcccttccaccagcacgtagcgcttggagatgcgctggacgcgttcactcccttcgcggtcctcgggtagagtcttatctgtgaggtacgcctagatctcagtgatccaagcaatcaatctaagggagctgggagcgctcccctcgggtcccgaggcctggactccgacgggcctcgggggccgttcaggcgcgtccgtctcctctagggggtcgggccgcgccgatggctgggcaagcctttcttcaaaggcgcccggtggggtctgggctcgcgaggaagcgagcctcgagagttcgtcggcgaccgcgttatcccgtctgggcacgtgccgaagctctattccgtcaaattggcgctccatacgccgcacttggcgcacgtaagcgtctatctgcgggtcagagcaccggtactccttacagacctggttaacgaccagctgggagtcgcctaacaccaggaggcggcggatccccagtccagctgccaccctgagtcccgcaaggagtccctcgtactccgccatattattggtcgcccggaagtcgaggcgaaccaggtatctgaggacgtctccgtttggcgaggttaacgtgacccccgcaccggcgccctgaagagatagggagccgtcgaactgcatcacccagtaggcggtgggaggcagctgcgaggggcccgagctggtctcggggacggagatgggctcaggggccggggtccactctgccacaaagttggcgagggcctggctcttgatcgcgtggcgtggttcaaagtgcaaatcaaactcagagagttcgattgcccatttcaccacccgtccagtaccctctcggttatgcaagatttggccgaggggataagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggtcgtgcggggcgcactcggcttctgtgccgacgacctcggggtcggagggcgacaggcgcggccttcccgcagtggccccggggccatcctgggggtcgggggcgcctggcaccgtctgacaagcaggcggagggccagctccggccgtcgggggcctcgggccgccgttcggctcgggggcctctcctccctgctctctcccgggtcgagtcgacacagggtggggatgcgcggggtgagggttgtcctcgtcgtgctccacaaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgag

SEQ ID NO: 74919 - DNA, 13271 bp, Oryza sativa
ccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaataaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtgaagaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcgccggcgccgacacgcgggccccacacgtcagtgagcaaaggggacaggcgcacggtggacacggtccaccgcagcctcgggcgcacgtccaccatttggacggcccagatcggcccgagctgatcgggcggccgaggggagcggcggccaggggcactggcgcgacacaaagccggcccggccgagccaaggcgcggcggcggcatgcagccaccggcggcagcagccggcgacgcggaacgacggcgggcagccggaggacagcggcccgcacaggggacggcgatgcacctcaagaggcggcagccggcaagaaagggtgacgggaaaaaaaaaggggagggaggagaggtcctcaccgaaaacggcggccgacgcggaggaagatgacgacgacgacgattgcccgatggcggctggcgaggacggagggcgaacgaggtcgcccttgacctgcggaaggagaagagggagttaggttggggagaaccgatgcggggtgactagaaatgaaggccgatggcgacgacgagaggtggggctcaccggcgaacttagaggatgagttggagcggcggaagacgacgaccaagcagcggacgaggtgagggcgagcactgcgaacgcgccagaggcagcagcacggccgggcgaggtccccctcaccggcaaggagcggctggagcgctgtggaagcggaggtagctcggctccgcggtgggagggggttccggtggtgaatgggagggatgaggcggcggccaggcttgcccttgtggcgtcgaagccggcggtggatgcggcgcagcacggcagcggcgggaccggcggtagcgcgcggctggagggcaccgacggtggtggagctcggggtcgacggtggaagcagtgctcgggctaccaaataaaggggtggtgcggcggccgaggcgtggcactacgcggtgcagcttttggtggcggtggcgcagcgcggttgcgacaggaacagcggtggcgggcggctggagttcgccggggagcggcggagagagggagcacggtggggaggtggctaggaggcgcggggtgctcggggagaggggaaaacggatgaggggaggcacgtgagtcgtttatataggtcccggagggggagaacgtggccgggagaggcggatttgaagggggaaaaggcgccggcgacgtgggcgagtggcggagcaaaccggcgccggtttttgggggaaatgggggaggagagtggaggaggtggaggggatgcggttgctctcagttcggatgcgagcgcgtgaacgggaggacgcgaaaacggcggcatcgtgggcggcaatggcggccacgagcggctgctggctgggatggagggaggttggggatgacaggcggggcccatgggtcccacacgtcggctggagagagaggagggaaactggggaggcaaagcagacttccctcaaggcctgagccggcctagagatggaggaggcgcgcggcccgggaagggggaggggattttgggccaagcccgaagggaggagagggaaattatttggttttctttttatttaattgattaaatgatcttcgtgactttaaactatttctcgagctccgaaaattcacggaaaattatggagagtacattagggcacaaagaatattacaaaatattcccggccaataatttttaaaggaaattttaatttcctctattaattcacttgaataaattgcttaactttttatttaatttctaggaaatgcattatcaaatgatttttaatcccgaacgaaaatcggggcgttacagtcggcctcctatcccccttctcctgccggcgcggccggcggcctctcccatttctccagtcgatgcggccggccgcctctcctcctattctcacaggcgcggccagcgcggccggcctcctctctcccttctcccgccggcacggccggcgacctctcccctttctcccgctgatgcggccggctgcctctcccgccgacgcccccctctcctgccagctgtcccgggctggaagaaaagaaagacgattggctgacatgcggaccccacatttttcttctatcacttacatatggacccccacaatttttttattccctctttgcggattaggatgccacgttagtaaaaccatctattatactgccataggacctattctacatgatttcgtatagtttagggggggagatttctggtattggacataagggatgttttacagactcgacataaagttgagggacggtaggtgaacttattcctcgtaggaatcgtgcaagctgggaataagttcactttgtgaccctcaaaagtgattgaaatctaatccgtgaccctaaaccacaaaaccggatatcttgacccccaaactatgaaaaccggtgcaatttgactccctcagcggttttggagggcggtttcgctgacgtggcggtattgaccaggtcttctttacacgtggcgttgatgtggcgcttaggtggcatttcaattaaaaagttatacgtgggactcatttgtcattcacacacaattgtggggc

SEQ ID NO: 74920 - DNA, 32845 bp, Oryza sativa
tctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactataccggcatatctatcgattctatagttatatgcgaaaatcttttatgtagtagtgcttataatcgattctactatcagtatcccatattatcatctttcaaattaaaatggagtatttcacaactgtagcaaccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtattttgataaacttttacaaatatgataattttgatagaatattaaaattttgatataatttttccacaaatttggtaaaatttgggtattttgaagaaaaaaagacagaatttgggcacaatttcggcatggtttttacacagctaacaaaatacatgtagcaatcatcacaaaatcacacaaaatcaagcaaatccaaatcatgaagccaagcaaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctctgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgataaggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttccaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcggtggaccgagtccaccgtgcgccctcccctagtcccgctgacgtgtgcggcccacctatcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagttttcctcattttgcgtgccagcgtgtagttcccgtcgtttcggaagtccgcggtcgcgaggaaaagagctcggaagatcaaagtgaagaatcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttgcgggatgccctggaagaacttatcgtacttaccataagccagcgtgggcaacggctgggcttgtagtgtagctttcctctagccgacgcatccaggcaagggtgggcgtgatggagtttagatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgttgtggtggcatgtcggcgcacggaaacgtgtcgtggggctgtgtcttgtgggtacagttgtacacctctgatcagagtaaaactattcgaatagtcgtgcccgcggttatgggcggtcgaccagattcaccgtgattagtcccaccttaataaatcgactcaatgcactgtagttcaggtgggttggttgggcctgttcaacgtggtatagcgttgatcagtggagatttaatgttactttaattactcaacagttttactattttgctcaataaaatgttttacaaccacctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatggggtttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgttctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctctgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagcatcaacatggtagcacaatgctgatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctataataaaattgaaccacagaccatcaattgcaaaatagtaaaaggaactcatcgcgtaccatgatcgcaagcaagctagatgaaatagatggttgcaggataactttttagctcgagccattggtccctaggagttgcagatttcaaaagaaaatcagatacacaagcactcaaaacactacagatcctgtgaaaatctagaaattgtttaccctacagatggcacactcatcgtcgtatgcacagatttcatcatatgtagcatctggaagtgctccgtcgagtgaactaagtgcctttcgtaacttggcataagtttttatccgcttccaaaatgaagctataagagcctgcaaacattttcaaagaattccagtcagtacatcatacatatttatttaaagtttatcgaagttaacaagtgaatgtcacactcacgcgcaagttcaataggagaacagcgtcaaccagatgaaacgccataccacggagccagaagatcattgagtaatgaccaagtgacatcaataagcttatcaagtcaatgacaaaaccaaaatttctgactagtctgcctctccactcagaaaaagatcctgcagttacaaagcatgattggaccctggtggtaaagttgagataattcaagagacgcatgtacaagaaatgagacatggactgctcaacctgaactaaattaatgttccaacagatcatagagcaaaatttacagtattacaaacagaccagaccaacataacaaatgtcagatgagtgaatgaaacctctgttatatactccggcctgtcaggaaaaaaaaaaggttctgttttttaccattggcatggccttggaaaaaaaagatcagcaatttatataaaaccgattattgagatcaatatacatgttttttctttgtgaccaatctaaatattcatagatatgttaccagtgaaagataaaatagtttactgtatgcgttctaggattttttttttcattcactgaatctggtgtttgcattcttgtctaggttagtaataaccggttaaccacgaaactcatacagcattatcctgcatgctcagccctagagggtttactaaactgaattaaatgagtctctgagcagcgaagacacgcttatcacctgctgcttgcttataagttttttggaaatcaagatagtccacaccactgtccatttgatgtcgttgccatatgtcaaacaactgaaatccatgcaccatgattgactgctaggaaaatactatgtgagaaaaggttgaagatattcagaagtaataactgcatgcaggtaaatgctcataatatttttaacatctctagttggcatttataagcaccacctcctttgaacattaaatgcaatgcagatttctttgataatgcaagatcgttataaattaagaaaagataaggaggagaaacttcccacaatctgggttgaagtacctgcagtgtctcaaagccaatactaagtggctcaaaaaacataagccaaaatagttgagaattacacgacttgcagaacccaacacaaagctttatcctggagaagatagacaatcaattaagtgtgagcttttaaaagtattacatgctacagttgtgtcaaggacaccataacaaaaggaaatgtggtaaactcaagcatcaatacaactcattccattatactccctctggtcaaaaatatttgtcgttttaggaccagatttggacaaacttttaaaattccgaatacaattttatgtgaataaatttataaagtctaataagttcatgatattatgaaagtactttttgaggcaaatctatgtatatcatttgttttcttttttaaactaagcatttaagaaattattgatggtcagaattttaaaagtttgaccaaatcttgtcctaaatgacaaatattttttttagaacacgcaggagatctgcatatcatttcattaagaaaaaggagaaaaggtggacggtgttagagaaagactccgacacccgccaccaagggtacaatagaacaccacacacccaaaggaagtaaaacaaactagtgcattagcagcacagccctagtaaagagatcacgaagcctagcagctcctgctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgaccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtttagcccttccttctcattatcaggtaaaccccttactgttcttgaccaccaattggcaaacctagcagtatcttgggttggaaagctagagtagccaagccgttgcaggaccaaataaacgagatttggagtgagagatgtccctccaaactttttttaagaagaaattgtgagagtgttggggattgaacaagggatcttagggttgaaaccacacaccccttgccactgcactatcaagtgcatctctaaatgacaaataatttgaccggacagagtaagtttataacagaagttgcaagttgcaagaaattgtaagggacaataatttcatgttggaagtgagtaagtgacatcatgcatctctgacatctacaaaatcaaaataaatttaagtgtacccaacacctaagcaaagaaaaaattatgtgtaaataatatttctaaacaaaaaacagtaaaatgcagactaaccagggaatattaccatagtacatcagccgatagaaccagcaatagtgcagaatatacacgaaagtattttgatggagtcgctgatggtgaagcattgagctgttcaaggcgttctctagccaatgattgaaacatctggatgtacgagaaattttagttaatgtaagggtataatcttaactagttgaagacttgaagttctaaaacattaccttcagggaacaaagaaggcccaaccaacttgaccaaaggattatttgttgagaattaggaggcacaaccagtgggagaaaagttccctggaatacgagagagatcattggcatttcttcacatggcaggcaacaacaagaacataaataaataactgtaaattgatcatacatcctcccttagggcttgttcggtttggaaggggttgaaggggattggaggggtttgaggtgtaataattccacaccacaataggtgtggaataaatcccctccaatccctccctcctggggattaaccgaacatggccttaagattgaaattgaggatgtaccctcctggcccacaagttaggttgatgaccccacatgtcaatggcataggaggctaaatcctcaacttttgatttaaaggagggtatacgatcaaatctcccggtttacttttccaacttgtaaatcgtagtcttcacttctacaaaagggcatggaaacttctactccctccatcccaa

SEQ ID NO: 74921 - DNA, 25995 bp, Oryza sativa
tctcactgccgggccgagctcgccgtaccccgccacgtgtgcctcccgccaccgccgctgtggtctcctccgtcttcgtcgcagtggagctcagcccaggtgccgccgcgcctccgcccctcgccaccatctccgcctgccgcgggagagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctacttcctccacctcatccccacttctatgtatcttatcctctcccaagggagtagggtgagcagagcggcgcggcgcggtggcggaaatccgctgccgacgccgatctccacagcttcggcgctcccaactccttccgccgtcatcatcacgccttctccaccgagctccactactgtcttggtcgccactcctacttccccacctgctttgacgatgacgatggcaacatgttcgaggatgcacacctcatcttcttcttcccagtctcctctgtcttcgcaccaccgtccctcgccatgtcagctgccgccgcatcatacaggcccctcttctccctgctcccacagcatgccacactcccccttctagccgccggacccctctcagcgcagcctctgccacttcgtccactccacctccttcctccccttcatctatttcgactccctcgaggacaatgctctccactctgtccccatccttctcagcactctccaacttgctcgtcgtcctcgagccccgtctccgccgtcctacgcgccaccccccgacctcgacggcatcctcgccatgggcagcggctcgccgcgctgtcccctcgccatgggtggagaaaataggaccaccaacatgtgggtaccattatttttctttatcttagtttgactgaccatattttgtgtcaattatttagttttcaattttgtttttttccaaataaaactgtcacgaaaaagccacgtgtaacaaagatcaagttaaattagtcacgtatgtaccgcgtaagccaaaactagagataatagtaccgaagaacttcgtttgcactggttttataagttaagggggtggttgtatctggttttcggtttagggcgtaaatcggatttggtatcaagttaagagatatcaaatgaacttattccaacttagtttcggtcagcccatatgcacaaaactcatggaatcagccgtaccttaattgaaggaaagaaaaagaagaaagaaaagatactgattttctttttagaaaatgaattaaaatccggctacatcgatgtacacagcacagaaaagatactgatcggtaagcagacagccattcgatctcttgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcactacagggagaggggatccaagtttttgaccagctttgacgaatcctcactctcctctctcgcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaggcacttggcgcagcacttgttgcagaacgtcaggcacgccttcttgtactgcgtgttggagcacctccccgcgcacttgggcgagcactcccacggcctcaggttcccgccgccggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagctagctataaatctgtagctcgctgtccttctctctcctcatttatctccttaaaatatgtttgcagctggcttatagcctgctattgtacctactctaagagccagtttaatagcatagcccattgctagctccaattcatttatagtcaattcatataatagttgtttactatactattaatatctgatcccacctaccataacacagtcttggagtccgtgctacagctggctacaaatctgtagcccgctgctcttctctctcttcctttatctttttaaaatatgtttacagctggcttatagcctgctattgtacctgctctaataccgggaatcaaacgaacccgaggagatgtaagagcaagtttaatattatagcctactactaactacaatttatctatagtcaatttaatagataaatcatacaatagttgtttattattttattaatatatgatcccatctgtcatatacacattgcgttttagagtccgtgctacagctgattacaggtctgtagcccactactcttctctcatattttatctcattaaaatatgtttatagctggctaatagtctgctattgtaactgttcttaacaaaaaaataacacgacgaggtggtgagatgctactccaagtctagattaaatcggtgagtgggtcatatactataagtaatagtactccgtagtttacgtccactagatcggcggcacatgctgatgccctttttccagtgcacctccactagctactagttctggtactccattctactcctggagagggcaccgcacatgcgcggttcgtatccacagcttgcgggcaccgcacatggatgatggatcgttccaggtttgtattcaccacagctcttgcggcacatggactcccccatctctctaccctacagattgtcgtgcactcgtgcagcagttcaattcgccatgtagtagtagtagtaaaaagtaaaaacttgtatatatactcaggtacttgtactatagtagtaaaaaggcgtccctcgtcgtcgcagagctgttcaaaatttcggttgcacggggcacgagggcagccggcaaaatctccctgttttgctgggggcttttcgcacgccaaaagtccaaacgctctctcgacagggtttcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggttaccgcggttaccgtgcggtaaccgtgcttaccgccggggcgcggtaaccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgtgccgcccgtcacaggctgtgcgccgctcacacgtcgtcctcgcttgcgccgaccgccccgccggagcaccgctgcccgcgcaccccacccgtgcgccgtcgctgctcgcatcgcccgccgtcaccgcaggagcgtcaccatcggcccgctgcctttgcccacatgtgggagttaagttttggggggggggggggggaagggaggaggttgagcttgggataattcagtgacatttttatgtgaatgtgttaaaaattaaagggtagtggatcttttgggttggagtggagctgtggagcagaaaaaacccagctctacacctgtagtttattttttaggagtagctctactaacttcactccaaaaacagaaaatatggatcgtttggtacagctccgactctagataagttggagttgaaagttagagccgtgccaacggaccctcgtactccagctgagttcgcaatgttgcaatgcacgggcgacgatcgtcgtccgtggagtgtagattcctatcattttggtgacctttgcagagggcgttgttgatcgatgatgcgcatttcggccattgcagatcaggtgaatcacgattagcgccctattgtttaggttcccggtcaatatggtcttactactgtatatgcgtctgattaatttcgaattatgtttatttatttcttctccagcatgtgtagtgctccctccgtcctataatatagcaatctagtataagacgagatacttcatagtatagcgaatctggacatgcttcatgtcatgtctaaattcgttgtactataaagtgacccatccggttctaggttgctatattatgggatggacgaagtagtagagtatgggtgtgttcggcactgctggttcctaatcttttccatctcgttttccgcgcgcacgcttttcaaactaataaacggtgttttttttaaaaaagtttctatatgaaagttgcttaaaaaatcatattgatccttttttaaaaaaaattagctaacactttattaatcacacgctaatggaccgctccgtttttcgcacgcactgttcccggctgggaacctccagtagcgaatacacccatatgtgtggtagagatctggatcctctgccttaggaaaaaagcagaggtgcacgataaaatgagtctactactatggtagaaaacagtgatttgcagttttcactgtagcaacagtacaaaacagtgaaaaatactgtgcgcaattactatagtgatcgatctcgtccatttcgtgtgaaccagacaactgaaaataccccaaagtcacggtactgttttacctctgactttaaccccgggaccttaatccgtgtggtagtagataatatgctatgcacatctcccgtgaggcaaagcgtaaccttgtggattgtcctccccgtgcgtaaaaaaaaactaaaatgtattcgatagaaaattaagtttaaaatcttgtatttttcttacctaatgatttgctttgagttccgtgctctgatgacccaagctcttattctacagttgaccccttctcctttagttctggtgaccccctacaaacagtaatggagctagtgtttagggtcctcgattatggctaggggtaaggccgtaagggtgggggagggggaagagagggaagatcgctggatttagaaggatggtcatgggaggcggcggctcggtgttgggtcgtggacatgagcaggcggtgaggcgctcatggcgacgtcgaagccatgagaatagaggaggatgatgagccatcgttaatgacgggagcaaagcaaacttgtggtgaggggcggatcaactgtgttaggtgtggtgtcacctgacaccaatagattcttgtttaatctaagagcaggtttaatagtatagccccactattggctccaattcatttatagacaatctaatagccaattcatacaatagttgctaactatacttgttggcggatggcatgaggcccttcgaccaaatttgccgaaacccgtggcgaaggctatgaaccaaggatgaggcgaggcgaagggtcgcgtgagtacctgacgaagaaggatgacttcgccatagccagttcgccctggcatccagcgaagaaggacggcttcgccatgtccagttcgcccccgcaagggccgaagaagcctttttggcccatcaagcttaggggctatagggccggcggtcgcctgacggcccatcaaggacccataagtccccttgacattatgtaaccctgtaaacgtctctttcataagggcaaccatgtaaattcccccgtataacctaaaccctattagtaagaacatgtaatggggctataaatagtcccctagggccatgtaatggggggatcccaagtaaaattaaaaatttaatacacttcgtttctttcccaaccactgttgagtaaccacgtctttcgacgtatgcggttgtcgtttcgacaacagctggcgccgaccgtggggacctccgagcgaaaccactaagagcgaatgccaccgaagaaggtcgcgaaggagaaggttacaaggcgaaaggaaagcgacaccggagtgggcatggccgccgaagaaggagcggagccttcggcgtcggtcgccgaggttggaggggcaccgtctgcttcggcgacggcaccgtccgcttcgacgccgacaccatcactgctgccttcggcccctgccacctctgagcaggcgccgagtgtgaatgacgtggcgaaggcgaccgcagtggcgagggcacttcagaccagggcggagatcctttcgacaagtcagctgctggtcccccaagctgctccgtcgcagccagcagcggcccaagctgcgctccctgccatacaagtccaagtcaactccgaccctgaaacacaagccgaagccgatatggagggcatgcggcaaaacatggcacgactccaagacatgcttcgccaaatgcaagaacagcaacaaacgtacgaagcggcaaggcgatccaaggttgcttcggcaccgatcctccagtattcggcaggttttgtcccacctcaagtctatccgcaagtgcagcccaagcccgctccgccgcaagtcttgcaggcaccaatgtactttgtcggacagccgacagtggcaacagtgccccaagccgcgacccaagtatagcctcagccacttggccagctgtcgcaagccgtagcagaaggggcttcggctctgcaggcacaattccaagctttcctccagcaaatcaatcagccccacaacatttcgaatacaactccctcaactcgtccagaggggaattcaagtcaaggtgcgctcagttggttgccgccgaaccagccgaatctgaggacttcgccatggaatcaggtacctcagtgcgactttaccaataccgctcaggcgcaaaccgttcggccgcaagcaccaacaccaggcttcggaacaagccaagcaccaactcatgtcgccatggcgtggtcgcagccagttttcgatccatccatggcggctcagcaagcatcaccagtcggagccgggcagccgaacgccatggctcaaaatcatgcgcaagccgtaatttcacctttcgccacgccgtacccacagcaaggcaccgcaggcagagcgggaggcgaaaagggtctgccgctgagtgggggaatcaagaaccgcccaattccgccccagttcaaattccctcccgtcccacgctactcgggcgaaactgacccgaaggagttcctatccatctacgagtccgcgattgaagcggctcatggtgacgaaaataccaaggcaaaggtaattcatctcgctcttgacggcattgcccgttcttggtatttcaatttgccagccaatagcatttactcatgggagcaattgcgcgatgtttttgttcttaactttcgaggcacttacgaggagccgaagacgcagcaacatctgctcggcattcgccaaaggccgggagagtcgataagagaatacatgcgtcgcttctcgcaagcctggtgccaagttcaagacataaccgaggcatcagtcataaatgctgcttcggctggtctgcttgtcacgcccggaaattcactagtaatttccgaacttatttgtgcataaaatcctcgtccaggaatcaaccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgatttattattgcaaggtgagcatatgacatactcagcaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacagcacacccatgctgcataggcccaaccattctgaacaaccatacccggctgaacagatctaactccaaaccaggagctaagcaaattattacccggtataacatctataaatattgtgagaggtgtgagactaatcacgaaaaacattgttcaactcgcccataaccgcgggcacggctattcgaatagttttactctggccagaggtgtaccactgtacccacaagacacagcctcaacatcatgtctacaatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttgacaagtaattaattaaccaatcacgattaaccatcgtgaactatctttaaaccatcattaaataataatgagtcataagttatcccaatagtgtgctaatgtttctaagcatggctaagcaatcatatctaatatctagctgaaccaatatataaagctcaaccagtcaagttataatctcccaaggtatcaaggaataaagtaatcaagatcaaaagggccataacaaagaataggttaacaccacccagtgacattcgaaaataaatgcacagttgaaataaatagagaatttaaatataggatcaacatgctcaaaggattgtgtttaagatctgtgtgacttgccttgcaataatcggtcttcaattaatcttcttgaatacttccggcgcactcgcgaaccttcacaacgacggaaacgacaagctaacacgtaaaacgaagaaaaagactaataaaaaccaaataaacagtacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacctttatatggattttaattgaattatgacgcaataatgaattatttttgaaaaggaaaagaaggattattgcgtcagcgggctagggtttgcggtggaccgggtgcacggcagcggttcacggaaatgaacggccgagatcaaccctatccaaaacggacggctgagatcgatcggtccacgaccggctcacgacgaacggtcccgatgacgtcggcgatgacgtcacctaccggcggcggcttggacggctcggacggcgcacgctcgccggcgaacgacagcgcggcggcgcgaacggagagctccaggacgaagagcgcggcgcggcgaactcaccgatgaccaaagcaacggcggaggagcaacggacggcgccggcgacgaggaaaaggcggcggcggtcttcgggtcgacgatgacggcggtgctccggcggtcttcggtggcggcgaaggagcggacgaggacggcgacgaccttgcgaacccgatggcggcgacggcgaccgacgacggcggctgcaacggcggcgcagcgcggctgaaccgacggcaacgacggcggcgactaaggctacgcggaggcggcgctagacacgacggcgggctaaggcaaaggtggcggcgggtagaggagacaccgggggtccttataaaggggctagcgagcggcgacggaggcccacggcgaccggcggcgagaaggaaaggtcggggattcggaggaaagagaggaatccgattcgacctcgaatccacaagtttccaaaccgaattaggcgatgattccaaaagagaaaaggaagaggagatctcaaggatcatttgccctcaaacaattcggccggagaaggaaagacgcggccgaatttggaaagcggcggcggagcggctcggctagggtttcgggcggcggcggcggcgcgaggaggaagacgggcctgacagacaggccccacctgtcagcggctgagagagagaggagagcggcggctcggcggactgggccggcttgggccgagaagagagagaaaaggttttgggccgactttcggcccaaagccaaaagagacttttaaaaacccttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaaacttttaaaatcatttctaattattccttttaaacaacaatttataatttaaggattttaaacaagaaaagctcttaacaattataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctaataataatttattaaatagtttataaatcctgaaacgaaaatcaggatgtgacactgctcgaaggcgaactcacaaggaaaatcgccaataaggaaccacaaacactcgtgcacttgcttcgcatcattgacggtttcgcaaggggcgaagaggattccaagcgacggcaagccatacaagctgagtacgataaagcttctattgccgctgctcaagctcaagcacaagttcaagttgccgaaccacctcccctcgcggttcgccagcctcaaacggcgatccaaggacagccgccaaggcaaggtcaagctcccatgacctggagaaagttcagaaccgaccgcgcgggcaaggctgtgatggccgtcgaagaagtgcaagccctccgcaaggagttcgacgcccagcaagcgagcaaccatcaacagccggttcgtaaaaaggtccgaaaagacctttactgtgccttccacggacgctcttcgcataccacagagcaatgccgaaacatcaggcaacgtggcaacgcgcaagatactagaccacagcaaggagcaactatagaagcacctcacgaagcagcccaagaacaaacacccccggtcgaacaacgtcaagacgcgcagcgaagggtaatgcaagtgattacgagggctgacccgccaggccaattatccaaaaggcagaaaaagatgcagatccgagcggtccacagcatcacttcggcgggtgagggggcgccacagtatgtgaaccagctgatctctttcgggccggaagatgccgaaggagtcatgttcccgcatcaagatccgctggtattctcagctgagatagccggctttgaagtccggcgaatcctggtcgatggagggagttcggccgacgttatcttcgccgaagcatatgctaagatggggttgccaacccaagctcttacaccagcaccagcgtcgctccgggggttcggcggagaggcagttcaagttcttggccaagcacttttgctgatagctttcggcttgggagaaaacagacgcgaagagcaagtactgttcgacgtcgttgacatcccgtacaactacaatgccatcctcggccgtgcgaccctgaacaagttcgaagccatttcccaccacaactatctcaagctcaagatgcctggcccagcgggagtgatagtggtcaaggggcttcagtcttcggccgcgtcaaaaggcgatctagccataatcaacagggttgtgcacaatgtcgaagccgaattgcacagccggccgaaacacgtgccaaagcccaccccgcatgacaaaatagtaaaagtgcagattgaccatgccgaccccgcaaagctcgtatcactgggggacggcatgggtgaacaagaagctgagggcatcctagcggtgctcaaaaagaacattgatattttcgcttggagccccgatgaagtggggggtgtttcggcagacctcatcatgcatcacctggcagtcaagccggatgccaagccaagaaagcagaagttgcataagatgttcgccgatcgtcaagaggcggcaaaagccgaagtccaaaaactactcagggatggggttattcaagagattgaccacccagagtggctggcgaacccagtactggtgcggaagtcaaacggcaaatggcgcatgtgtatagatttcacggacctgaacaaagcatgtccaaaggacgatttccctttgccgcggatcgatcagctcgtggattcaacagctggctgcgaactcatgagtttcctggacgcatattccggctatcactagatccatatgaatccgcctgacatcccgaagacagccttcatcaccccgttcggcactttctgtcacctcaggatgcctttcggcctaaggaatgccggagcaacctttgccagactggtatacaaagtcctttgcaaccagctggggcgaaatgtagaagcttatgtcgacgatattgtcgtgaaaagccgtagggctttcgatcatgtgtccgacctgcaggagaccttcgacaacttgcgcgcagcgggcataaaactgaatcctgagaagtgtgtcttcggcgttcgcgcgggcaaattgctgggtttcctagtttccgaaagaggcatagaggcgaaccccgagaaaatcgatgccattcagcaaatgaagccaacgtcaagtgtacatgaagtacaaaagcttgcaggccgaattgcggcacttagccgtttcctctcaaaagcggccgaaagaggtctgccattcttcaagaccctccggggcgcaggaaagttcagttggacaccagaatgccaagcagcattcgccgagttaaagcaatacttgcagagcccaccagccctcgtaagcccaacaccaggaagtgaactgctgctatacttagtagcttcgccggtggcggtcagtgctgccctcgtccaagaaacagagtccggccagaaaccggtttattttgtctccgaagcactgtaaggggcgaagacaagatacatcgaaatggaaaagctcgcttacgccctggtgatggcttcgcgcaagctcaagcactacttccaggcccacaaggtaatagtgccttcgcagtaccccttgggcgaaatcctccgaggcaaggaaatctcaggtaggcttagcaaatgggcggcagagctatccccgttcgacttgcattttgttgcacgcacgactgtcaagtctcaagtactagctgacttcgtagccgaatggacacctgtgttcgcttccgaacccgagcccgtcgaacaaccctgggtgatgtgctccgacggttcgtggtcgcacaaaggggcaggcattgtggcaatactcacttcgccgaatggcgtaccagtccggtacgccgcaagactgcagtttaatacaaccaacaacgcagcagagtacgaagccattcttctgggcctaaggaaggcgaaaacactgggagttcggcgcttgctaatccgaaccgatcctaagttggtggcaggccaagttgacaaaacctttgaggcaaaagaagaaggaatgaaaaaatatttggaggctgtcagaaccatggaaaggtacttcatcggcataacagttgaacacttgcctaggggccagaatgaggaagcagacgccttggcaaaatctgctgcttgtggcggaccgcatttgcctggcatattttttgaagtactgcacacaccaagtttgcctgtggacagtttgacagtcttggcaatcgaccaagtgaaactgggcgaagacccaaatgactggcgaaccccgtttgttaaatatcttgaagctggttggcttccggacgacgaagcagaagcaaagcgcttgcaaatcagagccacaaagtataagttggtctcaggccaactttatcgctccgggacgcttcaacctctactccgttgcatctctttcgccgaaggtgaggaaatggcgagggaaatacaccaggggctatgtggcgcgcaccaagctgcaagaatggtggcctccaaggtatttagacaaggggtttactggtcaactgtgttgaaagtctgtgctgagcaaattaaaaagtgcgaaagctgccaacgtcatggccgaagccaatctgcgccccattataacttgcaacccattgcgccaatctggcccttcgccaggtgggggctggacatcattggcccgttcccggtagcgcgaaacgggtacaagttcgtaattgtggccatagagtatttctctcggtggatcgaagccgaaccccttggggcaatcacttcggcagcagtacagaagtttgtttggaaaaaaacattatttgtcggtttggagtgccgaaagagttcattactgacaacggcaagcagtttgactctgataagttcagagaaatgtgcgaagggcttaacctggaaatcaggttcgcgtcggtcgcgcacccgcagtcaaatggggcggccgaacgtacaaatggcaagattctaaaagcactaaagaaaagactcgagggggcagcgaaaggcaaatggccagaggaattgctatcggttctctgggcccttcggacgacccccacaagaccaaccaagtttagcccgtttatgcttctttatggcgatgaggcaatgaccccagtagagctaggggctaactcaccaagggtgatgttctctgggggcgaagagggccgcgaagtatcgctcgaactcttggaaggggtaagagtcgaagcgctcgagcacatgcacaagtacgccacaagcacttcggcaacttacaacaaaaaagttcgaccgacggagctgatgcctggtcatctcgtcctaaggaagaaggcgaaccctgtagcggttggcaagcttgaatcaaagtgggaaggaccgtacctcatcaaacacaagtccaggacgggatcctttcgcttagcgacacttgaaggcgaggagttcgaccattcctggaacgccgcctctctcaagcgcttctatgtctagaatgggtggcacccaaatcgccaacttgtaaaaatgtacataccgttatgtaagccctttggcactatgtaagcctttcggcaagaaaaaaaaagaaagagagaaaaaagagaaaaaaaactggatgtagggctattatccaccatggaggcccgaaccagtataaaatctctgtgtcctccgccttctttttatttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcagaaaataactagccgaacgatgttacgctcgatcaacataaaagcaaaagcgtttctttcaacacagaacgctacagatcgaaaacgaacgatgaaaagctgaaaagtcagtacacctatttcgctaatatacgcaaaggggccggcatgttccgacctaacaaaagcacaaaatgtgacgatgcgaaaaatagcgaaaaggaaataaaacacatttttattaacttcgaaagaatagaaggttcacacgatacaattcaccttacaagtaaaaatacatcttcgcccccataatcactatccctccctaaggaagggtcaggcgaactaggttcgtcatcactactaatatcatacacaaccttaagaggagtagggggcgaaacacagactaaactataacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttcgcgataagtaggacgaaatggacatcgcaccttcggcagacccttcaacgccacaaatttctcggtttgacttcgccagctcccgaaaggaggccgaatgcacgactttcggcgaaccccctggtagactgtcacgcccggaaattcactagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactacagcggaaaataaaatctagcgaagctccggctccactcccacaggcagctcaactggggtataagccaaacgtcttctccttctggatcctttttcttcaactgaggttgattgattatcgcaaggtgagcatatgacatactcagcaagccacacagcaaatatgcaagtgcacaaggataccaaaggatggcataatattggctcatttgcaaaagcagcatttagcaaaacttttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagctccacatcatgtcaccatttgcctcagtaccaccacggtacctcggaaaggagctgtgacattaccccttgcataacacaatccaccacagcgcaccttcctggatcataatcacccccttataaacaaggcatggactccccagcgacccccgtgggcttatctccgccacttctcagtctggtgctccgcaatgaaccatgctatacaaaaggtaaagccgttgcccacactggcttgtggttggcacggttaatgttccacaacagtagctcgcgaaccagtccttaattgtcatgagcacgactctcaaaaccatgtgctcacaacccaccattatcaagttttagttggcaagtaattaattaaccaatcacgattgaccatcgtgagataccattaaatataaccataagtgatagtgaaacattagttatcccaattatgtgctaatgtttctaagcatggctaagcaatcatatctaatatctagctgaaccaatatataaagcccagctagtcaagttataataacccaaggtatcaaggaataaagtaatcaatgcaaacaggccataacaaaggaataggttcacaccacccagtgacattcgaaaataaatgcacagttgaaatatatagagaatttaaatataggatcaacatgctcaaaggattgtgtttaggatctgtgtgacttgccttgcaataatcggtcttcaattaatcttcttgaatacttccggcgcacttgcgaaccttcgcaacgacggaaacgacaagctaacacgcaaaacgaagaaaaagactaataaaaaccaaataaacagtacataaaaagtaaacaaacatgtagattacaattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattatttttgaaaaggaaaagaggattattgcgtcagcggactagggtttcggtggaccgggcgcacgggcgacggttcacgcgaacggacggccgagatcgacttgatccaaaacggacggccgagatcgatcggtccacgaccggctcacgggagaagggacgataacgccagtgatgacgtcaccaccggcggcggcggctcggcggctcggacgcacatgctcgccggcgaacggcggcgcgacgacgagaacggaaagcaccgggatgaagcggacgacacggcgaactcaccggtgaccaaaggagcggcggaagaggaacggacggcgacggcgacgaagaagaagcggcggcgctcttcggcttgacgacggcgacggcgctccggcggtcttcggcggcggcgaagcggtggacggggacggcgacgaccttgcgaacccgatggtggcgacggcgaccgacgacgacggctgcaacggcggcgcgacgcggctgaaccgacggcaacgacggcggcgactaggctacgcggaggcggcgctagacgcgacggcaggctaaggcaaaggaggcgacgggtagaggagagctcggggatccttatataggggttggaaggcggcggcgaaggcccacggcgaccggcgacggcgaaggaaacttcgggaagaacgaatccaaaacaaactcgaatccatcgatttccaaaccgaagtagaggatgattccaaaagggaaaaggtggaggagatcccggagattgtttcccctcaatcaattcggccggagaaggaaaggatcgaccgaatttggaaagcggcggcggcgtggctcggctagggtttcgggcggcggccgacgcgaggaagacgacgggtccgacaggcgggccccacctgtcagcgacagcgagagagagaggagagcggcggctcggcagactgggccggactgggccgaggaggagagagagagcggttttgggccggctttcggcccaaagccaaaagaagacttttaaaacctttttcaatttaaattattcatgaaatgcaattccatttattaaaaatacttccttagctcaaataaatcccagaaaaatctaggaattatagaattaagcaaagtatttaacaaaattttatttagcccaattttatattgagatttaacaaattaaaattagatcttctcttttaggcttttaaaatcatttctaataattccttttaaacaacaatttataatttaaggattcttaaacaagaaaagctcttaataattataattagatcattattgatcaaataattactgaactgttctttgtatcatttaggaattgagctccgaaaaattcgagaaaatttcagagagtataattaatcatggagaatttaataaaaattaaatccatccatgctttagatttaggaaattttatttcccacatttaacttcacttgtaaattaaagaacatttaatataaattctattaataatttattaaataatttataaatcctgaaacgaaaatcaggatgtgacatagacagtgcagaaaaaagcaaaacacagcttacatggtaggaataggcggaagaagggggaggtatggcataatgcgaaatgagcgaaataataatatgtcaaagacttggaccgacagtaaatggcgaaaagtaggtctgttatacaaattttaaaaacgcccaacggccacctgtttcggttacaataaaagggtttgcggcagattgccgaatatacaatggttcgccacatctagcgaacaccaaaagaaaactatgaaaatctaagagaagggcggagggcctcacacctctgggtggtcctgggcatcgcttccaccccctccggccgccgcgccttcctcttcacaaaggtccgccgcctctgctttcaccagctgctccaaaaggcgcgccttagcggcggagcggccatccttctgccagaattgttttcgctacgcacgaagtgcgggcgaaatgtcttgcgcgctgatttcccaatcccccttcgcgtacttggggaactcggcgatgtgctcgcagccgaactgctgcaggaggcccatggtaaaggccgctgacacgcgcgcacagcagtcgccgtatgcggtggcgcagtccgaaaccgaaccaccagcctgttgggtccattcggagaagtcgaaggctgaggcatcttcggaggggacaccctgcacttttgcgcccatatcagtaatggcgaggcggagcgtttggcacgctgtccgcgcggactaggtggttttcaccatctcccgcgaaaaccgccgcgactcctccgtagcgcttgcttcggccttgcgaacctcctgccgaagagcctccatcttcggctcggtgaggttgtaataatctatgagcacggcggagtgggccttctctttctccagttcggcctttaagagatcgacttcggccctagcttccttccctttctcccgttccgattggagccgcttgttttcggccttcgcctccttaagggtgttcgcaagggcctccatctccaaatttttgcggcctaattcatcatccttggcccgaagacggcttttgaacccgtcaaggcgggctcgcacggttcgctctgtcgaacagtgagccgtgaggatctgggtgcaaaataggagcggcgaagagaacaagtgttagttgtaaaaacatggttaaattgttccggaagtacagataaacacggcatgaaacatagcataataagcagatagctaatgtaagcatagatttaatatcagtgaatccccttgagcctaaaataaactatagattagcagctaagcagcaaccattcttaactgaagaatgacaaagacaaaagcaacacagtataatcaagataaataaaacatgataagcaatatttcagaaccatgtgaaagcaagataaacaccaacaccctaaccaagtaactcacaaaatgatgcaatggaacctcaccaactgggcacccaccattacccccgagcagatggcctatggctgaggacgaaacatagcttggcctatgttcaaactacagcaacaacatggtaagctagtcaagcactcagaagtcagagaggagagagatggaccggagacgaaacatacgcacctagcggtgaaggggcgggcagacctgcagccgtgggcacccgtcgatcccgttggggacggtgtgtccagccaatgaagatgtacgccagcaggccttgatagaatagcgggccgatggctgaggacgaccgtagcagaagattgtgtggaaatcagcgatggcagcgatttcggctcgacggggtagagagacaaagaaacggcggcgatggagactgcgcgggtgaaagggatatatcgatctggtgaggggaaaggcgagcggtgaagaacccacggtggagcggcgacggtggagacgcgaaggaagtcgcgggagcggatggggaatggaaaacctagaagccgcggcagcggcggcggcggcggcgtagatgcgaacgaccagaggaatatctgggagctggtagcggctgcaaagaaggaaaaaacgaacggctggatccagtcaagcaaacaatcgaacggctcctggcgtaatgcaacagtgaaacagtaaaacagtagcgtacagtgccggacggctgtggttgcaacggcaaaaactatagattttatatgatggatgacaccagtgagatttatcctttgacaccaccacgtccatggaagcagccatgaaagcccatcatttgcttaaattgcttcggctaaagttagctaatacaacccagccggctagctattgcctgttgggctgttggcagtgagcagccgaacatgttgtgtctaatcaataacgcatatcccaacatctcaatgaatttttccaacttcccattcagtttgcaaacaaatttcttttccacttacatttatataacatgtcacctaaataatgtttaaaaacttctattaatttatttggtttaggtattttatttctagagattttgggggctctaaggctccgagctgttaagtgttgttctttggtgccggttggatagtgtacggacacctggtctaaggtttttaatattcatttgtaatattatgtttgtgtagaaaaaaaatacttgtggtgctatttattttgcatatatgtatctagtatgatctagtatatagtttgtggtttttcaggatggtaacttagttttagtaccatgcgatcactggatgtttaactgctggttatttgaattattatgcaagttcatctacattattccacctattaactctactacttatcattattcttattacttttcatgtatattattactttgttagaaactacgataattgttatgatttaacgatgacaccattgatccaatatcctagatccgcctctcctagtggttaggagctaacgaggatgggggctggtggggcggggtacctcaccgctactgacttgagaagagggggggggacatcgagtgagtagcgcttgatcccgattctcgtgcgacactggtgtgagggatgtggttaggtttatgtcgtactgcatgaatcttaaagcatccgatgatctaaaatccgcaatattttattaggtgtttgtcgagctctagtgacaaaatggaccagcaggtccagcaccgaccggcccaatctttttttttccaaagaaacaatggcccaattaacaagattgccccgtgtggacgtgtggaggaataagctcattttgactctcttaaaccacaaaaccgaatatctcaacccctaactattaaaaccgatgcaatctaactccctcggtaattttggagggtgatttcactgacgtgatgcctacgtggcaatgttgacccggtcttcgtcctacgtggcgttgacgtgacacatttgtgtcattagaattaaaaaaatatgtgggacctatttgtcattaaaaaaatatgtggaacccacgtgtcattctctctcatcccctttttcctatagatggccaaagggcccgcccggcatggcccggcccaggcacggccgagcacggcccagcagcaatcgggccggcacggcccgataggcacttcgtgccggggcgtgccggcccatgggctgcacctcccgcccaggcacggcccaccagttgtcgggccgtgccgtgccggcccgaaggcatgggtggcccatcgggccttttttaaaataagtctatttttcgtccctcctctttggactatttcatatgtatagctaaaataagtctattttccgtccctcctctttgggctgacatatgtatacctaaaataagtctattttctgtccctcctcttcggctgacatatgtatagataaaaaagtctattttagatccctattctttcgttcatggcatataatatgtctaatttttactt

SEQ ID NO: 74922 - DNA, 19472 bp, Oryza sativa
catccctccaaaaacccttatatctatgaaagatcagagtatccacgtattggacttgtgctaagattctcaaggagataggattagatctaaattagattgtacatgtattatggctgatagttattgaacaaagtgtaagactgcatattatctaatttaaaagaactcactatcaagctgctttaaattcactaaagcatatattgcaaacatcattttagagcaagtctcttgtgttgaagactacgagcttatcagcagaaagtcaggagaaaaggggagcgcatgcgcacacagagagagagatggatagagcgcttaccttgtaaagcacatagttaatgatgtgttccaacacctttctagtctcagaagaggttaattgaacaaaaaatagtgtctgcataaaagaaaaaacaacattaacgccactattgctaatatgatatgcatacgttaaatataagctaagctgcaacatcctctttactaaaaatcattaaaagaaatctggatgctcaggtaaaatggtttccgctaaatcatggattggaacaatggaggaagaacaatgccctgccttgtgccttcaaaaaggtcacctggacacctggctttgtaatagtatgaaccatcctttctctcatatataagtcactaagaatctaaactaggatagcagactagaagtttagcttcctctatgaaatagtgtttttatataacatagttatcatgtttgcaatgcaaactgtatgcatacatggaggacgagcttttccaacagacaaaatgctttgattgaactacaaaattgggtcaaactctaatgctccttttaaagattcctatggaagtaaaaataattaagtacagccagtttacgacatgaatcaagaagtggatgtatcaatacaagttcttacatgaatattaaaccacatgcacaaaaatgagtctagaaggaaatcgcaacgaaccaagtcacacactgtcagcttagctcttgctctatcaaagccatataacagccattcagagacgtaacagaaatcctctagcatcgaacaacaaaagtaccacatacaaatatccagttcagatttcagaaccgcttaacgtaacaaaaatcctctagcatcgagcaacaaaaataccacataacagaaatcctctagcatcgagcaacaaaaatactacgtacaaatatccagttcagacttcagaatcgcggtgttcaagcctgtattcaagcatgttgttgtatagttgctattggcattgctacttccccatatgttccaactaccatagtttagataagcatctactcaactgaaatgcaactcctgagaacatgtggttcttcgcaatcagctaaagcacaatattcctactaaatcactccattatctcacacacttgatgattccaaaaacaacatggaaacaaaatgtcattagctgatttaatgaaggaaaacacgtccattctaactaaacaaattaagtttatttctacctaaacatcaaacatatcttcagcacgcaaattaaaccaacaaattgggcagcaaatttgaatcaacaaatttgggcagaaaaaacacctccatcttcccaactatcagcttgcatatattattattgcttatattattattactgacaagtggtcaaccgacaaaagtttttttttccccaaacagcacaatctaagcgaatgaccgcgtggccctgagcagcaacaatcccaacccccatcccattcccgatcgaccgattgctcaccttgagggagaggatgaggacgaggaacacgtgcgccgccagattcgccaggagcgcgacggtcacgtgcgagcccagcaccgtgccgagccagtcccctcctcctcctcctcctcccccgcccgccgcgtcggcatccccgtcgaggagggaccccgcccaccactgcagcgccgcggcgctggccgcggtggatgccgcggcgacgtagaggctgttcaccgccgccatgcgccgcgcatcgaagacaggtcccccacccctcctccacaaccctatggcctcctcgtcgtcctcgtcgtcgccgccgccgattcgccggcgatgcgggggaatcgcggggttgcttgcggctcgggggaggtgtcgacgacggctttatttcgggggggccgcgacgccgtgagaaaaggggggattgaggggaggaagaggaaggtgggggggggagccagggggacaaaattattgacgacgggatggatagattggaattaattatgttaattaaagtctagatatttgacgggtttaatacgggagaattgtgcgtttcagtcctaagggttatctgtaatattgtttctttcctaaaatagattagtactctctctttgtcctaaatgtgaaagccatataccagattagatattttatagtaatatgaatatgaacaggaaacctctgatcatattcgtctgatgctagtttctatatattggaatgaatggagtaataaattttagctatcaatttagacaaagtgcatgtatagattcgtagctaaaagttactaaaagtgcattatacattttatagtactacgaatataaatatgaaacatgattagattcgtagtattttaaaatatcaaatctgatactatatttctatatattgggatgaagggagtaataacttttagctatgaatttggacaagtgcatgtctagattcgtactaaaagttattatattttgggatggagttagtatgatgttagtattatttcttttcggagggagaactatgttatggttggatgatgccttcaacttgccaaatcccaactttaggtggttgttttgcagttgtttagttgatgccattgttatgggtagctatatttttcatcggcctatttcaaagacacaattttttgcaacactttgcctaaagcttcaccttatgtaatatgaggtttggcaatgttaatcatcaatcgaacatatctttatctatctattgacatgtttggtattgctccagcctagagaaaactcaaagctgtagagtttggacttgagctatgtttgatttggattattaggcagattactgctactgattatatacttaattatatgaataaattgaatactttaagaaacaaacttaacaaatatgcgtcctttgagtgtattttccaaagcttagagtaaataatccatttcaataatctgaaacgaaccataaaattgtttaaatatgacaatacacgcatacttaaatgtatatatttcctatgaatatagaagttggatttctagcaactattgtatttctctaaatttccctgtcaaacttacaaaccttctccatttaactgttattaccatttactgtgcacatgtctcctccctacgattgttgggggctaaaatattttttttatctctctacattaatattgtaataatccttttccagttataatagcgaagaaatttattgcaaaaagatagcggtggtgacagtgaacccgccaacccatttatcctatcgtaaattttgcaaattactcattcaaagatttaatgttaaaaatagagaaatatcgtggacaatcacatatgaaatcaagtgaatgtttccctataaaagataaggtagtaacatatttcatgaattatatagttttacttgtatttgataatagtatgatatagttcttttatcatagtaaagcataaacatttagctagtatttcgaaaaaggatgtggtgcacacacaaaagaaaaagaaaagaaaaaatggttcatccacggaatattgcaatatgctgcgaaggtaggtgcgtttgtgcaaaacggggtacgggccgcgtgcgacgcctgcctgcgcacaccaccagcagcgagagcgagagagggggcgtggggcggttggcgcgccaaggcaggtgggtcccgtgcgtcggtgagtaccggaaaagcgagagctcggtaggtgacgcgtagagcagcaagccgcgccacgagcgagtgaccgcgcgacacgaccccgacccggcccggtcggtgcggcgcggcggaggtcgcccgggtcagccgctcgccgccacgcgagacgagacgatcagacgagggctaaaataaaaaaaaatcttctttttttttccctgggcttgctaattccacgctgcccctctttaggggtggaaacgagccgagctgagctcgcaacaaactaatttggtttggcttggcttggttagggaaacaagttaaaactttagctcggctcggctcatttcttggctcgagccagttcgagctggcttgcaagcctttctattgaaacgactcttcatatatattttataaatattaaaaaaagtaaaaacaaatcattaacatgtaaaatttaaataagtttatatattcaattcttcaaaatcttaatgataaattttaagttgacaaataataacgccatataaagtaaaataatcgatataaacacacgatgcctaaggctcgcgagccaaaacaagcggctcgcaagctagctcggctcggctcatttcagcaacgagctaaaaagatggcttgggcttggctcgtttgacttacgagccgagcctagccaaccaaactcaagccaagcccgagccaagctcacgagcacgagttttttttccacccctacccctcttatccgtttgtggacacagcgaggggcattattgactttgcagaaatggagggagaaaaaaaaaagatgcactgctaaaaaattaaaattatactactcgcttcgttttcaaatactccagtagtactgccactagactgccaacattgactaggagacattcgtttttttcttgaccactaattattcctcaatagtttgattagactatgaggatggaagtgtgcttattccttaaccctaacactatgtaaagagaggattaaattttggacgtggcacgcttttcaaactgctaaacggtgtgttttgtgtgaaaattttctatatgaaagttgctctaaaatatcagattaatctattttttaagtttgtaataattaaaactcaattaatcacatattattacaacattgttttgcgtgaaacacttaatcttcatcttcatcttcatcttcaggagatttaaacaccacataagagaatggaagttttattctttgttgaacatggtcttttagttcaaaaaattccaacttattttttcaaactatttcaatattcgatcactttattcccttaagtattttttaagcttagtttatcctgaatttaattaaaatggttcactttattggttaattgcatttctcttctttgtttatctttatatgagtcatactttaagcttaaattttatagagccatagatggcatcattatcaaatttataaaaatttaataactacttgcttgaaagttaaaaccttcatgttaaaattagtttcggtgtttccaacctatgtaaacagcgataacaaaaaaaatgttgagaggtaagttataatacatatattaatgctatcaaattttatttcaaaatatgatttatacaggcataaacgaaaagcccaaatattatcatggagtaaggtgaactattgttaagagttgggtataaaatgagacgaaaagttgtctaagggttaagtgctctggtgaaaaagtttggggagtaaaattgacattttgcttttaagttactcaaaaaatggcctttttttgctttttttataaaatataaaagtttgaggatgaatgatttctattgccagctatttaaaaatgggggagtaactattttgctatgacgcagtatactaaagtgttgattgtttgcgctactttgcagctgcaggctgcatcaacagtagcagctactcaaaaattaaccgcggcagcagcagcagcagcaaggctgtgctgccacagctagcataaatgaacaacccttaattattctattcggtaattacatatttaacactgaaataagatattgtcaaacatttgaaactttgacaatcaataactctaaaattagttaatttcaaaatgcaaaagtggtatgggcaatctgcttagaaatgtactaatgtacttcataatatcttaaacttattaggttaataaacttgttctaatataaacttatgaccaaagttacacaccaaagaccttaaataacaaatatcgtattttttttactatagaaagcactgtcagacctctagcagcaggtattatacaataaaacaattaccagactgcaataaaaattaatggtttgcctcacaaagtaaatgggcacccaattaatgcacaatacaacaagaatagtacactacaattaatcttgtatattataacaattgaccccatgtagtataattattgcttgatccaactatcacaacaacaaagcaaagtgttagtctgtctactagcagagaaaacacacccttaacttgcatctattttgtagcatttttgtcatgttcctgcagcagcaagtgggttttccatatatatttcatacattgagctaaacacaaaccaggtttatcggttccgttccaatatgtgccattatattccaccacctaaagctatgaagcgagcgagcggcatattgttccaatcaaaatatcgttaatttcagttattctgattaaattctggtcggtattgatcagaattaacataccacttgtttcagtatattttaaacatgagtgatctttccgttgaatttggcttggtcgattcataaggatacatgataaattttgtaaaatatgatagtaacatgatgaataactttgaatcactctatttatattttgtaaattgcaagttctattctggagtgatctttatttcagtccaaagtggctcttgccatgcactggactttgctcgtgcaatgttcatgtattcttaataacgcggattcacctaaaggcttttttatagcattaactgcactaaaagtcagtgggtcacaattacattcaaagaaaggattatgtctagctataaactcaatcatccatgttatattgctctcattgctatcatttttagtataattatgggcacaaatttgataaaatattgcataatattccctccatcccatcataatatgagggattaaattatttaaatttgtcccaaaatataagggagtctagagcactacctgtgcaccaattgaccctcattcaattttcttcccactaaacaaccttccaaccctaatattgcctaatctagtagggaaaacatatattacaaacttcatatgtagtgtaaatctggaaactgtcgtacgatgtacaagtgaacgtttgagatttgtctatatcatcataagcaattttttttactaccagaacaaaaaattacttatgattaaatctaggagaaaaatactcaaggtgatatggatgaatctcggatgtccattcgtgtatcctacagtagtttctaggtatgcattacacacttcctcaatctattgaggggtatttgatctttttttcattttccttaatctctcaaatgcatactaaaatcacttctagtatatgatggagttagtaacatatttatactctctccatttcaaaatgtttgacaccgttgactttttagcacgtgtttgaccattcgtcttattcaaaaaatttaagtaattatttattcttttcatatcatttgattcattgttaaatatactttcatatacacatatagttttacatatttcacaaatttttttgaataagacgaacggtcaaacacgtgctaaaaagtcaacggtgtcaaacattttgaaacggagggagtattatcttattaaaccctgaaacggtacatctgtatcggttggtatgagaacttcctttctaagagccaaattggaatggcctctcgaatgaaattgacaatcttgatgcatatagggtagaaaaaaagctcgcttgcccggcttgatggctcagtccaaaattgttgcgattcatctagtttttcttttgagatacaaatttcaatctgaaaccagaagacgaagcatactaaaaaccgattggtatcttcgaaaaatagataagaaaaccaaatttgttttcgtcgaaaaatatagaaaaaaaatgttagataattggaaaaaaattgtgaaaatgccatttcctataaatttagtaatctcccattgacatacacacaatatgtaatacatattcataaaagacaatacatatcactcaccagtcaccaaccattggccaaatagaatgcctgtcacctaaatattaaagtccattacgtacatagtttagagtccaatacatatattgaagtccatttcattactacatggaatttggcccatgaaagggcttccctttttctaaataattattcttttctttcctactggacaattcaagaaatgcatggaatgcaacatttttttgaaaaaaaaaatatcctagtaggctctatgaacatcaaactatttataggatttgatttgatttttttcgttttttatcattttaaatttaaatttgaatgaaacccattgaaattctagacgactactacttttgagtcacgccaaaacttcagtgttcatcgaaattgtgaaccctctgttcactccctttagctttgtagacatacatagatcaatccaaagggcatgcttggtcactttcacacattatcacatgtgcgtttaaagcatctaggcccccgtcgttgattttggtaattaatgacaagcgctatttgtgaactaactattatcttgagttatacattttgagataggttcatatgatgtgtatgccatggatgactatcgaggattaaaatcgatggcgcaaagtaaaaggaatgaagacagtaaactagtggttttattttaattgatcgaggagtttgggcgatcaaaatttgctatatttatttatagctttgtcatactatcaaaaggggtaatgacctaaacaaaaagatgatcaaaatgctacattaggtcatttgtatttagacttggttctctgttagaattgaattgcatcttcggtccagggccggtctgaccgaggacattatgccggtctgaccgatgatcccaagtcggcctgaccagcgggttgaatgcctatggttggcctcgcgattggcgacccagagccgccagagccgcagccatggccggtctgtccggccaccctatggcggtctgaccgacccccgtgtgttaatacattaaatgcactgtaacggctagttttccaaccgttacaatgtagtccggtctgatcggccaccccatggcagtctgaccagtagagcacggagttggggatttcgaccctcaatggctagtctttgtgtgtgtgtgggggggtataaatactcccccaccaacaacagggggactctcttggcacttgcttcacttgcatataccccttgcaactactctcacactctctagtgtttgtgttcatccattttgtgtgattgagggttgattagtcaagagtcaagtgtattgcttcattgtagagctagtgcggcacttgatcatcttcgagccgggtcatcgcttgttactcttagaggttgccatctcctagatggcttgtggaggtgtttccctgtgacctctccaaggagattatgaagaaggcccgacgccagttgtgagtggtttggagtttaccacctttggagttaaggaagaactacctttagtgatcgaggctttgacatcctggccgagggcttaataggattaatactcatatcaacaagttgcaacttcttttccggaagccgatctctaaagaactctgaggttaagcgtacttggcatgcagtaatttagggatgggtgaccgatcgggaaactcttcccgagtgcgcacgggtgaggacaaagtgttcagaaaagactctatgagggcagtctataacctatgaaagctgcaagatgtaagtgggctcggcctgggaaaggcgggacgttacaaaatggtattagagccgactctcgcggtttcacgggcgcgcgtcgcagttgcataggcatgtgcgcatggctggtgtggactcttgcggtttcacgggcgcgtgtgtcgcagttgcgtaggcatggtgcgcatggctggtgtgtacttggagtggtcacacagcatggcacatgcgctggcattggacacacggacgtggccaagagggaacgttcctagcttgacaagttgcaacttcttttccagaagccgagctctaaagaactccgaggtctcgcggttttacgggcgcgtgtgtcgcagttgcgcagacatggtgtgcatggcttgtgtggatatggagtggtcaaacagcatggcacatgcgctggcattggacacatggacgtggccaagagggaacgttcatggcttgacaagttgcaacttcttttccagaagccaatctctaaagaactctgaggttaagcatgcttagcctggagcaatttagggatggatgactgatcgagaaattcttcccgagtgcgcacgagtaaggacaaagtgtgcagaaaagactaattttggtctatgagggcagtatatgacctatgaaagctgccagatgtaagtgggcctggcctgggagaggcgggacgcttgacgaagggggcatgcggtggatagaaagctgccagatgtaagtgggcctggcctgggagaggcgggacgcttgacgaagggggcttgcggtggatagaaagctgccagatgtaagtgggcctggcctgggagaggcgggatagtccacttcgtgggccggctcccacctcgcccaccccttgacgaagggggcttgcggtggatagaaagctgccagatgtaagtgggcctggcctgggagaggcgggatagtccacttcatgggccggctcccaccttgcccaccctatgacgaagggggtttgcggtggatagaaagctgccagatgtaagtgggcctggcctgggagaggcgggatgttacagaggcttgggtagtccacttcgtgggccggctcccaccttgccaccccttgatgaagggggcttgcggtggcttcgtggttttgagcggtgaagttgggttcgcctcaacggggattaggaaccggcgagtttccgaacctcgggtgaaaaattccttgtctcttgcctcatttacttattgcattttcatctgtgcaatttactttcatagagacatatctgagcccatatcaccctaggatttcaaaacataacttagttgcaatttactttcatagagacatattttaagcccacatcactctaggattgtaaaatataacttagttgcttagttaagtttatccctcaccaagcctagcaacttaggttagttttgattaggtgtgatttaattttaatcgcctatatattcaccccttgtaatcgacatctcgatcctacaacgtctaataatttgctagtcactggtgcatgggaagcgtgggaagaggggaagggcaatttcccttttactgtagtaaagatatgcttcctccgttttcaaaataaataaacctagtatgtgatgtgacatgttttactgctatgagattattaatactaactcatagtactaggatgtgtcacattccgtattagatttgtttattttgagacatgaataatatgggattgtggtgggaagagaacgtcgtggttttttataaataggattggggcgagaagaaaagggaagaaagacgattgtgctacatagtactagcaaattagccatgctatgccatgggatacaaaatgaaaccatttttccgtgtttgtagtaggaaattttagttttgtttctattcattttctaattggctggttttatggaaaaccattctttcttctttttttttggtggggatggggtgcaacatcgattttctccagtggtttttttagatttgttgaaagcgtgggtagagaggaggacgacttcctttttaatgtagtagagatagttgcctattttttaggagaaaccgttgtttttatagagcattagatcacatcattggttttctccgctaatttttgtagatacatgggaagcatggggtagagaagaggtgggcgacttgggctgcactcatttatgatggttaggaacttctcacatgggcttaaaaaacaagataactcatttgcacatgattaatttagtactccctatacagtatgcaacatatcttaaagactacaaatctggatatacagctatccaaatttataatcctaggtcatatcctatcctagatacatttatattgggactgtggagattatgggtaccccatacacacacggcatggttatccgactagttataggggataacttatatctatgaaatatgtaacagatcatgacttgggtattacgtttccttgtatattatggaacggcctaaggtcctggtttaatgatattgtaaagtagatttaggaaactgataccgtattggttaaggtttctattttgtaatcctgccctccatcctatataaggtgggcagtaggccctctagggggcagatgagacaactagatcgtcagatctataatacactcggcggattcaaatccccaaacagaagtagggtattacctctcattgagagggcttgaacctgtctaaatcattgtctccgcatccatccacttttaggtctcgtgcgctaccccttttattattgccgaattcttgtttcgacaaggacatagggaatattaacggatttcggtgattttttttgagagagagcattagagcaagtttaatagaagtatagccaactgttaggtataaaagctattccgttcatctaatttaatagcctaccatacaatagtttcatataaatatataatacactattaatacttagcccatctatcacgaaacctctaatgggcgatcgatcgcccagccgatggggtagcgatcgggtagcctcccccctccctccacctagtttccttttttgacaccgtattactttcctattttagtaagtttatacacagtttacacatctaaagtttagagaccaaaagtttataagtcaaaagtttatatatccgattcaaatttgaatttgaattcaaatattttttatatatagtatttctatacatctaaagtttatacacctaaagtttatagacccaaagtttataagtcaaaagtttatatacccgtttcaaatttgaattttaattatatccgatttgaatttgaattcaaatattttttatatatagtatttctatacatctaaagtttatacacctaaagttcatacacccaaagtttataagtcaaaagtttatatacccatttcaaatttgaatttgaattatatccgatttaaatttgaatttgaattcaaatatcttctatatatagtatttctatacctctaaagtttacacacctaaagtttagatccaaagtttataagttaaaagtttacatagccgattcaaatttgaatttgaattcaaattttttatatatagtatttctatacataaatttttttaacttttgttttttttttaaaaaaaaatttgtggtgtagaaggaggggaggaggaagggggagaggagggaggagtgtattgagtataggggagggggaggacgggacccgcccattaggcgtgccccatctatcacacacacgtactcctccgttaaaaaaaaactcaccatcgaagacaataaatctgaacaatctcatgtctagattcgttgtcaagttattctttgttttagtggagggattaatatcttaaaactcgtgctgcagttcaacataaatctgtactccgtttttcttttatctccttttctctttcttcgcatatgttttttatgggtgaggattctctaccataatgtcactattacgtgaatcccacccttctattatttcacatgtcagtgtctgtaatggtagtgtaattatggtagaagatgtgaacccgttttttactaccttgtcttatagtattagatgtgaacctgttttttactacctatcttatagtaatggtctactgtatccgtcctataatatagcaatctaggatatgatgggatgtttcatagtgcaactaatctggatagaccttctgtctagatctattaaactataaaatgtctcggctgattctaagttgttatattatgggatggagggagtacttgctattacaacaactgatcaagcaagcaaatcaccgaaaccgctcccgaaaattcaaatatccaacgctccatttcgcttccccacccaaattcccaatcccaccccgccgccgccgccgccgagcgataccggggccgccgctccccatggacgccggcgacgcgagccgcttgggggagtcgctggacgccgtctccgccgccttccagtcccgcgtcatggagctccaggagctcgtcctcgcccgcaacagtaagctccctctctccacaacctcacccctcctcattcccatctctctctctctctcctcccatcaccgaaaccctccgatcccctgaccccgcctgcctcccccacacgttcgcagtgtacccggctacggcgataccggacctcgccgccgtcgacgtgtcgctcacggccatggaagcgcagttgcaggcggtccgccgccgcctccaggaggagcgcgaagccttccccaaggccaaggtatcgtcctctttctaagatttaatcaatgcactgttaaattggcagtacaggttgttccttggttgctgatttgacgaacatggggaggggatcgacacaacatattttgattaggacctaaacaatcaaagggatttgatacccactaatcccttgttaatccaatcctcctgtggcgtgatgggttgtgtagaaatggttggattaatcttgcctgttcctgcggcgtgatggggttgcagtgagtgtctgggtatgggggtaaatggatatatcagttaccgtagtttgagtatttggagaattgaacaaaaacaaggtctttgtctttctgggaaaaaaaagtattatatctttcgataattttgctattgctcctaaatccaatcttaattttgttcaatctacccgtgaaatgaaatatttctaactagtgatttcctcaaatactgatgtagaaactagtacaacagtccttgaagcaacagcggaggctgcagcttatgcttgcaaacatgccaactgggatgcgcgaggatgtctttgctacacctctggaacataattcatcaatgtatttgtgaatattaggaaaatacattggctgtttctaccttcatttgtgatatcaagttttgtgcgttacaggatgtttcctgagtcgctcaatttcagctcggctgttccagaagtcagagaccatgatttaaagattaaggaggagccaactgcaccacccaaggtaaagatatacaatcttatgtaacttttactcattgtctacaattcttttcagatagaaattataattgtgtcatcatctaatttattcttttattactgagaagaagggaagaggacctgcacctcgttggtacatatccactgaggagcttgattcgttgtcatcgtgagttctcaattgcaatgatagcttcatttcatttacttgtctttatataccaaccacattcctttatctgcatccaatatgtggttaagtgtttttttttggtgtttacatctgtccgtttgagataatgcgatgtataccatatgaatgtgctacttctttctacaccattcttcttttctgcatacttagattttcttttctgaacaaatggtaagaaatgctaggtgaatgttttgtgatttacctagggcctgttcagattgtagccaaaataaatcttaccaaattttggcattgtcaaaattttgccaatttggcaatattgccaagttttggcaagatttcttatttatttattagagtttggtacgaaactaaatggatgcacatatttggcaactttgccaaaaaaatggtatggtttgaaatggcatcaatctgaacaagcccctagaattgagcctagacatgacttgcagtcaaaacatctgccttctttgcctttgcatcatctttttgctatgtgggtctcacaggcaatgaaggttgtcatgaggtttatattatcaatccagcactactgagtatggagataagtgcctatttacctatgttcctataagttgaagctgttaaagtgctgcctattggttttgtaacccatctatttcattatacaccaagttcaatcagtagagaacctgaaatatcaaaactcaagagacaaacaatgcaatatagctggtatggtcaacttctttgagtttcttataaatctaggttctttgctaacttgtctttaagaaatggttatacactatagaatagacgaaatcacatggaagttggaacaatatttttactcaggaaggttgctatttcattttcccattgtgtagaactatataagacatgcaaactggtgccatgccttcaaactaaaaatggcatcccattttgttactacagatacatgagagggaggctcactctggagaaggttaacattgccatcaatgaagtggcttcatatgcggacggcaatgctcatcttgttgcatgtccaaagaaaaaggttgatcatttcaataactttactccaccttttatttataaaaaaaaatcaagattattgaaaaaacagtgggaactagctggttcctgcacataaaccaaatttacccccaaaatcagatgtttcattttctgtttttactaataagcatcatttgataaactgtagaaatttccattcttatgtggagactttggagagaacttgaatataatataagtactaaccgttaaggaaacaattgaactttcccgatagcagaaaccagcacatcttttgtcacagttttcaaatcaatggaagtttaacctgtaaacagccattgcccagttgtatggtaggattggttgttgaccatccttaatgttcttgcagttatcagaagacacatgggagaaggcactggtaagttctggaaggatgttgattcgatttactcatttttgtgcggaatcagcatttttttttctttttaggaattaagggacattgcagcaagagagtcagttaaggggaggcatttcttcttggaaactgatataaagggaccgggcttaaaacttgataccacagggaaagcaatccttactgtaagtatatgcagctttgaccacttgtgtacaaatgattttttttcttctatatctctaagatgattttaatgatatacatatttggtagacaaaaatgctattcaaatttttccctttgtagttggcaccctttcaaagaaatttggtagcataatttgtatttgtcaaacttgaacggggtagagaaagaacatggtacgctaaattaaacattaactgtggtattgaagttaagcagttaaacaattccattcatatgttttgccctgtttaacaaaattgatttaacatttcataactcatgcgacgcaccatacttacactgcattcctgtctgtttatttgtataacagccagtattaacgagactactagtaaagccatttacttggcaccattaatgatgaatatttgcttgaatgaaaataggatgctacacactaatttcttgaagatgtgaaacaaaaactactactgatttgctcttgccaattggaattttccttttctgccgcattaatcttctcgtgttttttcaggtccttcgtcatctcggccgcttccaggagacccggattgggcatcatcgcgttttcatactttcaaaacaacagtgaatgaagggtctcctccaagctttatttaggtgctggagaatataaagtttaatttggtgttaggctggagatagatacgcatgcattgagcttgtttactaattgctatgctgtagtttgttgtatacaggtcagggcaagtactataatgctctatatgctacccctaaaattgccatattggattgagtgatgaggtggaggagataagtgaggagagagatgatgaaccacccctaaatcaagaggcaacctccacacaaatctattatctatctatctatctatctatttctattatataataaaagtctattaaattttctacaaattttctcaagctgccacgtggcattctacgaacgcttctaagctgtcacgtggcacttttagaaattagaaaatttcttaaaaatctataaaaaaaaggaaaacattttactgttgatttttattaaatttagtggtcccattattttaagcgtttagatttatccgaatcaacctacaggtaggaacgtacgcacccctctttctatgttatggttgttaagatttaatccataatttgttacagattaatctatctatactaatataaaaaggagttgtctccttgcaatcttacaggtgaaatccacatacttaatccccaccgtccatccgacatctcatctaatctgatccgtcgtctcatctcatcatcatcgctgtgctaatcccaccgattactccgcccccgagcgcgcgactccgccgctccaatccccgccccatcctcgctcctcttcacatcctccctgctcttctcatctcagccgcacgaatccccgccgcctcgatcactcgctccgctcgattccccgttgccgccgttggaccagccaccctcctcctcgctctgtgtgcatcctccctctctcagcagcacgaggaatccccgccgcctcacctgccccggctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggcctccatcgcgagctcgatctgcagcccttggtcgctggcgttcgaagctggccccggtgtggagcacgccgttccgcctctgttcaaagccctccaactcctccagccgtaatccccaaccagacttgctccatctatcgccaacactcgatctg

SEQ ID NO: 74923 - DNA, 58553 bp, Oryza sativa
ccctgcactacatatacgtggtttccaattttcccggatgatgagcccaggcgacaaacctctcgactcgacgacctcgaaggctcgaacgactggacgtcctgcccatcggggagctcccactcaaaccagcacgccatgttcgccaccacgagctccgcgagccgcgtcgcgaacgccatgccggggcaccccctcctgccggcgccgaacggcatgaaccggaagtcgccgccgccgccgtagtactcgacgccggcgttgtccccgccgtcggcgaacctccccggcctgaactcccccgcgtcctcccacgccgcctcgtccctcccgatcgcccacgcgttgatcatcacgcgcgtccccgccgcgacgcggtggccgtggagcaccgtgtcctggatcgcctcgcgcgggatgagcagcggcagcggtgggtggaggcgcatcgcctccttcatcgccgcccggaggagcgtcatcttccccagctgctcgcctgctcctccttgacgatgacgacggcgtcttcgtctccttctcctccgtgtgcagctgctacgacatgtctcacctctgcttgcactttcgccatttctgctgggttcttgatgagctcggccattgttcattctatcgacttgtagactgtgtccgtgcctgccgcgaacatgtcctgcaatgcgacatgaaagaaatcgaaacgaattttagcatgattatttgattggtgataattggagagaacttaccaagatgaggagtcccttgacatcgatcctgtcgagcttgtagccatggtcgtcgccgccgttggccatggagagaaggtcgtccatgaggtcacgggcctcgccgtcgccgtcgtcgtcgtcgtcgtccccgcggctcggctcgtggtcacggagcaccatctcgagaacctcgtcgagcttggccgccgtcctcttcgtcctcgcgtcgagccccgtcgcccagtccacccaccggagccgcgggaacatgtcgctcactgcgatcgtccccagcaggtcggcgagctcccccaccgtctcgcggaccttcgccggctcgacgccgccgagcttcttcccgaacgccgccctcgacacgacggcgtgggtcaggccgacgatgagctcggtcaagttgacgacgcctccgcctccgccgctcgccgcgcggatccggttcacgaacgacgcgacctcctcctcccggagggcgcggaacgagtcgacccgcctcgcgctgaggaggtgcacgacggcgacgcggcggaggcggcgccaccgctcgccgtaggggctgaacgcgacgtcccggcagccgtacagcgtgccccgcgccgtgtgctgctgcggccggccgcagaacacgtggtcctggtgcctgagcacggcctccgccatggacgccgaggagacgacgagcgcgcgcacggagccgagccggagctggaacagcgggccgtgccgccgcgcgagctcgcgcagcgcccggtggtgccgcccgcggccgagctggtggaggttgccgatgaccggcaacgccggcggcgacgtgatcgccgcgccaccacggccaccgtccgcgccgcccgatctcaggtagctcctaaccgcgacgaccaagcacgtcgccaagaagagaaagccgatgagcaggccggagtcgagctgcacggccgccatgaacagagctcacgacacacacggtgtacaatgtgcaagccttcactgatttccttggtcactttagagcaggtacaataacaggctataagccagctgcaaacatattttaagaagataaatgaggagagagaatggcagtgggctacagatttgtagccagctgtagcacagactccaagacacagtgtgtgtatgacagatgggactaggtattaatagtgtaatatgtaactattgtatagatgagctattagattgactatagatgaattggagctagtagctagctggctatactattgaacttgctcttagacatgcaactagcttatgcacgaacctccaaaaatcctatgtggcccaatcaggtgcaataacatggacctcgatgacatcctataggacacgccagcaatcatagcaaacttgcctatgaaatatctgggtctccccctgattacaagccggctgagaaagacatacctccaaccgcttgtctacgcagcctccaaaaaaaagaatagaacgcttcagcaggcttcgcaagcggaccaatagcttctcgacttggacctgcaaggaaatgcgggctggacgacaaacctgattgaccaacttatcggggtttggaacgcactacacatggtagagcacgaggaggacaatataacatgaaagcttactaaccatagtgaatatatgatagtgtcatccaaaacagagtctggaccttcgccaagttggcgaccagaggttggccaaatggttccatctgccccttatgttgtcggacccagaaaacaaccctgcacctcctcgcggaatgaatctagcggcattagcggagcgggcggcgtgcggacgactaaatcctagtcagtggtggcaaactttgacggtgatagatttttttttgactaaatcaccggggggggagagaatccccacctgaatatattgagccaaatgatcttacacagggcaagctttacctacgcaagcgcaggggccctggaggataggagaacagaatacacggagaatacaacgaggagagaacagagaaagaaaacctcctaaaagattataattgatgaacgacacctgcaaaagttatcttgccaaaatacaagaggcacccaataaggcactccgcactttgatgctgttggtcggctagaagatatggaacgaaaggaatcgcataaccttccaacaaaaggagctttcagctacctctcttctagccaagatcaaggaagaggccaaaacttgggccttagcagaaacgaaaaatcttcgtaattagttttcttttagttagctcagaccaaaggtcctaagcttcttttctttcctttcgctttgtaaagctactccttctcaattcaatgaaattggcgctcgtcaattcattaaaaaaaagatatgcactatagaagttaagaagtacgcatcaacgcatgggcacagaaaaaaaattcaggcgggaaatacaaatgcaaatgcaaatcgaggaggcaaatccaacatggcggggagaggcatgatgccacgtaatacaaccatggatcacattaatggcgacgacgacgttggccggtgccaatttttccacaggggatttgctagatttcaggcacgtgccttttccccttccatatgcagcattaggacccgtttagatccctgccaaaatttttcaccctgtcacatcgaatgtttggatacattcggatacattcatgtagtattaaatataaacctaaaaataattaattatataaattgcgtgtaaattacgagacgaatcttttaagccgaattgctccatgatttgacaatatgatgctacagtaaatatttgctaatgacatattaattaggcttaataaattcgtctcgcagtttacagacaaaatctataatttattttgttattagtatgcgtttaatacttcaaatatatctctgtatatcacacgccaaaacttttggacctaaacacggccttagttgctggttggaccatcgggcctgggcttctataaagattgagctaacttttggggcttaatcgtctgatttggcccaacttggatatgggccgtttacaacatttggccccacacggattctcaagtcttacggggacggacacacctcatgcacttcatgccatctcgaccgtccaaaatgcaatcgaacggatgccgattcatctcaccatggacgcggtccagccaagcaatgccagcataaaccgcgtgcacctggtttatgtgctggtgtgtcctcgccgccgccatcgccggtcaactccggttcaaaaaaaaatttagagagaccaaccactcatcgtctctctacttccatccgcttcaaccttcaggtgcgccgcctcgccctcgtcggatccctagtagggaggggaggtctccgtctgccggcgggaggcgcgggcgccgccatgaccgggtgcgtgcgtctgcctgcccccccactccttgattggatcgtgtagcacttgccccgagctgttcccctaggtcatcggagggaatgcgatttgggattgggcgggatgcaaaggaggcgtccttttgggttctagggtttcgcgggattgcgttcccctgttatcctcactgatttgttgttgtttatcatttcggtttggtgaatgcgatttggattggggacagtttgctgtgtgctacagtgaaaacatggagattatcgcaggatcctcagacttctctattgttttttttttggattgatatagatgcattgtcttgtttatgaggcccggtgttcggaccgcgtcatacattcgtggaacagtgtgctcatgccttcggtgtgagacgaaaggttgtgtcttttttttttttttggttctctggcaggcgatgactgaatttcgtcactagcttgtagtgttgtaggcttttgtagcttggtctgtgattgtatagtagaaggatgacgcttctgcattgattttagttcaaaggagatacttttgtttttgccatttcggggggggggggggggggcgtggtgggggtgcagttatgcactacgtatgcattctgttctcttgcaattgattgaagggcacccagttctgctaggtgttgcaccgttttagtttagctgctgcttctttctacagcgtggttgtgctagttatagcggtctccattatatcaatttagtttgaaaaaacactagtggtgttactactcctttgagttaaaatgtgccaactattagtagcttgtatttgggtatacacctctccaagatgaggttgaattcctcatattcatatagtcgtgggtagcaatagataaccttttttctttatatgtggcctgctgataagatcatgtcatgcattgtggaacaatattttgtcgctatctgtttcagatgaaaggcgggatctgttttttagaattttttttttggagggggcaatgattgaatatcgtcactagtttgtagtttatgcttttgcagttaagtttgagattgtctagcagaagtacaacgtttttgcacttcattatagttgaaaggaggcatctccctgttttctgccatttctggtggtatggtacctattttatcaaatctttgttggaaagacattggatatagcctttgggttgaaattttgctaattttactattgttagcttgtctttgggccatcaggtatgcatatacatctctgaaagctagaggttgcccactgccttgtattcctactttagtacccttcacaaaatggtgaaaaaagactattgttcttagtttacgtatcattgtgaccagcatttcaaattgtgtcagaagagcatagttttgaacatatgcctgtcatccataccggagatcaatgtctcttgatttttgtaagctggtgcatgattggtattagtatagatatacagttctgagaaactacattttgttgtagattgaatcgtggtttaggagtacttgtctcctcaggattaattggatcattctttgggatcattttaatgatattagatgtgcctttacctgcatttggtgtgttgctggttaattatgccgatctatatgggagttcctgcagttagtgttcttgaacaaatctgcttcattcatctgtcttaactctataatcaatatttctgcaggacatcctggataattgacagccatagaattgcttcaaaaataaaaaatgcatctggatcggtggatgccagtaagcacaaatgggttagcaacccaactaaggcttgtccaaggtgcaaccacatcattgataacagtgatgtaagagatgtgttcttttatcatgtataagaaccaaatacgcacgtagtatatcatttgtatttcattcctgctttataccattctaaacagattaaacaatcaaataaaactacatgtgaacacctactgagtagtgtcattgttatgcacctttgttttcgtcgagtcgcctatatcaataaatgaatggatttttgctattagcaacttactatttatcactttgacagtgactcttttgtatattattctgaagtcctctgactttctctctaacatcgaagctttgtttgtgtatactttcagatacaccactcagtattaataaataatgtgtgctattgagtgcagtcctctaatgattaatatttcaccacaggttgttcatcaatggcctggtttgccaagaggtgtaaagtttgatccaactgaccaagaattgctttggcatttgcttgcaaagcatggcaaagttggtgcaaaagctcatccgttcattgatgaatttattccaacagtcgaggaagatgatggtatctgctatacccatccacagaaacttccaggtaaccgttagtgaaaggatatatatttttgtttctctcttcgtggggtgagcaagagaagtccaattttattttcatataagagtaaaattcacatttttcagcttgtatcaaatgcttgcctttggtccgttttcttttggtatttattttcttagtcacaccatatgcacaaagtttggcggtagtgcgggtgtggcaataaggctacttattttacttctctttattggcttattaacccttgatttttcactattccactcagcaacactctacaactaagtaattctcattgactggtttgcatttcttaaatggttccgatagagcattcaaattctactttcttttgacataggaatctcagtttctaactggaaaattgttgttttttgtacctctgttgtattgcttgtggtattcttcaactgacttttttttctttttcaggtgtcaagcaagatggaagcgtatcacactttttccatagaacatttaaggcctataatactggaataagaaagcgccggaagataaacactggtgatcttgctgatgtccgctggcacaagactggtaagacaaggccagtagtagttgatggaaaacaccttggttgtaagaaattcatggtgctatatatgagcaccatgaaaggtggtaaacctgaaaagaccaattgggtgatgcatcagtaccacctaggaactggggaagatgaggtagaagggcagtatgttgtctctaaattattgtttcagcaacagtttaaacctggggagaagaacgcacaggacttaacctctgcagatgctttagaatctatagttgctgaagatcttccaaatattcctccacttcccctggaagaacatgtttttaccaaccaagaactagaagttcttgagaaatctgaaactatcactgaccaggtaattgaacatctaagctttctttatttcccttccaccttttccctatgtgcagcacatatttccaggtaattcgacatagcaaagaaaatgtcaatatagtttctttataatgatattaaagggaattggataaatgttgtgccttcttttgctggcaaatgtacagggaaaagagactagcgaaataaacaacgaagataacgctgtagaagatgttgcgcatatggctactgagaaacctgaggatggagataacccctcatcgcaagatccgaaatggtgggaaggtgaatcccagttcctgttagactctcagcaactggcagagaaccttgcgatttgcgatgagttccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatggcattaatttgatacgtagaacggttacgaatttaataagttattgttttcacaatgactaggcttatgaaatcaaatatagcacaacaacacaggctaaacatctaagcatcaattgcttgttctttccatgattgccgtgacaatatcacaataccttgttctcactaatactctatgtgattttatctctacctgacaaaaccaaataaccaaatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggagaatccttcgcaaacacggtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttcctttggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattttaagtgactctcctttttccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagaggaggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcggcaggccgcagcggggacgacagtgacgccgaggccgagggcgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcatgcactcgttagtgctaaccagcgaccatccttttttaccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaagatttaattgcaacaaatacaatggtgtaatcggattgtagatcagataagtaatttgaaagaaaattttataagaagggagaaaaagacatagatgcctaacactacgatgcttctctcaaattctaaactctgatgcttctcgactaaatcggatggccgcgccaggcgtcgctgcgtaagactagatcgagaggcctcacgttatagaatttacgttcaaatatattatattatcagagtatttggtgccataaatataaatttttattcttcataatataggtattattatttataaataattcatgctactttgcactccggtcggatacgccctaactatagataaagccctgatcgatctccatcctgaaacacacgcaaaaccgtattctaattctaattaaacagaaactcaaatcacgaagacaaacaaacataaaaaaccgtttgcattacaacacaacccaaataaccttcctgtcctcctccgatttaggtaggccccaccggacagtgactcgaccttggcggcggcttatatataaaaacacgcaaagttaacacagcgcggccttcttcccggggatcaggacgcaacatattcacaacacgcaaggtctaatccgaaaaaagggaaaaaaaataccctcctcgcacgaaacgaagccaacccccaaactccgccgtcaccggcgaccccctcccctcctccttccgccgccgccgccggcgaggcgtatcccgccggtacatctagagaagaggtggtgggaagggtgggggttggggtgggagcaaacgaggcggcgagacatgaatttcttctcgggggtatgggtgaggacgatgatgaagcggctgtgcaagtcgctgctgaagaagcggctcggggatctgatcctgggggacctcgacctcgaccagttcgacctgcagctcacccgcggcacgctccacctctccgacatcgccctcaacgccgacttcgtcaaccgcaaggtgagcccctctctctctatctcgtgccccgacccgtgtgttcgattaggatgcacccgcccgtcgtgattagtgtgctatttgcccgaggttgaaattctggtggcagagatgggaattgggtgtttggggatgggaattttgtttttttttgtttttgttagaaaaaagaattttcctgtttagttgcttggtggattcaactctgtatgattttgatctcgattggttgctagcatgagagtgtgggcttgaaattttggtctagaattttttgttgcagaggaaataatctgttcgcaggaaaaaaaaggaaggctttttcctttcaatcagtaacctcgggtatgggtacagttcagggttatttgtgttcatttcatggctaaagctcatgatcgcaggtagagtattagggtttaggagaagtggagaaggggttataaagcttatttgcaattcacctttttcagttggagtgttgggactaatccgatacagtgtaatgtttgtaaattatgttgaatgcaaagcttctagaatacaataaagttaacagaaagtatcaaagctggagtaggtgattgttcttttctgctaacctgatttgttgtggtgagtagcatacagtagtcctcttatatgtgcatgaattcaccactaaagacacatctatgttcaacattttgcgatccatgaggatcatggcgctgctggtagcccaatatgatacatttgttcattcacaagtgttgcatacttgaatagaaacttataccgcaaaacttgtgaaacccactagattttgggttttccagttactttattaaaacagttctatttttttccctttccagttgtcaggatctgctatcatgatgaaggaaggatcgataaaatccctgctagttagaattcctctactattaaacatgcgcgactgttgcgagattgtcgtggaggatttggaacttgtgcttgctgcatctgtttctagcgaagatccttctggtgatactgaatgctctgtttctggtagtaatactgacgacacacagaaatcagtccaggccaaaagaaatgaatctgatggcaatcagtgttctacctctgcatctcgagatgtcgacaaaggtgtccagaggatagctaatgctgtcacatgttttcttaccaactttaacatcaagttaaaaaactcttatgttgtatttgatcctcaaaacattttggataacaaggtcccagaatttaatcgatcactggttttccgaatcaaagagaccgaatttggaaccaatctttcaacagatggtataatcaaacttcacaattttgtgacattccatgaggcggtcattgagtttttgaagatggatgatgttgatgcgcatgcacttcttcaggatgatttggatagaggaccagcagacatttcatcaggtcatagcactaccgcggtcttgacaggtcctatcggtggattctcagggaaattgaacttaagcatcccatggaatggcttgaactttaagaaacttgatgcagatatatctcttaattcattagaattgcggttacaactgagcagtatccaatggctcatggatgtgtgggattctctccaaagaagaaatctagtacatgaacagagttatgcccataataccgcagacatatctagatctgccagttcatatgtatcaagctcttcaaaatcaggttcaggttctgtgatagctagcagggaacatttgacagaggacacattttctcaactcaggcaagaaaaaacacaagagccttccctgactatgccatacttgattccggactggattccagtgcttatccatgaggatcacggtgaccctgattcagtttgtgatgaaaggtttgttcctttttgtttttcatcttcctttcttttcatgaaagttcaatgatattcactgcacctttgcaactgccatccttttttacatatagacatttcatcaagagtatacttttgacagaactgttgtcaaataaataatttttgaaatgaaatgcatttgcctcccatttgtatttccatgaataggtttggccagatgtattacacagaacttttctccccatcttcgttatatactatgtactcttgaaggttgaccatggacaaatcctccttttctttccgtgcaaaaaaaagaaaaacatttttgggtgcttgtgcaagctattttcttgctaagttacttgcctttaaatttcttacgggaagcagtttgtttaaaccaaataaagaatatacataactacactactaatatgttgttatcttggacagcatcgaccagttctttgaatgttttgaggaactgatgaactcccagactaatctgggaaacagtggcatatgggattggacatgttcagtgttcaatgcaattacctttgtatccactttagcttctggatcagatcaaattcctaaaggtactatggtttaaacctttcaattttctattggttgtccacattatacacttctcttgcagggatacagaacccttatcatatggatttatttattgttcttattgtgcctgtttaccacatatttttttctcctgacactctttcctgtggagtattcttggacaatgttcttcagcttcaattttcttttactcttgaacatcattcatatcaagcaggatcttttgcactttccatgaaagacaatgtttgactgttagctcctgagtagactgaaaggaaaatgttgtagaccactggttaaaataacagttttgtctggtgtgtagtaataatacattgatccactgaaaacatctcctgttagttggtattacactggtgatactcagggaatagcactgatactcaccaatgaaactgcacggtacaatttaaagttattattgtaccatccctaccttggactagtccaccttatacaaaaccatactgcatgaactgaatacttgaaacatgcagaaaaacgaaaattactgttatctcttgaatgaaggtcaggtaaaaggtacacatgctaggttatgttggcttatgaataatgacagatgttatatgttctaagatacagtaacagtctggtatcaacagatgcaacttacgagtaatgaattctctccattctcttgctattagcaaacctatcaagcatgtccaaatatctgttggatgtatttctggcattgaaccaagtatctgcagtgttttactttttctggctaaattatcagaacatttatatattgcatcactttgttacttatttttccttttcatttcctaacagaaccgccgatagagaaaaccttgcgggcttccattgctgagatatctgttgttcttttgttcagtgatgaaatggatgctggcaattccagtgttcctatcagtcaattcaatgacatgagaaattctgaaatgttttcaagctgcctttcctttgcacattttgagcaatcaatgatatctcctgctcctgctgccagcttgaatatgcatcacgttgaagccaagtgtcagaacattcatctttccctggaggtctggtctgcttccaccaatagcactttttcgtagtttatatctcctaattttatgaagcttgattctaatgttatgttcttgatgtttgcagacatatcctgaaaacctaagtctcaagggatcaattgctgctataaagcttgatgaatactatggcagtaagaacaatgattcagatcatccaaatcttggtgctgctttcttgaacaataatttttgcagagaagttcaagcttctctccctcaatctgtatttgcttatcaagattaccatgaggaaacatcacgccgtcataccaacaattcaaatgacctcactaaggtcgaattgctaaacacgtttggtgagtgcgtattccactatgatgtcagttcctcaggtcaagatggcaacccagtaagctcaacttcactatcagtctgtttggctcctttggtttgctgggtgcactttcacacaatatatatgctactgaattttatcagtaaaatcgagtctgatgttttgcatggggaggataaaattcataggaagaatgacgaaaaaaatgtcaatttgtctatgaagtcaaatgtttctttgggaggaagccaaaaggttcagatagccctgtcgcctgcaagagtcatcttttgctttccttctgaatcatgggatttgagctgcccatccatgctggataagttccttgtcattgaccacacaccatctctgaaatcaggagcagattcatctccacatcaaaatgaaatgcctaatgatgtcaatgcaatcacaccatctactttggtccatttggctacagggaactttgacatctatttggttagaccagttaatgatgaactgaatgctagaacctgttctctgagtaggcaaactttctcttctctgaagattttctctgttaccggatccaattgtcatgaaactggcattacgatgctctggaagaagtatcctttaaaagaccctgagatggtgagcaaaacttggagtttgccaaacctgcatgagcaaaagattgctcagaacaaaaatggtaaatgggttggtgtttcctcttctacaacctcagaagatcttgaggaatcaagttccagtatacgcagggagctcctccggagcacagagtttttgttgcacattaaactttcttgtgtctcagttcatctcagtaagaaggactgtgggatactaaaccatttgctaaaaaacatccttgatggtctttcagatggagcaactggaaattttgaaaatgacagtgacaattgtatgccaatccatgatactgctagccaaacatctgtcatttttgaatgcagcatcttggatatctgcactgaattggatgaaactgttgaagttggtcctttattgcagactgaactagaaggttcctggaactgtctcaaattgtcaatttcaaaattttctctgctatcctcttctaatgttggcggggttaacaatgccaattttctttgggtcaatcatggtgaaggtgagctctggggctctattactggtacggatgactatgaagaaagcaaagatgttcttctagttgtttgcaaggattcggcaagtagacgaggtgatggtgaaggtagcaatatcttgtcttttggaactgcgggctgttctgtgactcatatcatgaacccaaagtttcagaagaattatacttctatcaatgttcgttctgcaacagccgttgcacctggtggccgcatggattggataagcgcgatttgcctattgtttagttcagcttcagatggaactgaacaaccagctaatagtagcacaatgaacgattcccagggtggtgaacctttttcatcactgttctttcttgagctggttgatgttgctgtgagctatgaacctcatttcagaagttctgcactcagcgctgaaactccagactgcaaatacttttcatgccttttagctgcatcattgtttaaacttcacagcaaatctgcatcaaactctacagctactgattttgatatcgagctgcgagatctcggggttctcatttgtggatcctctagttttaaaaatgtcagttgtggctatggtgcagattacctccgtcggatgggctatgctaagattgtgcagaatacattcattgaagctgttctaagaattgatacttccttttggaaactcgaattatcagactcgcaattcgatattggtacttgtcacgatacgacacatggtgttattcaattgtgctcccagcttcagcagctatatgctccagatatgcgggatgctttagatcatctacaatccagatggaatagtgtccaacaggcaaacaagcaaaatatgggcactgatgtgtcagaaaagtcagagagtagcattgataatctgacagattcagaggagtgcaagtcagatggtttgcttgatgatataattgagaatgccttttgcactgaccaggacttcgcaagctactcattgagtggtagcgaaatggatgaagagtttggcctgagtaaggccatcccagaggcaaatgatgcctgtatttcacttgaatcattactagttacccctgaagccagtactagtgatgatctaataattgaatcttattatatgccaccttcgtcatcatcaactctatacaatgaagaccagggcaattgtgctcctagaaccgtagagtgtgacgaaggtgaatggtataataattttcccacaatagatgaaaaccatgttcaaaggaacaaaccacgagaagagcaaatatttcaacaaaaactgaagcctgctattttcatcttgaattctgatgaatcgtgcagtctgaaaggaaaggttcttattcatgatatagatgtcaagtggcggatgtacgagggaaatgactggaaattagctcagaaagatacgattagccggccgtgctcaaatggcagagacaagaggtcttatttagagtttattatgtctgcgctcaatatccagttcaatatgtatccagatggggatatttttgtttctaagctatccatctctgccaaagacatcaatatttgcgaccaaagtacacatgctccatggaaaatggtatgcatttttctgtccaaattatctagaatttactattaccactggactaatggtttctaaatcctctatccattttcgaatcaaaggttcttggttgctacaactcaaaggattacccgagagaatcttgttctagtgcattcatgttagaactggagtctgtaagacctgaaccacaggctcctttggaagattacaggtaaatatggtgtttctttacactgaattaaactatcagaaaacatttgtgattttgcttgtttctgttaatccatagtgaacattgcgtttgcctcatacttaatgggcttgcattgttaaaagaaactacaaggctacctttttgtgccctcgatgtatgaaggcactcattgcccaggtagatgtaggaaaaaacctatgtagtggactaggttccacattacagatcatattgcaggaataatttctagtgtacccagctatttgacttttttttttacctcagcacatggtaatatgcaagatgatgagtctgagctgaacaatagaggcacatttctgaatgtaataattagctcttttatgatgaatttatgtttctggattcgatataaatccagtgtttgtgtactgctgcactttgatcgcaattctgtaccctcaagtccaattcaaggagtaacgtaaaatagcagatagaacatgaaggtcctttattaattagtgttttttatcatgttagtatatgataaaatggtaaatttaaaattataatggtgatacaaatgagatagagcttgttaacgagcttaacgatctagcttgtgagccgagctaagctaggcttttagttctctaaggttaacaaactgagctgagttggctatacaccccacacgtcaacaagtttaacttgagtgcatgtaaaataaagaaacgcatagaagatggcagatccaaataaaaaaaaatcatgcatgcgtggttcttttggcagatattatttcacccttttgccctttagccctttagccgttgctccacacacattttgtgtccatataccatatctgaatgctgaagtataagtgagtttgagtactggtgtcttttttctactctctatttttggtacttattttagactcagtatgatgactgatttccttgcactatcctaaatatttcaggttacatcttgagattttgcctctacagttgcatcttgatcaagggcaacttaacttccttatcagtttcttccagaatgacttgtgcaacaaccctaatttggcttgcgaaaatgagaatattgacgcgcagagtacaatgtatcgaagcgatacaattgctgatgaggcattacttcctttctttcaggtatcttgaagtttttcagtttttatttcctctttttttccccactcatggtacttgagatggacatatggttttaattttttttctcctactttacctgatatattttaacaattgtttttacagcaactattagtttcttttcattttcaaaatttttctactaattagcagcatggatcttctttgtttagtaaacaatattatggtctaatttatttcttttgatgctagaaatttgatgtgaagcctcttgttctgcacattaattatattcctcggcattttgatcctgttgcacttagcaaaggaaattatgcagaacttctcaacatttttccatggaaggtaattcattgttcagaactatacatcatagccagtcgtatctttgtaggcaaccctgatactaaatttgctgtgcagggaattgatttaaagctgaagcaggtttctgccatgggtgtttatggtttcaataatatatgtgaaatagtagctgcagaatggttagaggacatctcaaaaaatcaggtcctaatcttcccacacatatcttacatttatattaaagatgcctgctgttgtgtacaccaataccgattcaggacatgcaatgctataagagagaatttaaaatttgcatgttggcatacactatttcttcacaaaaaaggagaatcttatatcttcctgtcttacagatgattttctattctcatttgtttcaaaaattttctattctcatccaaatcgacaatctgttccttgtttaggtccataaattgttaaaagggcttccacctataaaatcattagttgctgtgagttcaggcactaagaaattggtctctttacccataaagagctataagaaggatcggaagttgctcaagggaatgcaaagaggtaagccacatatagctgcactactatgctgaaatattttgtttgacatttctgttgatgtgttaatatatgatggtattgtgaaattcttgatgtcatgcatccctgattacacttgatggtgattgacaggtgcggttgctttcattagaagtgtttccattgaagctgtggggcttggtgtacatttggcggcaggagctcatgatatgcttctaaagacagaaagtgcccttacagcaattccaccacctttagcctcacgtgaagcaaaaagaaccaaagacaatgtaagagctaaccagcctgaaagtgcgcaagaagggctgaagaaggtattgaattcatccaaattgcacatgaactcatcttttctgagatgaactcatctgttgtctgctaataacatgttgctttaacctaactatttgcaattctatttttgtttgtgatttgcgtttactttctatatcaatatggtaagtactgccagtataagtttcatttgctgtgtaattatcaataattcaatatatgctgaacatttttcaggcatatgaaagcttgaccgatgggtttggaaggactgcctctgctttgattggaaatcctattaaagtttataatcgtggggctggtgccggatcagctttggctactgcaatctgtggagctccaggtgctgcagtggctccattatcagcgtcttttcgtgctgcacattatacacttcttggtataaggaataggtgatttcactcatcctcaaacctcaaatcagcaaacattgtgaagctctacggttattttgaattcttaaatcagtccagaccattcccaactcactgttgactcctcggtctgttctgttatcatttactcgatgcaataggactaagtttttctgatcacatttcacatgtgacatgagaccatcagctagactcaaaacatggcataaaaatttgtattttctaatctaacttgttttctttttttacttgtttatttatgatatatcagcaaagtctccatgcacatgttagataatgctccctttgttttttaacagatgacaccgttgactttggaccatttgtcctattcaaaaaatttatataaatatcatttatcttgttgtgacatgttttatcatgaaagtatgatttatactttagcatatttacactattttttttaataaaacaaatggtcaaacgttattccaaatgtcaaggacgtcatctattaaaaaatggagttattacattttgtaatcatatacttcctccgattcatattataagtcgttttgacttttttttaagtcaaactttttaagtttataaaaaagatagaaatattttcaatccataataaacatattatcaaaatatattaaatgttagttttaatgaaactaattgtgtgttgtagttgttgctaaaattttctataaacttggttaaactttaagaagtttgactaggaaaaaaaatcaaaacgacttataatatgatgaaacggaggtagtatttataaaataaaaataaaaaaataaaatctcctctctcttttttcccccatataatggtgagcaagatctcaaggtctgattgcacaaattctgaatagttttctatttgagattggagggagtaatacaaatagatattaaaaagatttgaaaatagaaatatattgacttgcaatttactgtattagtatatttttgtcttctgttggaactggaagaagttagcaacggaaggtaacaaagttcatggatctggacagcttaggattaatcaataaaacttcgtagctaaataactgtaactgacttgccccaaatgaaaaatgtatatctatgcaaaagaatgagaatatagttgatttatcgtcctaaatattatcagtctgtgcactgataaaactatttgttactctgggtaaaatatgtgtttgagcaaaaacagtttatttacaccgaggacttatgagggtcagaaggtgcttggcattccctacattgacacaagctcacttaactgggagaacttgtaaccaatgatttttaactaggctcttacgaattgcaaaaataataatgtgcatgaattaggctaggcaactgactaggtaactatggaacaatctacagaaaaatctaattgtgatcttggtttgatttataatattagtggaattgagttctcttccgatcagcatcggtgaaaatacatatttgtcctatgcgaatgttacaactcttgagcatacttcatttttggcatgaccacagactgctaatgttggtttgctaatattttcttttcttctacattcacagccttgatcctgaacgcaagaaagaatctatgtacaaataccacgggcctcctcaattgtagacttccattgagaagaggtggtctgttcattcttttgcgagatctcgtatttacctggaagaactggttcaagagcacatgtgtgcaatctcatcaaagggtggtgggcaaacttgtacaggataagtcagatttccacactagcaatccaaccatttgtgaatcagtgccatctccgatgttcttgttggagttcataatccatctcctctgcaggtgtacagtttcagatgccacgtcgaaaaccttcatactgtaaattactagcacacgatcacggttgtaatcacaaacgtggccacccggagcgggtggaagttttgttgactccttgcttaggatttggctagagagagagggtcacagggagcttggctcggtggctcttgtacataaatttggtggtgattactgagtagtgcaaatgtaaatatctctcttgtttctcggttttccatttacgtttttgttggtttgagaaactgctcactgtaactctcactctacaagtgtaaatatcatcaggttttgtgctgctgcaatgagatataagcgcttgtttcgcgtgtgcgtgtctggagatgatcttttgtagtaactgatggaagtccaaattattacgcaacgcttctgctacctgaagtagttattgagggttatgtaatctacagaaaattggagatacgagatatgagaaggggtacagtattgtcattcacattctttcaactgtccacaaaacctctcctctccttcctttatatagccaattcttatacatggtacataaagcctctcctcttctttctttatagccaattcttatacatggtacataaagcctctcctcttttttctttatatagccaattcttatacatgtaaagtagggtgaggcctgattagtgtattgggcgttcattggccaagtttttcaacactctcctgagccgtcaccatgtattgcttatgcctcattaaagctccttaatgagccagtggaaaaaaaatagagaaaaagtacataacatacggtttgtgttgcacgggttgcctcattaaaaaccttgataaagaaatgcgggaaaaattatctaagggaaaaagagtacaacccctccaattattcttattaggtactttgtcattctggactaagtttggcaagtgagtcagtgaaattctcctcctgaattttacatttctctaagtttcaacatcccgatccctcagatgcacctttcaaaaggggatgttggtaatgacttagtgaataaatctacgatattttcacatgacttgtatgcaatactttaatttcgttcgtcttatgcagttcatgagcataaaaaaaacttggggtatatatgcttggtgagattgcttttcacgtaacccatttgtccttgtgcgacacatgctgcattatcttcatagataattataggagtctggatggtgttcaattcacatgattgctaaatgtggtgaatcattcgacgaaaccatgcatattcatgagaggtttcgtatagtgcgatgattttcaagtggttcatcgaagttgctactagattttgctttgacgatttctaggaaatttttgttcctccatataggaaaacataactagtttgcaacttggctgtgtgtgggttcgataggtacttcctccattccaaaataagtgcagccatgagtttccgtgtccaactttggtcatctgtcttatttgaattttttttataattagtatttttatcgttgttagattataaaacatgaatagtactttatacgtgacttatgttttttattttttttcaaaaaaaaatttgaaatcagacggataattaaaattggacattgaaacttatggttgcacttattttgggacggagagagtacccagcatctgcatatcctaccaaggtgaggtcctggttctttctgtagaacaatttcatgtccttactttcttgaagataatggaggatgtccttgatgcccttccaatgcctcttggtgggctctgtgttgtaccttgcatgtaagttgacgacaaatgctatatccggtcttgtgcaatttgcaaggtacatgagcactcctattgcactcaagtacggatattctaatccaaggacttccttcccttcttctcttggtctatacggatcttggtctacttggagtgaccttccgaccataggggttttagaaggatatgtcttttcaaagccaaatcattctaacactttctgtgtgtagattgactgatgcactaagaccccttcgggggtatgctcaagttacaagcttaagcaatacttagttttgcccaagtatttcatttcaaattcagatttcagatatgagcttgcttcttcaatatccttgagtgtcccaatgatgtttagatcatcgacatatacaaatattatgcaaattccatcctaggatctccgtataaagacataagggcaatcttcattgttgttgtagccctttttgcttaagaaatagctaagccgattataccacaatcttcctgactgttttaatatgtatagtgacttcttgagttgcacactatacagattcctgcttgctctgtcttggtttgggacatggaaatctcctaataccttcatgtgaatgtccgtgtccaagttccatagagataggtaattacaacatccataaatttcatttccaaattcaaatttactaccatagagattacgcatctaaaggtaattctgctcatgaccggagaataggtttctttgtaatcaactgttggccgttgggtgaaaccttgagctactagcattgctttatatctcatgccacgccctaaaaatcgcctaaattaataatccatattttaaatcatttttagaaattacttttaaagcctacaagttaaactctaataatctaagaaaaatttcaacataaaattgagctagataaaatttcattaaatactttgcttgtttatctattttctagatttttctgggaattatttgagcaagggaagtatttttaataaatgaaacatcatttcacgaattattttaattggaaaagttttaaaaatcctcctctaagccgttgggccgtatttggcccaacatccctctctcctcgcgcgcgccgagcggcccaagccggcccagccgacccgcttgcccctcctttcccctagccgccgacatgtggggcccacatgtcggggccatcccctacctccagccggctggtcgcccaagccgagcccgagccgccgcctccctctgccaaatccgcctctatcggtcgcccccgagtccgattagttgaggggaaatcatctcctccttatcctcttcctttcccctaaggtttcggagaccaatttcgcccggataaaccaaatcgagttcgttttgagtttatctctccaaactaacccgaagattttccggcttcgattcctctcggttggagtccgatctccctaatctaagcctataaatagcttcccctagtcgtcctcttccgtttgccccaactcccgagctccctcgtcgcttgtagcgccgccgccgctttgctctagccgccgccgtcgccggcgatcctccggtcgtgccgcaccgccgctagcgccgtcgccgccgtcgagtgcgcacggaggagggaaagctcggccgccccttcgccgccgtcgccggacaccgtagcgccgtcgccgtcgctgacccgagccgcgccgccataggacctcgtcgccggccgtcattcatcgtcgtccgtcgcgttttcttgcaccggtgagttcgcgtcgtcgttctctacgtgtagatggccttagatagcccggccgacccctctagcgccggtggtcgtgttgcccgcgccgtggccggcggtgatgacgtcatcatgacgtcataaatccctttttctaggttttctttattagatgcaaatcgattaaacttcggaaattcataactaaatcatcgtaactcggattcgagtggtccaagttgctaaatttttctaaaatcgagatctacatgttaaaaatatccacatgtactgtttatgcttgtttttgtactgttttggttgattttgttcttttgctttagtttccgacgttccggaggagagcgttttcgttgaggaaggttcggaagcatttgcggaagctcaaggcaagtaatatagatcccaaacaaccctttgagcatgttgaacccgtttaaagctaatgttttattttaacttatgcattattttcgaatgtcatcgggtggtgagcctttcccaattaattaatggccaaagatgtctttattttcctatgggtaataaattgattagcttgtaccttatatattggattggttcagttagatgctatatgtataattgcttagccatgcttagaaacattagctcattaatgggatgaatcatactacattattaattatggttatatttaatggtagctcacaatggttaattgtgttatgttaattaattgataactaaaacctgattaaggtgggttgtgagcatatggttttgatggttgtgctcatgacaattaaggaccggttcgcgagctactgttgtgaaacatttaccgtgccaaccacaagccagcatgggcaacggctttatcttttgtatagcatgatttattatggtgtgccagactgtgaagcggcgagaagtctgtgggggtcgctggggagtccattgcctctggttttgagggggagatcatgatccaggaacggtgcactgtgatgagttgtgttgtgcgaggggtattgtcacagttcctttccaaggtaccgtagtggtactgaggcgcatgatgacatgttgtggagttgtgtcttgtgggtacagtggtacacctctgatcagagtaaaactattcgaatagccgtgcccgcggttatgggtgagtttaacaatgtttttcgtgattagccccacactattcattaatgataatattgtgttaattaatttgacttttggtttggaatggtatattcctggtatggaggtttgatttgtacaaccggggttggttgctcagatgaggttgggcctatgcagcacgggtgtgttgtatagtgtttatttaatactgattaattattcaactgttttattattctttaaaatgtttattaaatgctgtttatgcaaatgagctttactatgccatcttttgttatcctgtgcacttgcatatttgctgtgtggcttgttgagtatgtcatatgctcattattgcaatattcattcgtcagaggaggagtacttcaatgaaggtgatgatctggaggattaggctttgttcgggtcgagttgcttgtggagtggagtcgccatagctgttccgttttgtttttatttccgctgcgtataattttattctttgagaggaactatccacctctataatagtttattattttattattgtgcgaatattaattagttgtttgttagcactctattatcaatttgttattgtgtgcctcggttaatttctggacgagggtttaacacacatgtaagcgtttggaattttggatagaaattctggacgtgacatctcactaactcgttattctgattttttctttcgaacaaataaccatttatgcccgtatatgaggagggatacggcttacagggtcaaatacctctcttttgtttagagaaattaactcgattgtgattgctttcttccattcgtcccaatccgaccttttcttgcattctgtgagtgatatgggctcgcagtcgagattcacgacagaggctattttcttagcaaagtagatatctacatttgctgttgctctatcaaatgattctcccgatgtgtttatggccatttcttcatgagctacttcttctgaagcttccacttgcttcctgttgttctctgttacaggggaaagttcctttagtttgctaggttctatgtgtgcacacacattgtcactgacaactctctcggtgggaaggtttaggccccctttgattcaaaggaaattcataggaattttagatgatttctttcctataggaattttttctatacagccctttgaatcaaaggaatggatcttatggaatcctatgaaattcctatggattgcctaatgccatgtaaattttggaggaattctaacatgaggtaaaacctcttggaaactttcctttaagtctttatctctcctctaattcctgcgtttttcctgcggttcaattaaacgactattcctgtgtttttcctgtgttttgcaatcatctattttacacttacattcctatcaaaaacctacgtttttcctattcctatgttttctcattcctgcgattcaaaggggcccttaggtctggtatgcctcttttcataggttccatactagtgccagatctccgctggctcctcttttttctttggatatttttgcaattggctgtaccaagccccctgtcccccttttctctagacgtttcttgatacttgaggatcgagagactggagttcttgtccttttgttctgaggcctccagactggatgagggttaccaatttcctttggtatttcaatctctccggtgcattgcgtgcatgcacatgcgacttggttacgctattcaaattacaaaaatggttaggcagttgattcactaaactttgcaaatcaattatttttagtacctctccatttgcttcattggtgcgtggatcatgcgcatggatccccatgtctggccatgtgatttccaaattttctcatccaagggttgatttcctccccataaaaaggggaaatgatcctcatcgaagatgcagtcagctaaatggactgtatgcgtgtcgcccgtcatgggttccaaatacttagttatatatgcagtctcataaccaacgtatatcccaatctttccgagtggacccattgctgttcgttgaggtggtaggataggtatatagactaggcatccaaatttgaacagatgggacaatttcggtgtgaccccttgcaccagtttcatttttgaatggatgttgtaggccgatgatctgaaattaataagatttaccacgtgtagggctgcatgtccccaacacgtgcttggcaatttacaaccttgcaagagtggcttggtgatgaatttaattcttttaatcaacgcttctgcaagtccattttgcgtatggacgtgacatatcgagtgctctgctttgattcccattgccatgaaatattcatgaaatgcttttgaaataaattcgcagcattgtccatttgaatggactgcacatgatgatcaagaaaattattcttaatttggatgatctgctagatcaattttgcaaagtcatggtttcgttttgatagcaggcacacgtgcgaccattttgaggaagcatcaatgagcaccatgaagtatctaaacggcctttataggtgctgtatagggccacatatgcccactgtattcgtgctaagaatgcagggatttcatccttcattttccatacggatggtcttgtgatcaatttcccggtggcacatgcatgcctcgcaaaatcttctcttttttttttctgaaaggaacatagaaagggaagcccctgttaaaaaaaaatctaaattgataattgaaaaaaaagattacaacaacctaatccagtttaagactacatctttatcaccctcattcaatctaaataacaaaagaaggagatcacccttgagggattgtctccaagaaaccaaggaatgaagaatattctcaaagaaatcaaattaacgtgcaatctccaatattacttgatctgaattgatgggccgcacaggtcctacatttgcacatcgtgctccatgtggctgaccgcagaggatagggtggagtccgccggtgatggatgttgtttgctatttttcttttgccggtgatggatgttgtttgctatttttcttttgcttgtcatctctatgacatgaacgaaaatgttcttacatttttttcgtgcttgctagatgatggatggctgctactgcgcaacgtcgagcccatctctataccacaccgctacacccttccatgattccatcgtcaaactaccgctcgccacccggttaccctctccactacccgtcacaagacacagactagcctctccattagcaaaaccaccaggatcctattttcgtgatggatttttcgctgaatcattttttttcttttgtagtgtgtggttaagcctgtaatttttttattcatatggctattttgtgatacaaattaacaatactgttagtatcagtttttgctcttatactgtgtattgaacacattagtaaacatattactacacgattgctacgagatcatgggctatatcgagaggaatgtggtaattcttttactcgcagaccacgaaattgaaacaatatttacaacactagtaaaaaaaattaatagcgttgtaagccggtagtagttcttttaccaccatctaggaatggtgccatatgatgtgggggcattcatgcaagtaaatttgttacttttgaatggggcattcatgcgagtaaatttgttacttttgaaggagcagatgtgggaggctgggaggagtagatgtgggaggctgggagtaaatggaaaacttcatagagtaaatccgttacttttgaaatgtgaggagatactagaaaaacagaaaactcggtaagaaaaactagatggtaaatattttactaaaacacgaaaacagaaaaactgaagagaaggaaccaaaaacggaaaaatctggatggttaattttttagcgggcgcttcgatcaagcacggataagatgtaaaagagaaaaaagaaacaaaaaaggtgggggtaaaaaaacaaattgaggaaaggtggtggtaaaaaagcggaaaaccgtaaggagggagcattgtgcggcactccaactaatattccgtatgcagcgcgtggattagcgctagggaaaatttcatctataccacaaacttttgagcggtacccaaaaaatagcatagaacttcccaccttcccaacaataccacagtagaacaggagcggaacggggcggcacgggaaatagcgcgatagacaggattacccctcaggcttatccctttcattcatgcactcgtctctccctctccaaaaccctaaacatggcggtagtggtggcggtggcggtaggtatagatgaaattttcccttagcgctactgtatgtaattattatatatttatatatatatattatacctgaattacaatgtagttacaatatagttacagtgagttactactattgtaactaatatgtaactagtactccctccatattttaatgtatgacagcattgactttttatcaacatttaactattcgttttattcaaaagttttttgcaaatataaaattatttatgtaatgcttaaagaatatttgatgataaatcaagtcagaataaaataaataataattacatattttttaataaaacaaatggtcaaacgtttcttaaaaaaatcaacagggccgtacattaaaatacggaggaaatatttaattaatatgtaactggtatgtatctaaacgaaaaccaaatgcgcccaatcggctagctccgttcagtcataaacgagaggttgtaggtttgattctttgctcctgtgcactttgcgccaatttttattatccgatctgcacgaattttgatgtgatctaacagtctacaatttgaaagtttttaagcctaaaaaaccgtaaaaaaaatatgcaagtactccctctgttttataatataagactttatagcattccccacgtagtaaaaccgtaaaaaataagtaagctataaaatgacgctcttatcctttgttcttttcctcaccggcgctcggattagtccgtccgcatccccggcgctatgcagccggccgacgacggcaggcggagggcagatgtggagtagtgcggcggctgcggatggtcgcccacatcctcggaggctacgcagccggccgtcgatggcagtcgcagccacgtgcgcctctccgctgcaactgcacgggccgacggggcatcatcggacatgtctcacctttcctggagcttgattgttggcattcaatttcttcgagactcgtcaatactctgaaattgtgcgagctggcatcagggtgatgtaatgccattaagcgtatgacaccattcatgagctgcgctttgtgtatgccctgacttaatcttgtgttatgcactgcaagaattcacaacttcactttctgtagccagggaacctttaggcttcagcatctgtttacttgatgcacctgctgtttcttaagtctatatgtttcaattatttgtcctcttattgtttgcatattatgggtttgattgtttatcctctgtttatgtttccgcctatatcatttgctaaatacctagtgcaatgtattgggtgcgactgaggagtgaggactagtgttggatggagtattagtttcagactttcagtagatggtcagatctcagatgcaagctaacctgttgagtaggtattgggattggagaatttggtgccaggcaaatcgaattttctggttcgccatttagcatggatcatggcgtcacgagccatatggtgacacatttgctgatttgcatctgaaactttcagttatgtcaatattttcctattcacatgagatcttctgactgcaattccataaatgtaaatattttcctgcaggtgttttcagatggatgggcacttattaacatgcaattccattggaattcattaatttatcattgctgccaatttgcttttcagtcattcaaagaagttcacagccattcatattgtcattaggtacttgcattcatattgttatttaatttctaatggtgagaagaactgaacacaaaaaattgaacagactacacaaaaaattagtgtcattcagtttccacacaagcaactgtcctagttgcttcctgtgacaagaacatgaaacaaactgacaaactggagtacacctaagttatcaggaggacatcaagaacagctttatgcattgagttaaaaattgatattgatattgtaagttggggaatatgttgtgatttagcatagctaataacatctagcaatatgactaaatttttttccattttaacatccagaaaatcaacaacggtagtcatagtacatattatcaaataatttcatgagaaggagcacagctagaactattattcctatgaaccaatttctaatgtcattggtctccttttcctgcttggacaacttcttgagtgaaatttccatgtctaaaaacggtccgccatttccagctctagcttcatactaaagatcatctttagtctcggtttttagtggaaccggaactattgtggatttcggccgacggaccaaagatggtttctccaccagtgtacccagattgacatgttccagcaagtgccaaagctgcttgaatgtcttttgtactcttggatgccagatctactccaatcagagtgtcatcctccttaaaaaaacaggactgttatattgacatgcatgactaaattaaaagaaaatttatttatactgaattaccactaaaaaaatgacatatgcttggaatgaaacttacctatcaacacacttcagcgtacaacttatgtaataccactacgcatcggcaatatccttgatcaccggcatcgcagcaacagcaaacgaaaagtcctagagcttcagaggacaactggagcaccaccactatgccgctgtggccgccgacagctgccaaagtccccaccgccgccaccacatcaccggctccaacgactccatgactaccacgataccgcggccaccaccacctcgctccacgaccacctcgtcactgcagccgccaaagcccccgccgctgccacaacatcgccagctctaacgactccatgaccacctcaacaccgcggccgccaccacctcgctgccacggccgctcacgcaccagccgccgccaacaccacctcaccgccacggccgccaccacctcgccgccacagttgcccatggacaagccaccgctgttaccactcatcggacagaggggattcaagcaccttccacctctctcaacactgccggtaccacctcatgggcaaatatgtatctggaggtaccacaccttgccaatcgtctgatcggatagaacgaagggcagagatttgttaccgggctacctgctgaacagaagaaaatctcttcatagtatcagaagaaagtctgctcatgcacctcggcagatcccgccatggctaaccccagacctgctcccgctttcgcactcgtttctaacatcaaaaaccacatccaccgctcaccctccaactctctacatggtgtgaacttttctttgttcttctcggccatttcaatctcaaggcacacgtcgacggctcacccaaaccagccaacgctcaattatcaacagaaggctctgggtgccgcagcgtgaagaaaaataccccggaagtctttagaaatcagctatgctttatccatataagtgataggtaaattgaagcagttccttcttgtccttattagtcagcaggcactttttaaagggctgctctacttcgtgcagctttgggcagatcgatatgctcacgaactgcatggatgaaagaacgtgtgatcctccaatggatgacagctccgagcaccgctcgagaagcaggcatttgacctaaagatttgtgcccagcggaatggactccatgccatcgcagctagacaaatgcaggatgttgagagaggtgaggctctgtaggcaggccgggaagtcaaccttacggccagacacaatagagagtcgtcggagtgagggtggcaaaaccattccctgcgggcataacaatttgcagtggattttcagatcttgtaggtatttgaatcccacgaaactatcgacaggcattgacagtcctagatcgctggagctgtcgatctctatggacttgatggatggcaagtattccggggacaagcaccgatcaagattctgcaggtcctcacaactgtaaagacctatataggtgagtccactaagacatgttgtgccattgctgctactgctactgctgcttgcatgctgcatcgtttcaccaccagtcgaaccaccaagaattgttactgttttcagccaaatatttcctgatagcattagaagttcgagggaaggaaacgatgggattgacagatttttcaagacgccacaatggaaaagcaccaggctccttaaagtcagcaggctctctagtctaaaccaactaggagaaaagctatcacccccaaaaccttggactgtaaggtgttcaattcttggtggaggatgcaaggcttcgagcactccattctcactactcttcactaaacttgtgactttctttcgccattgtagaactagattctggaggtaccgtttttcaacaaggctagcctcagcggcctcttcctcgttcttaacattacaaatagaactaataagtagagctacactgagctgattcatgcccctcaactcaccaattttccgcccatcccctgtttcaactataaaatattgcaagttccgtagacgagacagatttccaagcctacttatctctgataactttggagagcaacctgttggcaatgctagacgatgcaagttgattagctttatgacatccggactaattgcttttagacttgaaccatttgcatcaacaacctataggctgtaaaggcaccagaatttctccggcaattcttgtacaccgctataagaaatatcaagataacggagactgttcaactcgcctatgctctcaggtagcttgaccaccgtgcaaccctttaggctcaaatataggatgttggagagctgattgaaccaggtaatctcaacattgaaattgattccaaacctaagtgaatgtaatttgttcaaatcctgaatgcctctcattccgctcttcagggattcatcagcgacctcgactgacatatggcgaactgcatatagcattctcctctcattccgagacctcaaatcttgcatcaagaggcattcatccacagaaacggattgcgccatatcatggatcaagtcatgcatgacctatctagttcgattaggatacttggggtcggtttgaaaaagaaacctgctcctcaaatcatccaaatacctaatccccatatcttcaagacgtgtgcttccacttgacacaacaaagccctcggccacccaaatgtcaacgatctcatctcgttcaaagctgtaatcttttggaaacatgcagcaaaatgcaaagcatctcttaagttcttgtgggagatataagtagctcagttggagggccggtaatatctcattctctcgatgtggcagctcccacaattcactgttccgaactgtctcccaatgttgcacggtcagctccatattcaacaaacgtccaatagttttggcagccaaaggagatccacataacctagaggcaatgttgtgaccaatatcttgcaattgaggatatgattctggacgctcttctccaaatgaacacttgctgaagaactcccaaaatatatctctatccaagccttcgagttggataggcttacaattgttggtggcaacacgatcagcaacagttgtaaatcttgtagttactaagatcatactgcctttaggtccgttcttgaatggtgcataaaatgactcccactcgtcaatagcttcttgccaaatgtcatccaacaccaaaaggaactttcgtctccctagctgctccatcatttccacctgaagagcatctaaactgaacagtggcttatactcttccttggtgaaagactcaatgatctcttttgttattcttctcttgtcaaagaggtctgaaacacagacccataccctcctcttgccaaagtgagcttgcacccttggatcattgtagatgaactgagccagggtagacttccccaccccaccaatgctaaaaatcggcaagacagaaacattgccgatgcatttggcctcatcaagtctaggggccctgctgctctctcccttcagtttcttcgttctgcaggatgctgatttcgtgccagtgacagtggctgctgctctcttctctttagcccgtgcagcagcacccctggtgagtggcacacccagtaactcaatcacctgatctcgttgactattacgtccaatcatcgaacgcacacccagcttctcaatcactagatctcgttctttatcacggccaaacacttgagacacatctatgactgaacttgtctccggcatgtgttgaactgcctcgatactaagacccactgaattgatcgctccctctaaatcagccacagccttgtcgagcttctcctgggcctactttatccttgttttgctaccacggatcaaagtttttgcatgatttagagaggaagataagagttgacctgcccagctccggtcagcgtcctccatcttttgccgcagcgcctggtcatcgaactcgcggagaagatcctcggcgtcgtaggtggtgtccttgagctgcgacagaaggatcgccatgtccttgttcttgaacctgccccactcgccgcgattgatgaggaagcgagccttgggcaaggtggcctgcaggcgggacagttcatcgctcagctgggtcgcttcatagatgttgatcccggttgagatgatcgtttccacggcgtccatcacttccgtagtccttgattacttctccggatcttgccctctcgctacttctgatgagaaacaggagcgatcgattaagattacaaggagattatgtggtccaaaagcgaaaaatgtagcagcatatacataagtcaagtttacgagaaacggaatggcaccaaaaccaactcacctgcactcctccagctgttatactccctccgtcccaaaatatgaacatttttgaaatagtgccaagtcaatcatttctaactttgactactaatagcaagaaaataaaaaagatcaatcgtgtaaaattgatcttactagatttataatcaagctatcataatatgtaactctttttatttgatttttttttatttttatagatattgttggtcaaagtagcatctcaaagactgtgttgaagtcctaaaacatttatattttgggacggagggagtatcttatccttggccttaacaagttcatatcttttacggttttggtgaaaaaaactccacctattatatcttatcctctaccttaataggtgcatatctattacggttttgctgaaaaaactccacctgttatatcttatcctcggccttaacaggtgcatatctattacggttttgctaaagaaaaaaataaactctacccgttatatcttatcctcggccttaagatgtgcacgttatctactactaccgttttgctaaaaaaactggcggcagtttttgtggttgaaaactttcgacttttttaaccattcaatgcacttgaagatttgtgctgagctgagaaagaattagctagccgtgtggggaagaggaacccagaacttcccgctcacaccacgcgcatatgccatgcacaaccgagctatcaaagttttctcttggttagagtaagggtaataatacaaccgatttattggctataaggtttttggtaactttctctcagctcatccatataatagttagctctttacaattaatatatgacccacctgtctctttcacagagtttctttgttcttatatccaagccggctataagtttatagctcgcttctcctctctctcctctcttctctcctccacctcagcatttagtcttatagcctactattatacttgctcttacaagcaatgaatatataaattacagttaaagtgtagttatctcatagttgcatgttgttacactatagtaacagtagttatagtataattatattataattgtattataattacatttgaatgttttttcttaaaaaaaaacttacgacggattttgattttcgtagcttttttttttcatccacatcgtcatccgtagtgatatcgtagagctcccacgttaaccgtaggtcttcaagtgatattatgcctttaatcttaattttgtgggctaggattacctcacgtgatatatatatatatatatatatatatatatatatatatatatatatatatatatatgcctttaattttagttcggttttgctaaatttttggtgacacattttctggttgattacagtcgcttgttgagccgttggatcagtcataggattcgtgctagcatacttaattacgcgtaactagttgtgcttcataggttataggtcgctaattagcggtctactggagaattttgctactatttttttcttcactgcatgcactcaatcaagtacgagtatttgtaccgaccagcgaaacacatatgtaattaaagtataaatagtaattagtatatattagtagtatatttagacagtagttacaccctatttacacaccacttacatatgtaattagtatgtaattttgtgacttacatatgtaattttagtacttacatatataattttgggacttacattgtaaataccctaaaattacatatgtaatttattgacttacaatgtaaatacatgccgactaacttttggtgaaaaatatggcgccataaatatagctactcccttttagttttgttgattgggttgtattcaaagcctacgtagctacataagtccatcaactaacaatgctatctatatatatatctattatatactaaatatatactaaaagtacattaaacttcctacaaacactttcaagtcgtcacgtggcgctataataaattaaagaaaatcctataaattctaagaaaaaaagcaaaacatataccccttgattttcacttaaattggtgggtccaatattatattggtgggtccaatattatacatcgttagatgaaatctatctatctattatattattaaaacaaccttaaaagaaggcaccacgttcaccgtagaggctagaaattctcacattaatcgggaaaatatgaattatttacactgttagattgttaggtatgtattttaacgtatgagatttaacataaatctaacatgttaagtaagagatacggagcaccctacatgtgctgaattagaatcaatctataactgggaccaacatgcaaacggactcaaaagagttgtacgatttcctaaactaaccagatttaggacctaaatgaattaggcaagaaataaaaagcagcaagcaacaaagcactgtagatctcaatttttagatgtgttttgttgatctgaagatagacactagaagtgagggacggaaatccgcatcagtgggtcaaccgtgcggctgcacgacgagccggactcggtgatgcacgtcagcaaccagaaggcacgatatatagcatgtgcacgacagcaagctaggtgcactccttaagaaatacaattaaaaagttttttttaaaaaatatagattccaaaataaacataaaaataatatttggaataaaaatataatcccaataataaatatgtaaatcgtctttgctagatattcctttttatctatctatattattaagataacttagaaaaccatcatagtagttgaaatctttattattaagacaacggcttagtcgtcctatattttttctactataagttatcatgttaatcgaagaaaaaaaatctaagccattagattgtggtagaaccaaattataacggtgaagattgataacataaatattaatatatgtaatacaattgaattttttgaactaaacaaagttatataaaatacaataacatgcaagccactgggccaccgtcagcaccatgcaccttatgaccagaccaaattaagcacatagtagtagcatatattgagaacctagaaaaaatgaaataagagttcaattaggaatacaatttaaaaataaccaaatttcgaaataaaacataaatactattgaaagaaaagatcatctaaaacccatcacgagataaattgaaattcaaaataaaaataaaataaattcgtaaaatataaaataattataagagttaaagtaaggatacaatttataaataacaaaacatcggaatgaaaaatattgaattttcaaaaataaatccatctagaatacaacaatgataaatgataataaaaaggggaaaacaacatgtccgtaaaaaagtagagcggtgacggttgatgggtcatctataaactataaacaaaatctcaaatagaatccaacgacgattaagatgagggacgggcgggccgttaaatagcactattacagcagttggcgagacttctaaaaagtaaaaaaaaataaaatccaatgagacaataaattttaaaaactacaaggtattacatttgttttttaaaatcccaatgacaatgaagagggcagacagcgggcaggtcatagagaagtatggggcaaagccaaatgaaccccaatcataattacatttgatttttaaaatcccaatgacaatgaagaggggaggcaatgggcaggtcatagagaaggacggggcaaagccactggctgtttggcgggacttctagaaagtaaaaatatgaacacaaacgataattttgttcgattttgaaaatcccaatgacaataaaaagagaggaggcagtggacgagacttctaaaaattataaaaacgaaatccgatgagacaataaattttaaaactataaggtattgcatttgatttttaaaatcccaatgacaatgaagaggggaggcaacgggcaggtcatagagaagtatggggcaaagccgctggctgtttggcggaacttctagaaagtaaaaaaaatgaacccgaacaataattttgttcgattttgaaaattccaatgataataaaaagaggaggtagtggacgagacttctaaaaattataaaaacgaaatccgatgagacaataaattttaaaaactacaaggtacatcgaggaagtggtacatcgaagggtgcctaagaaataaggggtagcaactagcgtgacttttaaaaactataaaattagaaacacgtagatgataaggtttgacctttcaaagtcttgatacaacaaaatagctatttaacaattttttagtaaattcatattaaataatagataattttgtataagtgctagccgcgtaattgcgcgggccacctagctagttgatcttaaaacaaaccaaatgctatgaggtcccacttctcctccttctccctaggtatatatacgtaagtacatcttctttccttttttctttttctttttttcttcattttgccatttatataatggatatatttttttaaataatcataattttacaaacaaagaaactaccatcatacaactcacaggtaactaaattagctctataatttttaacataaaatttacaccattatatgttactcataaaattaataatgtaagataatttccaattaaaccggtgtactcattactttttactattattttcaaataatgcactattttaaaataaagtttacaccattatattgtgtacctatcaaataaacaatttaagatctatattaactaatttatacatgcacttaaaccaatggacccattatttaaatcatcgtatttattttttattatattggactattattctcaaataatgcactgtttcaaaataaagtctacaccattatattgtgtacccattgaattaacaatttaaaacctatattaactaatttacacttacactagaaccgatggacccattacttaaattatcggatctattgtttgctaataaataaagcgttcaaagttctctttcttggcccgctacacaatgcacgtctgtacctttgccttttgcacgcgtgacaaagcgtcgtgtctgaggcatctaaggtgatcacgaccaccgcagcgctaccgctttgccacatatcaagtcatatatggagatgattaattttgttaatatcatgaaaggaaaattaaaggtgtgatgccgtgagagaagaattaagcaccgtgggttgtattttttcacacttagctctgtctaagctgaaaccgagagttgattacagaataattataatgtactgtgtcatttcatatttggattttatactatttattcgtacaggtgaaagaaatcattatgttataaatgtgagcacaatattaacgaatatagaacttttactaagacaagggtgttataagggagtttaaccctcttttttccccgattccgtagtttgggtttttgtttgcatgctttccatgtttctaaatggtgtcttttttaaacaacattttaactttttagaaatcaattcattcgtttataccctcaaatagctatcatataaatcagataattcataagtatattttttttcatgcgagtccagtgtgcaggtggcattcgatggctttcgttgcagacgctatgtttggatgggactccgaggtgaaagccttgctcggcttgccaatcctagcagcatgatgcccttggcgccgttcaccttctcgagggcattgctattggagcccttgttcaactccatatcaagggatttctctgggtgaaaaccatagattcgttaggatcgggtgatgtcgccgttctgtcgacgtgttcttctcgaagtcttcgttttaggtgcttttcccttgctggacggttgtacttaaattttaggttcactccgtcaatgccggggttttcgccggtttttcataaattaaccgggccgtagtaaggattttgggtccagttttctttataagttggataactctcttcttcttcttctattgtgaaattgcaggagctccctacccgttcccgcgaaaaaaataatgtaattatttttggagttatttttcccttactgtatagttctaatcgtcaaggtttccttctattctctacttcctatacgatgaaaataactatttttttaaaaaaataatatagtgattacctcaaaaatatagaaaataattttatttactcgtgaatattctacacttttctttactgtcttctatacattttacttcacacagtttcttatttcaacatcatcaactatgtttactttcgttgcatagaaaagttacttctattgtaaacttaggtggtgtttgaatgtgctgaagatgaagatgaaggccctgtttgggagagcttgtcccagctacaagttttcccaaaagctgcttctgctagaagctgccccaaacaatacacagcttctgagaatctgtatagatacagcttctgaaaaatgaactaagaagaagctgtgttttagagcttttccagattcttagaagttggctaccaaacagctgcttcttagaatctaaagctcctccaaacaggcctgaagattaagtgtttcacgcaaaacaaggttgtaataacatgtgattaattgatttttaattattccaaacttaaaaaatagattaatatgatattttagaacaactttcatatagaaagtttttgcacgaaacgcaccgtttagcagtttgaaaagcgtaccatgagtatctaaaatttaatccaacttttatggggtttaagtaaattacttttggatgtttaaacatattcaatattagactcattttgtcatatatattttgagtgaagtgtgatggttcaagcggatttaaaaataataatatatggtttaaaatatgtaagtcgccaaaagttttgttaaaaaaaaaagcactaatgcagaggaagggctagtggattggttggtgttggccccaacacatgaatagacatctttttttccaaagcttcttgtgctggtcggaggaggaggcctcgccgccgcccgccggtggcgccagcacagcacacatttgcgccggtaggaatccctctcaccggtccggatctagcgtcgctctgccacgagcttctctgcatcgtttccgtctccgacctccgccggtgactgccggagcagtcggagcccggagaccgctgcactgcttcatcatcgagcacctcgtctttgccgctgatccagggcatctcccacatcctgcacctgctccacacgcatacaagatggtgactatggcgagcggtggaggaggacatcatattcgcctgaggagatggagatggtgaagcatagggcgtgttgtccctttttttttcacggagcttcttctccgacgctcgtctggcacctgtgtgtcgtgaccctgaacgccggcgaacttgtcaccggagttgaggaccgcctacgtatgcagcatgaaaaaagtatcagtcagtcaaatatttcagttaactaataagtgaaacataaagttaagttatatgtagggtgaaacaaaaaaaatcagcaactgaaatattttaaaaagtttatgaaacatgataaaaatacaagttgaaacatatcgctatcacatatgaaacaaccaatgttaatggattgaaacatatgtttttctttcatcaaaatataatcatgtgatatcttgttgtaaagatttaattacaaagaatacaacggtgtgatcggatcgtagattagataattagtttaagagaaaaatcgttttgaaactagctaaaatgcatgcatgcatacatgaggtggagagagagagagaggagaaatagtagtaacagttagttttgtgaattttgtgaaacacgctaaagacacatattgaaacatgtccctatcatgtatgaaacaaaaagtgttaacgtattgaaacatatgattattttttatcaaaatataatcatgcgacatcttgttgtaaagatttaattacaacgaatacaacggtgtgatcggattatagattaaataagtaatttaagagaaaattcattttaaatatcgttaaaggtgcatgttatatggttagagatagagatataggcttggatatgtgtatgtgtgtcagaggatgctgtccgatttttctccttgcttcggacgttcgaggagaagaattatccacaactagtaatatacctgtgctaacgctacggagccattatatttttgaaaaagaaaatactatgaaaatttgtcatgttagtgaataatgttcatataatctgtccaattgagctttaatttgattcaagtcatatatcatatataaatatatttagacaaagaacaacaatatcatattgcgtgaaaataataattcataaccatcaaaaattatatattatcatttcaatatacaatatctcaacgtaaagatatgagggcaatataagtctacccaaaaaggaataatcgagagttattccattaccttgttgcgggcataaacaagtacaaaaataaaacatttgatacaatatagaatatactatgcaactaatcaactaatcctaactttgaatatttgcgatatacttaagaaagtcttatgcgccacattctatttgtacgtcaatggatacagcaaattttgttgtcttagctagtcaccttcctgcacatgcatttattttactaaaaaaatcatgatgtagcacaaggtagtatgtcagttccaatcacgcaatatcccacccaaatggttgcggcatgctgtaaaaaccaaaggacaacggtaagtaacattctgattagcattttattatcctctatatcacaaatattgaaatgcaccttttttacatgccatacatattagcctaggtacctagcgttgttaaccagtccaagacatctttatacacaatattcctagtgcttttccctataggtctacctctttctttggtcaaaggtacacatcttccatgccacagtttctaccttcggggggtaggaatgaaatgaaaaattcaactccgcttagctcctagtgcaaatcagttgtgagatagtccaaatttagacaccagaagctacctgttacaaaatcacgtgaacatcagacttaggccctgtttgtttcagcttatgattattataatctaaattattaaaccagattgctataagctagattataataagctgatataaaataagctgtgagttgtttgtttgtctggattattggaggcatggattattgggtttgaaaggctaaagtctataatgccctcagctatctattcggttgatggcatagatgggtaatttttctcaaatatgtaagggtagtgggtctttagccactcaataatctaaaaaaagctcctttaaagcagcttattagattataataatctggcttatagattataataatctgctataataatctatttgtttgtttcagtttactcctataagctagattataataatcctaagctgaatcaaacagggccttacagccataggcccccctgattccacaacaacccataggaggataggagaaaacacagaagaaaacaaaaagaaagaggaaatcctaaggagattggaggagcttgggtgtgaggaaggcaaaccgcatgctgtgtcagtgaccgatgcagcaggccagactccctgttgaatggaatcaggaactaaccatcaggttctccagcttgatgggtcaaaaaaaaacaagatttattaaccatcacaaagttttaaaataaaatccaaaaaagcggtctgtttgacaaaagaaaacaagtagacatgtttatgacacttccattttctagtaatcttgttctccaagaacattttctgataatctcgaaaaaaatctaaggcttgatgacatactgtatatgcacggatagtttaacctgccatatttcattatttgtattccacaaatttctaaagcagaagaagcatatctgcatatctcacctcatatatatttctgaatacacataggtaaaagagaaatgcattcttcagtctaggtgagaaaaaatgaatagttaggaagattagattcatttactatggacttaaccaaaaaaaatagtttattactacacagctttagtaccgctgataccatcgatccattttgtccattctcttcgctgttacagtattgctgcaaattactgaacagttgtgacaagaaaagttgtattttctcttagggatggcagttgaaaattataggaacatgagcatgccattctcaagtagtctatatgtactgatgtttggtcaaatttgttcaatctgaaaacatacatgtaactgaatatggcctaggattttgaaggtaacatgaataaaatagacaccatgccttttggcttggttacaacaaatagcactaaagataagaatacacactacagatggttgacatctagaaatgtagatggctgttgtagaattagcttattaatatatgcgatcaatggaggaacaatattgagagcaacttaccttgcctgtgggcaggattgatggactacgggggccgggtgaggcatcccgctgatcttgatcaatcaattgtgaagctggtgagcagacaaaagatcagtctgcaaatataaattaatatatcaatgatccaatttgtagtaatctgttgcaagcatacaaaaggtagaattttgctatggaataaatttagcacagtatccacctaaatgaaaaccaattcagcgagagcaaaaaaaaaaataccgctgacctcctaaatcagcatgaacacttatagcaaaacaaacttcattcagtttggatattttcacttgtaatttcacgagtctggacactaccataatgatctcatctacaatgtagagaagacatggtcagcacatcggtagtacctttctcccaaaattcaaggcagaaccagaattggacaacgataattaaaattttataccttacttggattgactcgtagcacatataaatagaaaggttaggccatgcaatttaggctactgttgattctataaagcaatgggggaaaatagttgataagggtcagggttgccatggaggtgatgccatggtgagacagcagttaaagtaatcagtaaagcatttttattgtatcgacggctgacatttaagatgcacaacaatccaacggctgctatatttctgatgatgtggcttcacatgatcccagctaatggtgattccgatagtagatggatataattgaatcacactcagtttcagcaaatacattatacacaaaatggcatgtatttccaaggttggccacagtaatcagaggaactttggattcgcaggcagtatagctgtatttgaaggtaagagtacagggtaaaaccaagcatcatgctatcagggttaactgcagctgttgtgccctctctagaacaaataaaacttacatatatcaaaaaatagattgactgtggcagagaacgagagcaagaactccttaccagccagggtcagctgcatgccgccatgcccgcatctgcacacccgtatggtattttgcctccatgccatcgcaatcgcagccacggcagcggaatccgccggtgcgaccacagttgacggggaacactgtcacgatcctaacttcttcccgaggaattgctagctaatcggaatcggagatagatttgaggagagaattggattcgagagagaagagcaaaagggaaagaacgaacagaggaggaagacgatagaagcagcagagagatttgaattgatttctgtttgtgtattacaaaagtacgtaatctctctctctctcgctgccggctttatagcaatgtgccaaaaagcctctctctctatctgtggacccagccaatctctactgagtccactcactcacagggaaacgcttgctgggctgacggagtcaaacgggccgctccttggtgcagcccaagttctcctggtctgaacctcttgcttaggggtggacaggaagctcgtggctcgttagctcgctcggctcgtgacaggctcggctcggctcggctcggctcgtttgagataacgagccagctcgagctggctcgcgagccgctcgcgagccttaacgagccagagcagatgaggcccaggcgcctagcccagcccaacagcccatcacctagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgccgacgccgccgcccccgcctctcctccccggcgctgacgccgccggccatggacgccgccgcccgcgccgctccttcccgccgccgccgccaccgcccgcgcctctcctccccggcgccgacgcggctggccgtggacgccgccgctcgcgcctctcctccccggcgctgacgcaaccaaccgtggacgccgccgcccgcgccggtcctccccggcgccgacaccgtcgtggatgccgctggccgcgccgctcctccccggcgcccctcctcggctcctccccttgttcgctttctctcttgtccccaaagctcacgagcctaacgagctggctcgagctttcaaacgagccgagccgagctgggtttctagctcgttaggataacgagccgagccgagctagctcgttatcctaacgagccagaccgagccgagccagctcgacatccacccctactcttgctatccgaggtgttgccgccgccgtgacaaacacgcgggtgacccgacggctgacaggatgggggtgcggcgaggtcggcggatcccgtcgattcggcggcggcgcaggtgggcgcggcgctgtgcggcgaggtcggcggctcccgtcgacttggcggcggcgcaggtggagatgctgccgtcggcgggtgagcagggtagggggaagccggaggaatggatgcgggatggaagggccgcgatgggtggggatgctggcggagggagcggtcggcgatagagggatctgcggggcggaggatgctagggtttggagtcggcgcgacgcggggagagggaggggcagaatgcggaggtggacgacggtggactcgatatcatgaaaggacggcgatgatggcggatgcggtttctgtgggatggggaatacggtgattccgcaagaggtgtgagtggtgcgcggtgggaggtgggagagctctggttcgtttgatctgacgcgttggatgatctggaccgttggatttgatgaatgagtaatgtaggtgtaagagtgagttgatgaattatagggtagataggtgtaagagtgagttgatgaattatagggtagatacggctgtccatgcgaagaaggatcatcctgttagccgtccagcagcggtgtttcaattaatgccaatcaaagaaagagcttgcatttgattggcccaccgagttggttcgtgcaaaggaaggacggctgcccgacaaagaaggcatgaaacgccgtcgccaacaatgaccatagttgatgcacggaacatggaagtaattccttcgtttctcttcaatccttttttctatatatagaaagtaaccaaacaaagccgtaagataagagtagaacgagtgctccctgcacctgagccggactcctctggcggtcactgcactctatctggcacgtcgctgtaatctatcaggcactagtttagctctagttgttactagttctgttgtaacaactcctagcttctaccattgacaaacaacctgtaagtacaacactaatgccaatattgaccgatactagcttatgtgggtgctacctttttcactagaaagaaaaatttcaaaaatcacataaatatgagttttggacatattgaagtgggttgggtgtgttcgttttgaaaaatctctttgtgactcgtgcggctaacttttgtcatttaatgtcaatattgaccgatattagcacacacatgggtgcgatgtttttcaccggaacgaaaaagttcaaaaaccaccaaaacatgaattatcattgttgctttcactctttcatggtagagcggtgcttccgtccagcacgtaataccgacgggtgttgaatcaaatccatccgtccatcgtgagggggtaggatcgggaaacgtcacgagcccatcgcgcagggcccaatctccttggcgctttttttctccctcacccaacaatccccatccctcagcgcaggatcaatgatgccatcagcacggcagtccgagtcccttatcccccctcgatggctccagcaagtacctgccctgctgctctccctcccttggtgcatgagcaatggagctgccgtcggcactgcctaggcccctaaccagtttagggtttcctcccaagtggtgctcaagatgtatgtgattttctagcacacaaaatactcagaaatcataccaaatctcatagtagtttgtttgattttagatgatttatgagtattttgtgtgtctttattttgatagatttggtatgggtgatgaaatgtgagacaacttagaagaacaagaggagtacaaaacgatgatttctatcagatgtatgagacttatgaagtgaatttaatttattttcagcaaagtagaagacgatgtatgagacctaagaagtgtttctttgcaccggtggaagttgaatcaggagttctttgcacttgtggaagtagaattttaatgtttgatttccatgtgtgggaagttgtgttgttggacagtcaattatatattgtttgcctctatcagactatgagacttatgagcgtgtgtcctgtagacacttatgctggtgcagtgcttttgtatggtctagttattttggaatgaactactcaatcaaccatgcttcttgtattgaatctgtgaaaagagcacaagcttatgatggacacattttgttgttgaatgggaaaatttgagcttattttggacagagcatgatcttctgtcatctttatgtctgtttgtgtgtttgttctggaaaatttggatatgtgcacctgaacttgtttgaaggttaacaaatttgttttctagcgaacctagaacctatcttgcaaggcttatggtaccacatagtacaatcaggcttggccctgaggagcatgagatgagcagccagcagccgaaatcaacaaacttgtctcctgttgcgatggcaactttatgcatcgagttaaaaatggatattgatattgtaagttggggaatatattgtgagttagcatggctaaatgatatctagaaataagattccaatatgattcaaataatttcatgagaaggagcacaactagaactattgttccaatgacccaattaattctaaaccaatttctaatatcatcagtctcctttttctgcttggacaacttcttctaaaagacggtcgtctttcagccatttcctgctttagcttcgtcctctcttgttccgcctttgttttttcaacataacaggtccactcaatacgtagcctacccaattggcacgttccagcaagtg

SEQ ID NO: 74924 - DNA, 59193 bp, Oryza sativa
tcctcgctctgtgtgcatcctccctctctcagcagcacgaggaatccccgccgcctcacctgccccgcctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggccttccatcgccgagctcgatctgcagcccttggtcgctggcgttcgaagctggcctcggtgtggagcacgccgttccgcctctgttcaaagcccaccaactcctccaaccgtaatccccaaccagacttgctccatctatcgccaacactcgatctgtatctgactatctgttggctactgccctggaaggacaaggggcatttgatgttggcagtagttcctcaccatcatctcctttcccagcgtgcactcctgcatccccagccatgccaagcctggcgccgacctccggcaaggacgacctcaactttgtgttgttcagcgtccaatacccattcaaaatattccagttggtcaggtaattagttactatcttggctaattgaccttcttttgtctattttctcctatacttaaattgaaccattgaactttgctctttgttaactatttcatcttgtgtaagttggaattccagtaattaaaaatgttgattaggtttcttatttgtcaaaattttaatcatattcgatttggtgtatttaccttctcatttctagatagcacaaattttgattaaaaattggctgcaatagtgttctctgaattgaagaggcagctattaaaaccaattgagccttagattgttaatcaggttgttgatattgctcgcggtcactgtcgttcctaggtctgtaacacctccattactatgctaccaacatacacaactttttagcctatatatgttttcttttgttgttcctttaatttatttaaaccttttcaggatggatagggaattcaggatggtagttggtaatctcctgcaggtagaatccattactttttactgtctttttctcaatcatcgcaagcattttctttgcttagggtctgatttatgacctagcttccatgaatctggttatggcagtcttcttggtagatgtggcgttaggattgtgctcccactcacactcacactcagaggcatattgcctaggtctacagtctactccaaaccacatagttcaattcctccgcgttttaggtaaatcactgatctatctctgtatttgtgagaaaatttttgatttggtatatatgacgaccttgagaagtaatgatatgctttcttctggattctgtatatacttttgtgcagaactggagtcaaatgtttccgtttgttttgtggcttgattagtcctgtgcccatgcatctcttgctcccttactaatttctctggtgtgtagaattgcagatcaatgatgcatggcaaggtcagagcgccaatgaagtactaaaatggtaaaagaagctcctgctcctgtaatttcttagtatctctatgcaacaatggatgccctgatatactttgatacaggatgatctgttgattaccatatccgaaccatttgttctgactgtttatatatattgtagatcaagcaactactgatcatgccatttgtagagtttatgtgcttatcgttgcaaggtcaacaaaggctacaaacaacctacaaaccttttgctccttggggctactaaagcgctcttcttttggtgaaatggcaagactctgtttcgaagagtatatttggttgcttctagaagtaatactttttgcatatagttttgttcctttaaccttttaggatcaactaattttgttctccagcactgatttgatcttaatgactcattgcttccaattccataaggcacatgctagatggttattgacagccacaacaccggcgccgaggcggtctgccctttcgccattgacgcggcccaacagtcacgctgctcgactgcgccggtgtgcccccaacctcttgtccttgaagccacgtcttgctgaaacgttgccccaggcacgattagggcgcttgtggcactaattcggaaagatggaaggtaattacaatcttcgacccgcgattccctccccctctacctcatcgtgatcctctcatgttccctttcgctattcgcgctccggcgaactactcagatcggtcaatccctgaaatagcagataggctggtggaccttagctgtggacgactgggatcttgatggcaccgatccaagcctccgaggagagggatggctgtggaagggcacatcactgacaaggtagtaatttaccaacatcttagtgagcataattccacactaatgagcataaaagttcttttttttgcttttaatacatacagagattcagttcatctgcctcggattgctataaaaatactaattgtctattgcagcactatatcatgtccatttaacaaccaattcttgcacagctaagaaaatgtgtgtgcactgtgcagccacaattgcagatatagttaggtacaataagtgaagttgaggggaataatttggtgatgactataagattttctgcttgtgcttctcaatattttttagatatgttatcctctaatgtaatggggagaaagtctgatatattgtgatacttttcctgctgtaaagaagtatatatggattctagacccttatgctaaatattttcagtgttatgacgttagctgccatgtttaaattgttcatttatacaggtgatatttttttcctgcatttattaattcaaattctaaaactatatatgctgtagaatttcagtgttatgatgttggcagccaaatacattgtttaatagggaatatatttcttgtatgcatagtgaattcaaattctgaaactatgtcaggttgttgacacactatcatatatggctcactgcctcatttaaattcttgaatctgtgttgacttgcatctcccatgtggtactcaaatggactcagaagctccccatgttgatattgctaatcatgagcattctacaatcatcacctataaacttggttgatggactttacaaatgcatcttgtctaaggaatccctgaagtaagcctgtttccatacgattaatagaacatggcattatgttattgtttaatttatattaatgatgtgcgttttaggaaagagtgtattgtgatctcaaaggcttatccaattcgattgagtctaaaaacaaaatcatgaatcacttcgtatgaatcatcacctgggcattgagtgtttcaacatgattgtacagaggcttgcacacaacaaaattcctacatttaatgggtccaaaagttctgttataaagcacttcatggacatgtgattttgtataatatctctgattattacatttggtttcataggatacttacatcactctgaattttctatcatttttatttttttcggcaaaaattgagcaattttggacatcatccattatgctgcaaggttattgatgttaaatcatttgcaagatccatagatgtttggccatggatggattacgatctcgcgttctccaatgtggcaaagttcgctcacttttgcaatgtggaagttgcttacccttgactaaatcaggttttcactctccctaattctcgagctcgcatactatgtttagcacattatgcttttcatttcatgtgttctgtaatatgagagcttccatataattccctcatctgattggcagttggcaacagcctgccgtgtttgttacaattctgaatagaaaactttgcccatgtcggtcatgtgtttgacaaaatgctccagacacttgatcaaatgaatgtatttgtattttctcacttcctcagtatagcaacaaaaatattactggtttgctttttcaatctgaatcactaggtgttgttaggtttggagaagtttggactgaatcaatgcaatggacaattcatagaagatttcaagcagtggaaaaaggagacttctacaactgccacaggtacaatactctgacattgaaatagaagctgaccaatgcgctcacattgaaatagatatatgtttaagtacagcctgaattttccttaataaggaagaccatttaaccatttgtgcaggattaaaatttggtctaagatacagatcttgatggcatggtggtgctgagtgtatgccataattctggtgagagttggatgtaatttgcttgccttcaggataaattggatgtattttttgctgaccaactggatgtatgctttcttaaccggttttatttatatataactttagtcagcttgtgaaattatgtaaaattcagttcctgaagtactggtacttactgttgatttatttgtgcgtgcacttactgatataagatcatttgttattctctttacttacaatttcacttccagctggcaatgatttatacttcaatcataattgtttgcttaggaagtactctctccgcttcatattagatgtttgttttcttttcttagtcaaacttcttttaagtttgatcaaatttatagaaaatatattattattttcaaaagaaaacaaacatattatgaaaatatattcaatgttatatttaattatactaattttatattttagatgttaaatttttttataaacttggtcaaacttaataaagtttgactagaaaaaaaatcttataatataaaacggagggagtagcaacattgcaatgtataaatcatgccgggctaccttgtacgttatggatatattcaccaaaaaggattttatagaaataatccaaatagggtttttactatgatgtatgaaactttatttttaccttaacaatttttatggtctgcactgccttaaaaaaagtcactattgttctactccctctatttcacaatgtaagtcatttagcatttcctacattcatattgatattaatgaatctagagacatatatatttatctagattcattaacattaatatgaatgtgaaaaatgctagaatgatttacattatgaaacggaggaagtacctacatacatacattgccaaaacgtgcaagtgcacgattacgagtgctaatataaaaaaggagttcaccccctagcaatcctacgtgtgaaatcaaccactcttatcccatccgtccatccaccctctcatccaatctgagccgtccgctgtacaccgtagatctatatccacaagcgatttcgcccgatgtcatcccaccacgcggtaactgcgacgcgcaaatccccggtgcgatgacgactccgcctgctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggtgcgtgttcttgtgtgttcttgatcgatcgatctgcgttgggttgcgagatctgagatttttgcatgtttgatctgtgcgtgtgtgcaggggtgatgcgttgcagcaagagctgccggctccggtggacgaactacctccggccggggatcaagcgggggaacttcactgagcaggaggagaagctcatcgtccacctccaggctctcctcggcaaccggtgatttttcttttcttggttttatggttgctttgattgctttgtccatggcgtccatggctgagtgggttgctggctggctctggctgtctacgatgggcgtccatggcataagaggattctgaactgatgcataagagtgtcttgcatttgcagttctctaccataatcgtggtccacaacatagccgtgctttctgaatactttcaatggatagtcaacgaagctctacactacaaatttctgcaataacatgtactattattttttgtctgaattttgctttgcttgctacctttattttacctggagacaatttatatttggcctgtgataatactctattgtagtgtatgtactaaaatgtgtttttattctatttaggagggatcatatggaggttagttaactattgtttatcactgattctcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttggaacatttgctatagtattttctgatcttatcctgggatgtacctgaacttaatattctcggttgtaccggttcatttctgagttcattccctgaacttgttgactaatttcaatctgtgatgtggctcaattttttaatatatatctaccaaagtttggtttgtttatgttattggtgcactgagataattttaattattttggctgttacgttggtaaattatgcagttatgacattttatcacacttcctaatttttatatgtagtttacattttatacttatttttttatacacgtgcacgattcctagtatatctaatggtcaacttaattccttgacttctctcatggaggcaaaaccggttgtggacgaaattctgatgcatgtcccatgtaccttgatacatatgaggttcattggtggtcttaggttcgttctttaataaactgtctttacaacgatgaccttttaaacttaacatccaatttatgataagattaaaccattgtatttcttttagttaaattaactgtttgagctccataattagatatttaatgacttttttaaactgccacgtggcgctctaataaatccttaaaattctattaaaaaagcaaaacatctaatcgttggtttttatttaatcgggtgaacccatagttatcaccattagatctatatcttaaaagtcaccaattaaatctatccccaaaaccgccacgtttatgccattgatcgctactacctccgtcttaaaatatagtaacttttagttacgaatctgaacatacaattgtccagatttatagctaaaaatgcttatattttgggacagagggagtaagtaggaaggaaaaaaaagtacggtacgtttacgcccagccccacgtcttttttttcttttcttcttctctcacttagattagatgaaaaataaaactaataatttaagctcatatgcaaaaatatatgttatttggagttgtattataacaagctgtatgctgtcggatcatccataaaaaatataaacaaattgaaaatatagattatataactgtatatcacttgagaaattagacttgcatttccaaaaataaaaataacattcaaacattcccaaaagttaaatactgatataactaaataacattactaattttttcatatattatgtgtttttcttttgatagtattgatgtgctttatgtcctaggcttcattcgctctagctaattggctgagcttatcaggacgtgcaaaacaacgtaggtcattggcattgaatattatgattaattaagaattaaatattaaaactttaaaagtatatttatttaatttttagaatacttttatatagaaaccatttccaaaacacacacaatgttcggtaagcatgcttacagtaaacaaggggtggccaatcctataagtacttcggtactcaaccttaatcattacttcctctctttcgtaatgtaagccattctagcatttctcacatttatattgatgttaatgtatctaaatagatatatatgtctagattcattaatatcaatatgaatatgaaaaatgctataatgacttacattgtgaaacggagggagtacttaggtactaaaattcttaatatgtagtatataatttactttgtcaattagtagtagccaaatatatcaattatatgtccctactattcaccgtatatataagttctatatagaaaccactgtctatcaatcttcgagtctgtcgacggtgggtacccgtagaccgaatatagagggtattggggtacgttggtacgaggatctatgtaatacgacatcaaggaaacaagagacaaagattatactggttcaggtcccttaataggtaatagccctaatccagttgatatgggattatacggggatgaccacaaattacaaagagaataacaaaactcgacgataccgacgagatcgtagtcgagttgattcgactagatcacccagcgacttggctcctgtaggctccggcttcgtaggctgtggtcgttgtgttggctatgagatttgatgccttaggtcttcccggggggtcccttttatatcgcaggtcaggtggtctccaggtaggactcggagacatcggaccctgcacgatatagtgacgacccagtcctatacgggtaggaacctttccattgatggacttcgagatgaatttccttagcgtatacagagaacgtccatacacgcgcagatgtaccgtattgccatatcgcgtacatctaagggtaaagggtatatcttatccgtagccctgacagagtcataccctacacaatgcacctaataattatctcatatccaatgagcacgtgtaccatctagcattgaggatgaaggacgatactaactgggaaatcataaaaagatgacagataagtagatgatgccaccaagtgacagtcaaacaatagttgactacaattagattgtgactatgagtaataatattcctactctcctacaaccacttctaggatgttacatgatgctctaataaattaagtaaatgtaagaaaaataataagaaaaaataaagcatctacccaccgttttacacttaaaccggtggattcattattttcaaccattagattagatctattaaagtaattgctcgctcttaaaaaccagttaatccctccctatgtacacatgtacacgaaaagaaaaaaagaagagtacgtacgtatacaatcctcttgttcggtagttctctttctttctttctttctttctttctttctatgtagctctacgattttcctcacgttatatatatatatatatatatatatatatatatatgtatatatatatatatatgtatatatatatatatatatgtagtgaccactcctggtgaggttatcgaagaaggcacaccgtgccactgcacgccatcccatctatttacttgaaagtatttttttattaactatgaagtaaaagacaattgtagatgctcatataaacacgtgcacacccacccaatgaatgcacatacatatactctacccctaggagagaaaaaatatttgtttgttgaaaacccaagaaaaaaagtacataagtacgagactactaatcgccggaaaaaaatattcatgcgtatgtacactcctaaatgtcaatgaaaccacattataaacctttttttattatgtcagtctcttctaaatagtgttaacaattagtaaaaataattttgacaatatagatcattccattgtatattgcctcctgaacatgcataagtggatcgatgtataataaaaggagaaaaaaagccaaaacccatatttactcgaatgtttgggaaggatggtaatatgcgagtttacgtataatcgggataaagtttttttaatatgatagacattatcatttagtatatcaaagtctttggtctatttcacggtatacttatttagtttttatggttataaggtaatctatgattttttataatgaatatagtgtgatataacttcttttttagtattctcattacaaatagcaaaataaattgcccgcgcatctgcgtgggcttcctttatagtttcaagaaaggtgtaagagtactagagatattagagatgacattgtatattagaggtgacatattatatggtttgcctcttaatttatgagtgaatgatatgaatgagtttggatgtggtagtcacgtctacatagcacttgccctcaatgcttcaaatggtttgtagacgcaattgaagtgaacttttgaggtctcacttttaccatgttcgttctgctgcgtgatgtaagattgtttgctactacatagacttgttcggccttttccgtgatggaagatcacgttcgcgtgatctcgatgaacaaaacattacccagtgcccctcgtttgatctaatttcttgtacatctccttctatatattgcataacctccttttttccagtatgcgcattttgatggtctaaaactgggccttgacagtaaatttttattctacaatgttttgttaatcaaagatcacaatcgaaagaaagtacttttgaacaagaacccaattgatgcaatatcaaatctgttctcagtaactcgtacactatcaggttattactattgttggtgaaaagcttgaatttagacaaccaaattataattatatgtattcatttacgaaaaggagaatgtttcaggggaaaaaaaatcagcctctgccattggtggagggagggaatcagggaaatggacactatattatcctttagagcatccccagcagttcatccatatttgattttccatatgctcatatggatggccatctaaaaagattcctcatccatattccttctcactcccatagatcatctatattgcatcttccaatatcactccctcctatattttactaatatttttcaactaaccatacatttgtattattttttatggactatattttaaacaactaaattttaacagtgttatttatcccgataatctaaatgagtttattttaatggatgtatttttaatattcccaactattttttctcctcttctctttactccttttctctcatcttccctattcctcttcttctctcctcttctattcctcttcttcttctctccgctcagcgtggaggcggaggctagcggctggtggccgcggcggcgcaacgggcgcggggcacggcggcacgacgggcacaggggcgcggcggcgtgatgggcacggcggccgacgggggctgcggcgtggcggcacgacgggcgcgatggccgacgggggctgcggcgcggcggtgcgacgggcgcggaggcgtggcggcgcgacggccggcgtgggctgcgggttccagatctggtatgtctctccctctccaccctcactccttgggaaaaaatgcacatctggccggcgatgacgacgacattgggggggtcgcgacggaggggaggtcgatctggactttggatgggggcgggggacgctggcggttacaggatgtggaggatggcgtgaggagagagaaacgccaaatttgatgtttctctctccccggatggaggatagctaaatttggatgctgggatggagtatctgttggagctcacttttcttctcccaacctctattttgtggatagaggcctgaatggagtatctgctggggatgctcttaccaaatgctctggataataaggtttactgctggtgggccagcccattaacgtatttttaagctcctgatgcacacgcaccgcatacttgcaaacggctcatcgtttcgcttattcgtggcatatttgtaaacaaatagtaatttgtgaataaattttttatatacatgttcttagagatctaaaagcaatgggtgaaaaaataaacttcgatgaaaaacctaaaatcagctctaaattaagggctaaaattcaaattttggctgataagcataagcataagcgaaaacatgaggccgaaaagtatccatacattaagcgaaggggacgaaccctagttagaagatagggtccaccatccatgcttttgaaggggaaacggattcgaatacgatgcgtggcccggagcatccagtgtcgacgttagagaggccttgatcggccgctgtcggtgggaggagattagttccggtacttccatctgcattgatctcccaagacaatggtggacgtccactcgttctacctctacgacgacgacgaccgatacaagtcgcatcttgtatatggtccgatacgcatgtacggattactatattttttctccttgtgttggggatcgggttgccgggcgatctatgtatcgggattttgttcacacaacggtttttttgtgtgactagttaagtgcccgtgctctgtaacaggttctatgtatatataacctttatgtattgtataaacaggcaaaatgaattaatggattgtatgatatacaaactaaggacgagaagctgttaatattgaataagaacattgctaatatatactccctctgtactcgtaaaggaagtcgttttggataatttttaagtcaaatcttaggaatataaattatgaataactcttaaggttattgagtttgaaaatataaaaaaaattatatgaatagatttttcttgaaaaatactttcataaaagtatacatatatcacttttcaataaatgtttttctagaaacaagaagtcaaagttgtgttttcgagaccgtgtcgctgttcaaaatgacttccattacaagtacgtagagagtacatctcatatataaaatagactaacgatgcactccctctgtcccaataaaacttaaaccctagcactctagtaaggatttaaggaaaacgacaaaaaaacaaaatactcttagctaataaagaaattgtattggtgaatggatggatggggattagtgaaggaataacatttctcgatttgtgaactgatagtaggtaagaagatagaagttggtttattatttaggacaaaattcaaactttagaactgatttattttggatggagggagtaggagtcccgacacaattactgcttttaatacaatacataaaaaaataatcataaagaaatagatagatttgaagttaatgttagaaagtttgatattctatctcataaatcacaatttgttgtaaatgcacaccctcctacgtagttttgttgtaaaaatcatcccattacgcatgtgcttaatgaaatcaactcactatcgctgatgtagagccatcacatgctaagctagcgagtcaatcttgtccaagtacttgcattagacttatttcttcatgtttcattgaattcttttatgcatatagcgaaactaagtacgacaacgtttaaactctcatcaacaattctctttattgaatcttcaaggaaagtgttaaggctataattctagaagtatttaattttgatagagactatattgatggctcataatttataaaaacacattgattatagcctattacttatgagatgtaatcttaaacgtgttttataaagtgagtaggggtggacatttgcaaccaaattacttatgaggtggaatcgtaaactttaagtgatttatggggtggtttattcaaatttcataattttcaattgtagaataaagattagcgcttggcagccgagcacgtggcagtgagcctaaatctaactgcaagagcggagtctagagtagagctgtcgagtggtccgaaccctgctccatacttctagtttagttttttatatcactccagaccgcttcgttgctattttgggtagagttgaaatcatttgtttgaatttcaacttcaaaagaggtaaagctgaagctgtagccctgtcaaataggccctagatatcacaagaaatttgaggtgataccaaagtgaagaatggaaaggacacacctaaagcgattgaaataaaaaaaacgaatccacggaagaaagatgttactacacccacaccgcgatcagcagagttgccatccattagagttgtacacttacacactgagtgctgaattttaagcagacacaaaattaaactacacatggacagaatagtggaatgcaccaagaagaagaattaaattctgcagctagagtggtatatatgtagctaagctaggagtgagactccaccagaacgtacagtggcttcccattgagcctctcacgaccctgccaaaagaaaaaagaaagagaaaatttcagccccaaattaatcagtcatcggcgacagcttcaatttctctcgttttcttgacgggaactgatgcagagtcctatatatgtatataactggagagagactcagcagcagcaagccagcaaccagcgatgaagtgacagtttgttgaacgacaaatacgcgaatattagaaaataacataatatcaaataattagaaggggtgaggcttctaacccgggcagggttggaaatttcggtcatttcggtgacccccgatacgatattaatttggccaaaatttttgattttttcaattttttcatgaatttggataatatttgttcaaattcaactaaattttgttcaaaatttcggactgaaatttccgaaattttgagatttcggtgacctctgatataaacccctgaaccgatagagtgaaccctgaacccgggtcgtctagcccaccaccttgtggagctagccggaagaccctggacatttctcgcgatgacgtgacagtgacattgtggacaattaaagctgaaaatgcgacattcagcgatccatttggagactggtgatactcatattttccttttaatttgagacaactattagtttaatggaatagttaattcattactcgatgcagtctacggcgattcatcactagtcaagataaactccggttattgcaataatacaacatattgtatttattctactatcatcgatgtatttacaatattcaccccaatcaatatatcccaatgttttaatcaaaataatactagctacaacactttatataattcatgcatcttttcttttgctagtactatcttgcgtatctatccatctttttgtttcatgaaaagtacataaatgtgtcaatgttcaatcactctcggttaacgccggcaatattgaatttggatgaagaacgggatatatactgaattgaaagtaggagcgccacctgccaattcttctctaccaaagtacgcaagttatttaatttgggttaactagttcatttattttatctcaaaatatatatactccgtatctaaattcatagctaagagttactatattttagaataaaaatagtataacatgacctcaaaacaaagtgtagaatataagtgaaataaagatgaaggacatgttcagataacatccacactttacaacacactaccacaaaactccttatgggttgtactaagtcataatttgatggatataggtcttgtcacacatgagtcatttctaacccatcagggatgactggatctgaactagctggtgacactttcttgtcaaactttaccataattcatactcgtggcaaggttggatgaagaaattaatcgcaccatagcagatggagtagaaatgtgttaagccatagttttagttactatagcttgcctaaattttgatatgatataaagtgtgccattcaaccaaacaggtataaggcacttattgtacatgcatgaacttattaccttggtgtacttacgatgcacaccaactaaaaaattatgaaaaacaaacgaaaaaaaatctgcatgtaattgtaatcttaccctatctacatatacaattgtaaatttaaatttattatattttatgataaaaccaatgaattttgtagttttaaaagcatcattttgcttaattaatcagaattgttctatttcgactactctatctgtaatcagtcttaaccggcatatgcatcaacaccaactattaaaaatccgccaatccacatgtggtgtgtgaaggacaaaaatttacgtggatggtaattagaagtataagggtgtgttctttaccccatctcttcacaacttctattttctcctctttttttttttatgtacgcgttccaaattgctaaacgggacttttttttcaaaaatatataaaaaattaatttaaaaattatactaataatatattttttcaactttatttttgctaatgtttaattcactttgttttatgtgcggtgtggggaggtggagttcccaacctccacctccaaatgcagccttattagtagacttttttttaaaaaaaaaattggtgacaattatggttactatgtgaaaaattggtgacggtatatgtttaggagtgcgtgatgcatgtaggggttgtttggttcttaactaacatcgtcataactcactttaggtaatgttagacaagtgtggcttgccacactttctgtggcctacaaattgtaagccacatttgtggcaaagttaggcaaatgattaagtctataacatatggagtaagatggtaagaaaatgtggcttaccataactatggcaatgaatcaaacacaaagctaacgaggtgtggcagtttaaagtatggtctggcaagttgaagcattgaatcaaacagccccgtagtatcccgataatgtggggctagctgtcgctgtccggccggacactgccaatatccctgtcgccgtgtgcaaattattcgtggagaaggatggccggaatcactcgacatcaacactgtcggggggacgcatgaagcaagcaaattagctggtagaaaacatgaattatccttgtaccaatatattatatatttcttcttgtttgtatttctcatgttctcatcgaacttggaaatgagctcactacctgccagccgttaagctagcttcaaatagcttgtgacagggtcccctcctatatatggtatcccatctatatcctaccatgaatgaggtcatagcttgagccaaactgtggtttaatttatcaagtggaatttggtctagagtgaaacaatgcttaaaaattaagggagcaatgtgagacacgcatagcgcagatgcaagatcggtccaatgcggcatgaggggatgaggagacagaggcacgaccaccacagcgcagatgcgacatgttttttggccacgtgtggactcaccaagatcgaagaactcgtctccctgtgcggaggcgagaggctcagcagaggcacgggtttagtcgacacgtacgtaaaaatttaagctggtgatccaaagcaactcgatacgttctcgcactgtaaaggccctaatagtctctggacaattagctttatataatttggaacattgtgttcaatttttctttgataaatcacactctatttcatccaaatagaattcatgtaatcacggaggaattttaattttttatatctatatatattaccccttcgaccttgaccaccacattatatatttatcttaaaagggaaattcaacaacttacaaactgtacattatttatctctcaacatgtattactgttcacagctttatccctgaattagggtggtttccacagttcgatcagtaaaaaaaaataggtcccgtatgtatcaatttttctccccctcttctatcttcctcataagcatcataactgtgatagttgaggaatggggaggggatgttaatatggatttattccatttttcttgaattgttatacacaatttttaaaaattccaaattagctatctttaagccatggccacatccccaacactactctaaagagtctaaacccaaatcaaattaatgtgtgcttaattccatatttaatagtacctgaattattttttaagcatacggtatgttcttaattaagttttaagctagaatgattatagattatttcttaaaagtaaaagtgcctctagttaaattggaaggaagaactcaccttcagttccgggagctcaatcacacatgcacactccaccacttctgcaccagcacgctctgcatgcatgcacattcaaatgtcatatatgatcagaaacagaaaatgctcctatatagtacacattgtactgcgttaacatgttgtatataatattgagctcccccaaacagggtgatagtcacatttgagtcactattgcaccatataattcctccattccagaataaatatcattttttccttccttttatcccaaaataaatccattttaagcaattattgcatcacaatttgtaaaagtatgtgatatatgcatttccagtagataaaaagagaattaattgtaatggaatttgataaactgaggatattttagattttttggttttgtattggtatgtgtgggatggatgaaaaattattttattttggaacggacgggtatactataatacatgtaatagtaatacacacatatatatctcctgagaattcaacaattttgtgatattagcactaattcttcgatctgaatttaaacatatatcatgagtgttatcttattaagcccggctagctggtgaacgatcgatcgatttccaatctggcatatgcatccatatatatgctcattaatttaattacagatatgatataattaatactccattcaattcgtgcaaaaatatataaacctagtattaaataagatacatcatagtattacgaatcccaatactaaagtgtatctcatactatgtttttatattttgggataaaacgagtacgtaccaagcaagacgatggcggcacagagcgtgccgccggtggcgacgaggtcgtcgacgacgagtgctcgctcgccgggctgtaccgcgccgacgtgcatttccaagcagtcggcgccatactccagctcgtactcctttgacatcacctcacctgcgcacatgtatatatatacgcaatttatcaaattcccattcacatacaaaattctatgcaagtttcatttcagtctcttggtcaggtttatttcactactagaattcaatagcttccctagagtttaaattagaactcaagggataataagaatccctagggtgactatggagaactcaagggaagatttatgtcccctagagttacaatatgcaacctagggaacttatgccacatcagctctattatgaaattattggcaccacagtggcaaccaaagtgagtcccacagaaaattttggaggcaaagctcccagcagcgaaattttttgcgggaaggcaatatactgtagtagactaaaatatattctcccccccccccgctccaactcccctaaacaacatcagaagggtgtttctcctccggtcctccccaactttgctgcttctccaatctcccccaaatccctctccaaatccctatctttgttctggatgctatccaaatcggagctccctgctgattagaagacctcagatagagcattatggagctctattgctgtagatcgatgttggaagtgcatcgtcctctctaacccattgccttccctcgaatattgttagtaccttgcatatcagtaccttgcatattgttagttttgttgtttgccctatatatacaagccttatcaaacaaattggttgttcactaaatttgtttaataaaattgtaacaattgtttttttataggatgactcccaagtatcaggtgttagagaggaaactggagatgacagggtaaatgttatagctgaaggaatgtttggtggctacttgaccaattcatctgctaatggtgccaccacctttctcccagctttagatgaacttgatccattttaatttcaactggctgtggtcatagggccaacttttgggaaaacttggtagttatagcgcctaacttttgggtaaagctgattcttaccgaaacatgtgtaatgaagtggaattatgccattttgagggcaagatgattataatgcatcttttgaatgctatatatggtgctggtggatttaaacaatattttgttcctgtgtttaatcatattatgtgtggtggtggtctttgtgcaatattacttaccttcagtgcaatttattttacataaatcctaatgaattgattaacatcataaattgtaataattatattaaaaaatgctcaacataataagtaattcctagggaatgcatgtttttgttccctggggtttcaaaaggaatctaacaactctagggacagtaactttacacgtcacttgacacccaccagctgggcatttttccctaggtcaaacaaccctagggagcattcctttccctaggtttctcttgcaaaaaccctagggagctctttgtttcccgtagaccgtttccctagagggcattccctagggttcactctagggaaacctcttccctagagtttttcaccattcccttgggtttttggctctagggatgccattgaattctagtagtgtttgtagtttatttgtgccacgctttcatagtatgattttccaagaacttttcacattatgttagcattgtttatagaacttgttttaagctatttgttatatatatttatgacatataatatttaagtgactctaaaaaaggccattagtttgtttagtgaaaaactttcaaaatataatgtatagtataattgtactttaactatattataaattttatgtaacttgtatataagtattaaaaattacacgtaacttctcatacataagttatatataagctacaatatacgtagttttaatataattacaattataatatagttatattatagttacacacaaattgtactgtatttttttactaaaagtcttatgacaatttttagcaatctctatatttaactatttcctataaacgaatcaaccatctatcagcctttctttccatttcttctctaaaagtccatcccacagctgatggatgcatggctagaggcatgtttggttgaggattaatattgttacacattttttactaagatgactaagcttagtcttgtcacacttttgtgacaaacaaaataacaaactaaactcaggcaaagttaggcaagaaaataaagtgtatgacatgtggacaaagtggttaagggtttaggtaaagtagatttatagtatgaactaaacagtacctagtaaaattgtgtcttacctaagataaaatatggcaaatttagttgtcaactaaacaaaccctggatctttcgattctctcatggttatacatttatatagtctttgatgcgcatttcatattatggataatctttccaataagatataaacaaaaatagtaaaaatacagacaaaagtgacttaattttatgaggaatatactaaaatcatgtattaaatcttagtatttgttacatgtgaattgcctgtacgtactttctaggaagtcgcctgttaagaacagacagatcatagtttttacttagagagttaagcagccatacaattttctgtacctggaagtttgttaggttttcttagtgggataaattttgcaccaatagcgagcgctatgggaggaccgaaaataaaccctctagcttcgacccctgcaccagaaagaaaaagtgaaattaaaaaatctactggaatttactactccaaccaaagaaaatcaaacttaataaacatgcatgagctcaaaatggcctgccaggctacttgtacatataaatatcatggcagctcgatataccagcgaacatatataatggcatggatggttatatacaagtagacaaggcatgcacctaattagaccaattaacatcagaactgaaatactacatccaattttacttatacgacattgttaactcttaaacaccatgtttgatcatttgtcttatttaaaatttacaaatttagtaaaagaattgatacagatatgcaaatataagtaatgtttaaagtacttttaaagatgaaataagtcataataaaataaatgatgcttgcgtacttttttaataaaataaatgatcaaatgtgatataaaaataaacaatgccatatatttcaaacagagagagtagtatttttcatatgtgaatatatatatcatacatgatcacagataaaaggacaagattgtgtgtacacaaagaaaaaaaaaccaaacaaataatagatcgaggagttggcccacaccgacagaaatcgtactcaactacatacgtgcagccatggaacagtacgatatatgtgcactggatcttgtgatagctctcactcattgactagcttgatacatactatcatcatgaaagggagagaaagatctaggaaagcatggacaccagctagtagcttatatataaatggctattgctggcccggagagacagatcttgtggtgatcgatcatttgcatcatgccatgcatgtgaacgtcaaagatttaatgcccactggtaattaacatcgatcggaaccatcgttttgcttattcgcggaataagagaaacgatatagttgtaaacgaaaaataatttgtgaataaaacttttatatacgtgttcttagcgatctaaaagcaaaggctgataaataaagttcgatgaaaaaaacctcaaaatccgctccaaatataaggttgaaaatttaaattttggttgataagcataagtataagcgaaaagatgaggcccgatatatataactatttaattggaagtacacattatatatgccacctcagtttctcaaagtttaaactttgaaaacgcttcttctttttttagcaataattaaatttataaattcttcaaaaatatgttactatatatatatatatatatatatatatatatatatatatatatatatatatatatatatagagcgtgcaacacatgccactagtaaatagagatgatgttcacccaatgcaagtttactctaatatgattcattagacaatattgtggaatcatgttgctcatacaaacaccgagaaatagaagtaattaagatatatttgatgacctcgaaaatataattcatggtgaattagttaagttaggaggaacttgggggcaaggatctaactctaaatccgagtcatgacatggaatcaaagtgaaggtcaggattaattgtatcaaccctatatttatagcattaattaaaaactcatgcattttatattggtatagattattgaagtatgtattgttataaatataacacaacatgagatggtaataatcaaccataaaaattattcgagaatagacagtatagttaataagccacacatgtattttggcataaataaagtgcctgggatgatattggcccgagaaataaaccgagggttcctttgagatgcaagatatatagaaacaccatactagaaataggaaaatcacaggagcagtgttggaattgcacaaagtagttgtttgatactctctctgtccctaaatataagatattttggttggatatgacgtatcctagtactataaatctagacaaatatgaccagatctgtagtactagaattcatcccatccatccaaattttcagaatattttgggacggagggagaacctgataagaaaattacaataaatttaaaagtatgtatctagatttattagggagaaagaaaattaagaaggtgcctatgaattttaatcaaaggtatttgtgaacattatgttagaccttaattatgctaaaatttctccaaatcatggaggaattttatatcctatgaaattactttgaagcaatgctacatctgaaaactttaatttcataggaatgttttccaatggattgaattcctcctctttagattgccacctatcaccctgtgaaaatcacatgtggagacatatgagtcaataaatgatgtgtgaggaaaaccataaaatctccaatctaaagagtggtaagacatcaaatccccatttttttttctaaattaaattgtggtcacatttcaatagccatcagctatcctctccccatctcaaaatttggtagcatcacaattacccgtgatacgccatagtgcagtgacgtaggctatgttagtgacaaccaagagaatatattagtatgacctagtgagctgacatgagagatcgaatatgtgtatggcatggtgggcgccttagaataaagatgtctatttccacactatataggtcaattgaggcgtacatagagaaaggaaagtacacctcaattaacttatgcgcatgtgcatatgttgtcatgggtgaagtgataaggaaagagagcatacccaaaagttttgacatacacaattgatcatatacacggatgcacacaaaagggatggtggactaaagcaacatatgtgcacggcctacctacctaaatggtttctattatcgacctaaacttcaacaattgacgcaaagtattttttttaactgactattagtttttttttctttgtgagtactgactattgaagtttgtaaagaacaagataggtaggggtatgacagtgccaggtgtataaagtgaactcctacaggctatgggtaatagtggaatgaaatgaccactcctaaatgaattgacatatgtgtattagttgttggaggtgtgtattatagagttatgttccatggtttagttttgttgatgtgcatatctaattaccttttggttctagttgaagcttttttatgtggtggaggatccaatccaatgaacatgacaggaccatgaatatttgataagtcacctaatcaaatccaatttatgtatatttttcatagttagtgcctcaaacttccatatatgcctatataccaatctatactggtagctgactcaaatgtccaattgtcatgcacatatatatgatctcaaaatatttgtccaacaggcacaaacaagtggagggaaaggcaaatatttttgtcatatcatctggaagccttcgaactttacaaaagggtcagacagagaggccaaacctcctgttttgtagtcaattactactgctgcattattcttcatttctctgtacatttgactgtgacactcctcatacgaataatctctctcgctctgatcttacacactctctctctctctctctaatttatttgtcattttagaattattttcgttaatcttataaattaaattgacttagcattttttttggaatcgacaaatgaaaatcatgtcattagatttttccatgaaattacttcgatactactgaactttaccgattttctacagtaataagtaggtaattaacggttaggagtatgtattattggaggccgggtcagtataaaaaacgacaagtaaaagatattgtactgtacaacttggctagattttcaatcgacccatcgtgtgcctgtcaaagtcacgcttttaattaactatatttggatcttcataaataataactctgacttagtattaaaaaaataaattatatatttcaatggatttgataagatctgatatttttttgagataaagatcagattagttactactccctccgtcccttaatataagagattttgacattttacttgtactgtttgaacattcgtcttattaaaaaaattaaaactattatttattttatttgtgacttactttattactcaaagtactttaaacacaacttttcgtttttatatttgcacaattttttttaataagacgagtgatcaaaacagtgcaagcaaaatatcaaaatcccttatattaattaagggacggatggagtacttgaataaacaaagcgcacaagttcaaataaatcttgattttttcaattttttgagataaaaaacaaaacaattatatgttaccagcaacaacggagatgcctttgccagtgtaccgttcaacgaacaagtcgatggtgtccttgaacacagggggatttagaagtagggtcgtgatatcttggaacattattcctgcacatttcatcaagaaaaacaaatattatgaaagaacctgaaaaaaaaaggtattgcatagaccttttcttctgcagggatgtgtcattgatttaattcgcagatctagtcaatcgattttttttctagaaaaaaataattgccacaaaactcttccaaagtatttgtgggaattctataaattaaatttgggcgggcaagggaagatgagatgtgtgttgagaaaaatgcagagagagagcgcgcgcgcacgcgtgctcaaattaaactgataccaaccaatatatatatatatatatatatatatatatatatagagtgggaaaagacttctaaagggaaaatcataatgtctcgaatacacaacattttgctcacaccaccttcatcatcacgatggatgcgcttatcgaaatatccacataattagccttttgaatagagtgagagtttcacctcaataggaagattaaatatgtcttcatgacataatatagcaggaaaaataattttaaaaataaaggaagatcagttcgcagcaacaatattttgtggtaaatgtgcatgctcaaaccatgcatgtgcatgcctataaattgtagtaatgtgagaaatttggttataggttacaagctgcaaaaagctcatgataaagtcacacaagaaacaagctatattcatgaaagtttttgggttcagaaccaataaacaaaaaaaggaaggaaagaaccaacgaggcaaggatcaatagtaccagtggggacctttgcaaggaaacacagattttggcacttgaaattaaaggcaacccccaaggtcaatattctttacagaattgcagcccctattgcacatgtatatatgagattatgagcacatatatgctgaaaaaaaggatcagaaagaagaagccaaccagttgatacataatacttctgaaaaatatttatactcaaaagaaataacatcgttcggtttcaaaacaagaagacagagctagaaaaccacatgaattaactagcgagacatgcaagaactaagctcgaaatcacagtaaagcaagagaggatgcaagaataattaagctaaaaaacaacaagcaagagaggagagagaacctggcttagggaagttgggcacaactctaatggtggatgctatggcctgtgtcctggggtcttgcatctccttcttctcctcagaccctgccattgctcctcccctctcttcttttcttccctctctctacaaatataattgggagagagagagagagagatgcaagtggaggcctgtgagaggggtgtgtgtataaatagaggaggaagctagccagcagcctccttgcagtttcagatatatggatgaatgaattatagatgatgtagctacttgcaattgtattttggttctgtacaacagtgcatgtttgggctctctcactccaattccaatatatacctggaagatcatatcatagctaggacctgatctagagatgttgctacatagattaatattatatacttatagcacacataactatacaaaatagcacatatgcatgcatgatgaaggtgtgttagagcctctagggatgtaaacggccgtcccgtcgacccgtctgatcagttaattaatcagatcaactctcacttaattggttcttcaggttgtatgcctgtcactgaatattttttttgcattgatccaggaaaagacaaaattggttgatcaatggctcagcagctagcctgcagatccattttgtgttatcactctctgaagagtcagtatatcaatatgtgtgcaaggaacaaaatcctcgattgattgcaggcatgcaactccagtaatgagactgactgttataatatattcaaaattcagttttgcgatgcgtaaaagcaacaatttccattcgaaggatttttttgacctaggtttttctttggaatttgctacaatcttttcattcatagatcacttgagattctttgggtaaccatgacatttaattcaaactagtaagattctgtgctttccaatgggtcatctcatataattagggattggctgggtggatggattgagaataaaacatagactaacctatataattagggataggctaggtgggtggattgagggaaaagtattgaattctatattgattacgtacacataaagggacgcacaacctctggtgcatggtgagaagggaacggaaggcagacgattacacttttaaagtagtagagatatgttcgcttaccatattttgtttaacattttagctaagagtatgaatagcgagcaaataaatatctcaagtgtggagtattccacaaaaccttattgtaaagagaaaatcaagactatgttattaacaaacaagtatgatagaaaggtgaacacaataatagagtccatgctaggtacaataatatgcaagtctagggtaaggccacatttgtaatgcatgaaaattccctactaggattaatgttgtaaaaaccagtgttcggtatccaaccacggaaaatcactggataagacccaaacttggtgacgacaaagagagattcatgatatatatttcttagcgaggttcagctgaacttatatctgtttaaatctgtactgaatttatacgtatattctacacaagttataacaattaatcgttcctgtcatcgtgttccgaacgaggtctaattaaatctcaatggtacttggcttgataagaaagtgaaaatgtgggtaccattaacccaataacacaagtgctaatcatagtctgggagatgttggagctttacctaactataaactctagcagacggcacaacgaaaagccgagatttttcagtgccaatttggattttggagggccgggccacataaaacgaaatctcaaaagctatatatacatagttcgaagaaaacgaaaccgaaaagtttgacgactcacgaagaatcccaaggaggatttgccaaatctcccaacttgcaataaaaccaacgtcttaatttacttgtctctggttcttctgatctgcctatagcaatagcaccattcttttctatcatgtgcacacgtatatgcatactaacccatgcaaattaatagcttattttacatgcaacccaaggtttatttaactgctaatcttgttgattagtcagtggggtcctgtgcctttttgtactggagaagagaggttgagatagagcagcacatatgatccatgccgtgcatcttccgggcacggattccgatgcgtggtcccagccgtggatcgaatttgttgaaaaatataccctaccctatgttgtggagtacagattaattaattagttaacagggggtgctttagaaaacattgttaattatcatggtactatggtagctagagggattagatgtgtagatccactggtgttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagatttgggctatctgcctgtgaatattggggagaacagaatgaggcaaaactaaagctcctttttttttatggatttaagccagtggaggcaaacaggagacaccaccaccactcttttttttttttttttgcgatcagtggaagttagtattatgtatagtttctctaaaaatatatatgtttgagattgtgtggtagagcgttcgacgatgtctatgaccatccgtgtttattctgctagtgctatatataggatgtacattatgcatgagaaagaaaagccaaatgaacggtataccttatctcttatatcaattatttctctcgtaatattttttgttacgtacattatgatcgtctccttggatatgaaaaggaccagtgtaaccggctcaaaaacaaattaaagacgaaagagtctatgtaggaatacataatgcatgggtaagggaaacttttttcccccgctatatcatctctagttaatacggagtcgtgtagactgcttgagagacaatcctttgtaactctttcaagtcataaaagtatgttatttttcagaggcaagtataggaatatgcaataatgcatgggctaagggaaactttttttttttctcttgtatcatctctagggaaccggatcctctgatgtaaggaaaccaacgtcagagggcagtagtttcttcatccaccatccctaaagcatccaacgcctctcttgcttttgcttcattgtggggtgccgcaacctctgttctctcgcgcgcgaaggtgatcgattcattgagacggctatcaaggaagcggtcactgtcgccgagtcaaattttcgtccttcacatccaaaccggattaacgcagcctacgaggacgacaacagcccgatcttgtacgatttgccattgttaagtcaagtgtactccctccgtcctataatataagggattttaagtttttacttgcaacgtttgaccactcgtcttattcaaaattttttaaaattattatttattttatttgtgacttactttattatctatagtattttaagcacaactttttgatttttatatttacaaaaaaaatttaaataaaacgagtggtcaaaatttacaaacaaaaactcaaaatcccttattatgggacggaggaagtatatatttgtgtgcaggtctccgtgtggcgatcaagtgcaagaacagcgctgacggcgagtacgagatgaagcggccgggaagctcgacggcgccggcgcattcagcgtgccgctcgccgccgacctccgcggcgccgacagcgtggctcagctccacagcgcggcgaaacataacgcggcatgccccggtcaggagccgtcgaggatcatgcagctgtcggagagaaccttcgttgccgtcgccggcaagacccactgcacgtcgccggtgtgcgcgtcggcgaccatctgcaagcccatctgccagccgcgtcgtcgaccaagccggcgcccaagccgcaccctggccagccgccgcacccaacgccgatgctgacgccgtcgtacggaacgccgagcccgtaccactcgccggcgaggaactaattaattaatgccgtcgagctcacacattattatgattttttttctgctctgcactagcttaatgccatttatgatttattgttgtcaaggttggagtagcgcagatagcttatgtattcgttgatcttgagtttcttgggtcgatcgaataaagttccaggttgatttgtgaggtttgagtcaatacaggttgatttgtctcaggattcgtttgcttggcgcttcctcgctcgccgcctcgatgaatcaatccccttcacgcgccagagaacagagattgtggcaccctacaatgaagcaaaagcaagagaggcgttggatgctccagggacggtggatgaaggatgaagaaactactgccttctgacgttggtttcctaacatcagaggatccggttcccatctctagctagttaacatggagttcgtgtagactgctctcgagacaatccttcataactctttcaagtcaaaaaaaaaatatatcgttctagatgtaagtacatgatcaagctaacaatgaaaagattagttttttcaaaacttcaattccaattataatatagtgaaattctgttaaagacagagaaagctatatattgtactccctacttctgatctcaatgttaatatagtgcaattgaagactagtagctgtccggtcatgcttaatttctgtcttaattacggcgcgtgttgcttgtcgtccatggacgcccacatgattggactgatgaataattgacacaaagcgatcgatgttgcacgcaacatatgcactgatctatgaacacacacacataattagggcatgtataaaagtcactgatgtcatgttaggttgttgcaaacatgcacagatgcacatatagagttgagaaaatatagctccatgtttagaagcaaatgaaccatatgcctatataatggctaccaatggttctctctttctatggatctagaccatatggaaagaaaactacgtacagaagatggtactacattatatatataactatatatcattatctagctatttgacctcaaaactttggaaaagtaatggctaccactaataagtttttacactatttttattgtcatagctctgaaaaatacacattgaaaggaatgtatttattttttctttttgctagccgtccaaaccgtgttctcttttccgccttaaaagttttgtatttctctctcttttaccactattctgttagcactcacttctcttttaccattatcattgatcaatgttagttgaccattagatttgcccccaaaggcctattattcccttatgaaactaaaagtcataacaaatttcaaacaaaaaataaggagatatagttttaatgttgttagttttaaaggttgtatgaaaatgtatatattgtaagaaaattttcagttagttttaaaggtttttatgtgaaactttaaaataaaatatggaaaatagttttcacatataaatattaagtagttgctaatattgtaaaaaatatatatattaaacatgcaatgcagttaattccctactataaattatttaatgaaacatttgagaaccgaatgattccatggtgcattgtttttgaaaaaaataagaaaaataacatgttcaccaatttaatgtttttaaaatcaatatactttaggtagacaaaatttaattatcctttttttttgtactcgttaaaaattttcaaaggaatgtttaatgttggaatatgcacaagggcataatggtctattaagataaagttaactgtgctcatcagaataaggcatgcgtatgtacgtttataggggtgagtgtgcgcgcgttatggttgcttgtgttagtaatgtgttactaagaaaaagaagttaaatgtcaactactccctctgtttcatactccctccgtcccataatataagagattttgagtttttgcttgcaacgtttgaccacttgtcttatttaaaattttttgaaattattatttattttatttgtgacttactttattatctacagtaatttaagcacaacttttcattttttatatttgcaaaaaaaattgaataagacgagtggtcaaacgttgcaaacaaaaactcaaaataacttacgttggacagagggagtatgaaacagatgaagaatcattggcttagattgagttcgggagtgggttggaaccctcactcccaacacatagagcggcggttagtgcatgatttattaagtattaaccaaaataaacttgagaaatggattaatataatttttaaagcaacttttctataaaattttaggactgaggtagtacgtgtgttataaaaattttcttatagcaaagttgagtaaaaagatcttattaatctaattttcaatgtttttaactaatacttaattaatgatgcactaatgaactacctcgtgctcgttgtcatggggggaagttatgaaccagtggattcgatgtcagccttaatagggatggcaaaacaaaagggtctgttgggctacttggctgcagcgctgctgcagcgctgtttcacacaagccaagcaagcagccggctacagctgtggctgccacagcctggctacggaacacacccaaaaatgcacactaacgggagaatggtgaaatgaataagtgcaaattaaatttcacccaaaaaaaagaatattgtgtgttcccttatgtgagctgaagaccgcatcgatcatcatccctagttattatatattaacgcacgcaagcatgcatattgtgtaagacaaaagggaagctggatagcatatccatgcgcgcatgcaaccacagcctatagctagctactcccttcgtttcataatataagtcattctagcattgtccacattcaaatagatgttaataaatttagacatatgcatatgtatatattcattaacatttatatgaatatagacaatgctagaatgatttgcattatgaaacggaggaagtagattagaatcatctttactagattttcaccgtatgccctaacagtggtttcactggcgcgatcaatcatgcaagatgcatatggacatgtgccaacactcgttgtttcactcctagtgcttcatcatgtgtacgggggtcaatattttccaccataagagccaacagctctcgacttcggcgtgcaccatggtcgaccatgactgggtttacaactttacataccaaggaaaactggccggtttctgcgaaaaatatattttctaggacggctaaaagcataaagcgttgggtttttttattaagtttgaagtggattttaattttttttcttttacgaaattcggtcagattaatttcaccgcttgtcaatggtttcataaaaaccaatgttctaaacctctggctatagcggcaaagatggagaggggaacaactaggatacttcaattttgatgctaagatttatcggccgctaatagttgtacttagcctctaaattaagtatgaattaggaactatgaactccacgtatgaagtatgaattatgaattggtgatgaacttgatgtgcaaatcaagtgagtgatcgatatgctaacttttagcctaaattctgtcaaatttttgaactttttcctaatattttcgacaacagctaatgtcttagctgttggagagctcaaccgctaagaggcttagccggagatttagaacttgataaaaactagaaaaagccccttgactaagtttttgtgaatggttaggtgttagctagtagaggttgtcctttgtccttgttccatggttgttagaaagcttcctaagattttgtgaaaatccgtttagtttgagataatagatcatatatatgagttgaccgtagtaaaattatggcaaatatcacctttgatcttgatgttcgagttacatgtacatgaatttacatccactgaagtttaaatcctaacgtctatacttaaatagttatgtatccaatctctcgagttacatgtacatgaatttacatccacttaagtttaaatcctaacatctatacttaaatagttatgtatccaatcttttacagatgataaataaagctcttaaaaatatgtttgatagatagagtagacatagccacccatccaatctaagggagacttctcaagaataagaggaacatgataactataagctactgtaatatattaaaaatggtattagtattaaaataaagtttctcttgacaatcgatgacttgactgaacccaacgtgccattcattaaacctactatctacacaaccacttcttttctggtttcatttattagaggagcctagctagataggcacaaatgttagcaacgaccccgatgattcatttctaaactagctagaattaagcatggtaacgacatgtaaagggaagacatgtgcacacactcacgatgtatggtgtggcgtgccctttacacgctcaagacaggccaaccgtaaatctataaacctcacaaaatccccattaagagcacatccacgtgtgcgtaattatatatatgtatatgtttttttaattgtgtgcgtaattatagatatcagaatttaaactctactgagtatacagggttgaacgaaaacaggacaaaaaaaactgactaaccgacgcgggacaaaagctatgttgctgaggactaaatcggtccatttcatccaaattcaaatttgaattttattttttcgaagaactcatataaattcctaaacaaattaagaaaatatgaatctaaatgacttgtttaccgggacagaatggaaagcgtgagaaaataaagaacatgttctgatgggctgtgccgtaaggccactactgaactgcaaattgcaatatgtaagcccatttatgtattggtaatagctctgcaggaccccatttatgttttgaactgcaataagatcgagtataagaccacgcgcttgaaccttataagaagaaattatgggtgtgttggggattgaacataagacttcagggttaaaaccacataccacttatcgatgaatctctacaagattaacctaacgaattaaccaacgctggagccgatgttaaacttgccttctccgttcagtttggactaatcttgccgtttatttccgttaggaaaatcgtttattccgatcggttttctatcgatagccaacaagcagaacgagaaaattcaaactcgaattcggttttctgtcgatagccaacaagcagaacgagaaaattcaaattcgaattcgaattttagtttgcgaaaattgatccaagtcggaggtttttgttcggttttcacgaaaacaacatttaaggagctgagtgaatagccaatatggtcctaaagtttcgcttcgggctcaatttagtcatcgatgtttcaaattgtccaaacaagtcctctaaaataattatttgggttaatatagcctttggacccaaaaaacgccacgtgagcatgccaaatcatcctcacatgcagcggtataaatgaaatatcattctacccttatatatcataattaaaaaaaaagacacaaacagaaaaaataacaagccagcctaggcccaacattgttgcagagggtgaacgacaaaaggaatttatacaatccgtggttggctgcagcaatcgtaagtgacaattctaaaacgatcatacacgtgcgaaatatttaccttctttttttttctttcttttctatatggtatataagggtagaccgctgcatgcgaggatgacttggcatacgcacgtgtcactttttatgggtccaaggattatattaacccaaataattaatttggaggacttgtctggacgatttaaaacctcaatgactaaactaagcccgaagcgaaacttcagggcccatattagctattcaccctaaggagctttattaagtcctggtggttaacctattgacctggcaaaatatattcccttaaaaaaactgggaaaatatataaaagaaactgcggcctgctgggctattttcttaggcccacgttaacagcattcacggcccatgcatctccgaattggaacatgactaattgtaacaatgataaaaataattcagaagcattcatagaaatatggttgatagcccctccgtcccattttaactgcagccataattttccatgcacaactttgatcgtccgttttatttaaaaagtttttaaaaaaagtaaaaaacaaaagtcacgtgtaagtactattcatgttttatcatctcacaataaaaatactaattataaaaaaaatcaaataagacagataatcaaagttggatacggaaacttatggttgcacttaaaatgggacggagagagtatttaagagattaggagcgcacgatcggcccccacaggcttctatattgtgaaatgtaaattgttgtaagagtaaattgcattagcagtgttatgaaaatatatgcacaacggagacacgaatttttacgtggaaaacccttgcgggaaaaaaccatgggcgccgaccggcaatgatcactatagaggaattggatacaaacgcaggggatacattgggctatcgcaccctccccgtgcggcttacaagggatatatatagcagaaatctaggagtcctaataggaaactaatcctataaagtagagtcatattagataactaatccgaatatattgtgggcccgaaattcggatcacatatttaacaatctcctccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattgggaacaaatcctaaatttgctggtatgacattgtggaacccagcagagacgcgaaactgatgtacaaacttcaaactcgccatgggaataaaatcctaaatctgctggcattaatttctggaatccaaacagaaacgcgaaaaattcttgtgcacaaaaacaaagtacttagatcccctgataacctcctggtatgttgggtacaatggtagcagaattcgccggacaatttgatcaccttgtgatcttgacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttgtcaaaccctaacagaaatgcgaaacactctaggtgcataaaacgaagtatttgatctccgtaaaaaacctcctggtagacttggctttgtgaacatagcaatttggaacgtgaatttgtgttcccctgaacagaaccaaaacaatgcaaggcttaaatccctggtacgatggatatgtgcacgcaggaaaaatccaacgtgaaatttaattcacatgaacagggcaggaacggtggcttccgcttcctgactttcttttctcccgacgtgggcgtgcgctggtagattgatctcctgagtcccgacgtgtgtatgacgccggtagattggtaggtggacgccggctgctcggagtcgacagatgaccccgctttaaatcggcgagacgacgcgacgacacgcgcctgctgccgccgatcagatgagatcgatttcttcgatcgtggaatcacgccagtgaccaggacatcatatagatcgatctgatggatggccacgaacccaacaacgaagcgactatagatcgaatctccaatgctctgataccacttgttatgaaaatagatgcacaacggagatacgaatttttacgtggaaaatccttgcgggaaaaaaccacgggcgccgaccggcaatgatcactatagaggaattggatacaaacacaggggatacattggactgtcgcaccctccccgtgcggtttacaagggatatatatagcagaaatctaggagccctaataggaaactaatcctataaagtagtgtcctattagataactaatccgaatatattatgggcccaaaattcggatcacatatttaacaagcagtacatatatcaagtaggtataatttagtactcaaacttgtaaaacacttattttagtgtatgtacatgtttgatgtgtgcgaaccaagatgaaaaaacacaaaatggccaagcttaccaagttagaagttggttaggacacgatgtatacaggcatgagacatgctatatttgtaaacttgattttcgctttattattgtcagttctacctcttgcataatttctttttttttatttttctccgtgcactcttaggccttattaaacatttttctgaacaatgtatgtctatgcggctctctcctcacttacatgttaatgtaacatcctaatcaacacttaaattagcaggattagtcttgtttgtgtgttctttggccttggttcacatggacctggcaagttcatgtaccaaaatgagtgttttactagttcatgtactacattacatccatctaaagtttgtgtaccgctagtgtaatttactcttgatgcaaatcatgggtagggatgaaacgaagcggataatttccatctgctatgggggaaaagaatactgataccgttcagagtggataattatcggatagtccggatacagatatgaatacagatatattttcctggatatgaatacgaatatggtgtcgaggctttcgatggatacagatatccactgaaaccatgagacatactcatttctttataactctaggacctttaatctacctttttagattttaatagtagccaatctcataacattagtccacactattaatattatttaagcttttaaatatttttataaattataatatattcaatgtaaaatgagctaattatgtatgatggtattgtttctattagaagttgaggtagttttcgtgttccaagaaaaaagtgtttccgccaatcatattcaacccttattcatattcgagataagctgtatttgtttccgtatctgagctattcatattcattttcatatccggtgaaaagaatagtaaaatgaatatggtatgagcattatccgaccatatccactctgtttttattcctaatcatgagtatatatgacatgtctaattgagggtgtctaacgtaacttcccacctgacgtggttactaacatgtgagcctgagggtggtatgactcacatgaaagcaaccacatctctctgattttatgtgaaagaaaccaatccccgacaaggataaataggttgtgtcactactacatggaggcaaatagagatcagcactgtagatgccgaaagtggtatagccggcaactatagtgcttttcccgcccactcacccgcccacgcggctgccagcctaccaaatcacctttctccctaaataggtgccagtttttaaatataaccagcaactattagcctgtcagagaaaggtgtcgagtttatgcatatattataggtgccggttttataccgatgatcaaagtcatttgtgcccgcacctatctagtgttctgtagtagtgtgtgcacatgtgcagaggtcgaaaatgtaaactttttccttgccattatcttaaaattgcatgtctcatgtcatgtagatatgaaattctctatgggcgcatcgcatgcatgcaagctgtcttgcttcctcatcacaacatcttccctgaacgcccgccttctacgtccctccccctcttctcgctccctccattccgacgtctcattctctctccacatttccttttgatcccttctcttttctctctctctccggccggttgatcgaggtgagcgtttcctgacctacttgctcggattaattacaaattgatttgatcacgtagataattacatcatcatcatattgatggatggatgcttgcacatatatgcatgcgttttgaatctggtgatgtaatgatatccaattaataatcttgctgcaacacgaaagctcagccagtttaattgatttgatttagttaatgccatcgatctcaggcttgattatcgattggctgttgaatgcacggattaatcaaataggttgaaggcacgcaatgcaaaattccaaattgattgtggacctcttcggtttctccttgtataagaccttgaatttagaaattattagtgagctatcgaaagttttcagtggcatcacatattatctgcttacttggaacatatagaaaaatagaattattaattaataaattaattgtattgagcattatacttccttagtctgagagtatatagcattgggcataaagttagtattaactattcaccatgtaactagcttcttagtaaaggtacaaattaaggactgaagagaaactccagacttttaatcttcaaactgaaggcaagtaatacattttcagcccttccatttagttccttggaggatcaaattcaaatgttgcgacggatgaagacgcacgaaatttgatgcttttatcgcacgttcatgtagtatttggtcaatcgatctctgcatcatgccttgaccaagatgcatatttagtttgatgatctctgttgcttccaattgcactccattaattgtttgaactaatagtcgttttgcttcatgtaatcgaatgcttcctgcgttcgattggtgagagaagtgcactccaatgctgtaccaacagtactcttgggtttttctcttaggagagctttatttagagtgaaagggacttcctaattaagatttctttattttgaaagaagctagtaattaagatttcttaacatatgcacacgtgaagttataaaacatgactcaaatctgatgttgatgtgtgttcgaccaagtccctaatcagtttttgcactttttcttctgatttctcacgccaactgatcaattaaggcaagtaggattttagttgtgttcttttcttattgttttcctttctcttgcttttcgctttctcacctcctacctccttggagacagtccacaattgtgaattttcaacattagaaaaataatcacaattttgtggaaatgattgaaaaactaattaataggttgcatttcacatgaacatagttaattagagaacaaaatgcatacactaggtgttagagcagtacaaaagttatagaagatgtcactgcttactgcatgagtatctttcttcacaatcccattccatcataaatattgcctaaacaattccactcaaccttgttgcttgttcaactttaattctttcataacttgatatgaaggtcaggacaattactgtagactagtttcttcatggttgcacgctgaataatcgtacacagatgcccttgctgtctctgaattctcaaacactgaacatatattgtagaacattttacacctattcctgtctgatctcttgctgtgtgtgtacggagcatgctgccgttcttcccaagactttgtgtctcaattggttatttttgacttgaagcgatccgtttcggtagtccctgaggcagctagcgtaagcctcttttgacttccaagcacacaagttacttgctgcctcagattcatcagcaagtcactagtacttttcggtatctagatgaagcatatatataaaccacaagaaaagcggctgcccatttgtgttctgatcatgaggagattcaggtggtttcttgaaagtatgtattgccattgcttccttttgcccttttgatttttcattatatgatgtagagagaaaattatatatcttatcgcatcgatgctttatttttcgttgtgaaagggatgtgaatctgtggttgcaagatactgaagaaagtaataaggtggttcttcaatcttcataggcttcagagttcagagttgagttaatgtttttgcaaacaaggtgtctgctgacagtttgacagtaaaaagatctgtatatatgggttcctgcggtaacggtagaagctctgaatatgatgatcctgcatcattagagaagatggaggaactggttttacctctgaaattgatgcccttacacaccaatggccggttgtatgacatgaggttgtcctcacctactgctacctgtgtgatcaatagttcatctggttcattcgacccgatctaccgagcttggacggtgagtttactaccatactagttgctgaatttttgtggtagcagtgtttgatcttgtaagagtggcgcaattttgcatttgttgttgttgcagaagaagtatccttcagctctaaatgcctttgaccacattgttgcctatggcaaagggaagaagatagcgctgtttttggactacgacggtacactgtcgccaattgtcgatgaacctgacaatgctatcatgtctgaccaggtggttttcattgcaatatctagctctgttgagtctcctcttgtcaagttgtattgactaaaacttctgcacaatatcgtgtatacagatgcgcgaggtggtgaggaatgctgccttgcatctacccactgcgattatcagtggaaggtctcgtgataaggtgcatatgttatttaaaaggtttcgacgtaatcattgtgctgatataatagtaaattgatatgttatctgtcattctgatactaactgtacctttttgtatcaattttaggtgtttgattttgttaaactaacagaattgtactatgctggtagccatggaatggacatcatgggtccagttggggaacatgattcagttactaaccataggagctccattaactcaaatagaaagcaggtgtggagagctctttacagttcagccaagcataatatttgtttccaaattttagtgcaaaatatgatacagtatttgttttttgaattgaattgatcttttcaaacggtttttagggcaagggagtgaagatcttccaggctggtactgaattcttaccaatgatcaatgaggtagaaaaatgtcaggctttacaactccatattttagctcagtgttcatcttaatgtaatggaatgcaggtttttagattgctcatcgataagacaaaggcaatcgacggtgtgaaaattgagaacaacaagttctgtgtatcggtgcactaccgcaatgttgaggagaaggtgaagatttatcttctcaaaatcatttcatgggggagaaactattcataaattatattttcaggcatatgggcaattccttgcttctgattaatctgactttcagaattggcaacttgtttctcaatgcacaaatgatgtcctaaaagtctaccctcgcctccgattgactcatggacgaaaagtaattatctgaaaactgaaattggctcctgaagatgactgtcagctgtatctgatcattgaaatgcaggttttggaaattcgtccagtgatagactggaacaaggggaaggctgtggagttcttgctggactccctagatctagctagctgtaaaaatgttctccctatttacatcggggatgattgtaccgacgaggatgcttttaaggtgcggaattctgctttcattcagaaggtttatgtctttcatggacaaaattcattttatggttcaattttcaggttcttcgattttaaggcgcataatctgctttcctgcagaaggattaatgctttttcatggacaaaattcattttgtggctcaattttcaggttcttcgtgacgataaaaggggtttcgggattctggtgtcatctgtaccaaaggattctcatgccctatattctctgattgatccatctgaggtaggttcatgatttgtgttccatgtaaggcactgtttgatgacagttctcataattgttttttatgttcattcatgatatatagagctatttcaattgcaggttatggaattcttgaaaagactagtgatgtggaagaacgaagaagcatcacataataagtagattataaatatatctgatgtttactctagggtagatttctgaattctgacaaagagaataagcagaagggcaacagaattaacttggacatagtggacagttgtacatcatatagttaatccattttcttagcctagcaagtggcaaaataaaagtaattgccatgttgtacaagaatgcgaagcattctgcacaagtccagttctttgaataatggtctcagttgtagaatggtgtaacttgttaatgaactgtgatataaatttttgggctaaatcattaatatggcatattgtttggtgtgcattatctttacagatcatacataccttgcaaatttacagcagaaagcaaaatgagtatcaatgtttccaactccaagtaaaaggcaatttgaggtaaacatgtatacaaatttttctttacatacgaaaattgaaaaaagaaatcgattccccaatggcagattttgaagagttccctcaaactgaatgctctaaatgtgtaagttccagaattgagtgctctcctttggcaccaagtttctcaccattacgcactcttattgatcaaggggtcaacaatgacttgaggtttaaaatctggcttcaagtactctgaaagcaaggaagcatacgtgtcataacgggcagtcatgcggaagccccacttgtctttgatctggcgacataagttgaggtccatatcagatatcatcaagccatctcggtagcgagatagtgatggggtgcaagaagcatcaggtgctgagaaatggctggatccatagaaatgaccaaagtcggcatgctgaggtttcccgtcaccagaagtgaatgggtttgggaagacctctgtgccaacccggttaattgacccgacaaagtagctatttgcaattgcagcatttctggcctgaaagagtacaacttaagcatcagtgctgttctaccgcaaataagatcaaaaaacgaataaaattattcaaacttctgaaaatttcagaacgcaacaactggaagtaagtgctataaaacagaatggaatgtaagaatatatctgacctcaatgggccacattggttcactgagttcaccaacagttgcggatgggttgaatactatttcagctccattgaggccaaaagcaagccaattaaggggatgatgccttccataacaaatgtttactccgattttcccatatgctgtttcaaacactggatgcccagtgttaccctccatatagtatgtgctctcattgaaatcaccgactcttgggatgtgattctaaagtagcattttgttagaccggaaatgcttagagatatccagaggaaataaatatgtactgattgcacatacctttcgatgtataccaattatgttcccatgattacctatgacaacagctgtattccatacaatctctccgtggtttacatctctttcgaggattgggctcacaattaccatgttatatttcttagcaagttgttgaagaaattgagtagattctccatcaacaggctcagcaaactcacaccaccttttctcacgtgtgcagaaggcaaaaggcattgtccaagcttcctgaattttgggtatcaaccattagaatgatatgcacctttggaaatttaagccaatgtgtctagaacataacattgccagaaaattgagaaggaatattctgagcaacaaggatcagaaatgaattaatcaaatattcactattaacatggagaataagtattctgagaaacacattaggttggaaatgaagatatacatactaacaagttgcatgggaactctagagtaattcatcaaatgccaaaaggaagttgtacaaaccgataattgactcacctgtaaacacaaaatattaacaccagcatcaccagctgcatcaatcataggcttgactttctccatgatagccttcttctgatctgcaaaatgactggtggtaggaatagcaattgagttctgaatcaggccaactcgaataacccgtggttgcctgagatactctttatctgcatcaaaacggaaggcctgcagcacaaaagagcactacttaaaaattgagacaacaagagtgcagggaattatcagtttaatttgctagatgctgaaggattgaaaagcgcaaccagtagacaagctgctactaccactaccaaagaagagtttgacatgatgctttatttgtcttagtgaatcctgattcaaacattaaaattgtacatgattatttaccaatagacaaagacatttttttctgtagatagtgtgtgtttgattccatccataaatcaatgaaagaatataccaactatcaggaaataacctgcacatcaaagttatgagcttttgcaagagcagatgtggcttcgggcaatgagatggcctctagagcacgcccacaattcagtcccaatagcagccggcttgcttcctgttaacaaatatagaaactaagttagcaacagctcaggctcagcatataaacaagttgatatcttcaacacatccttaccataaagcttaacataaaaaactagtacggttccccaaataatcgaaccataatctattgttctgtattggcagtgatatactttagcatcttctaatgaaaccatatcataattaaacttcatagcgactgacagatcttgtcaattaactagcagtactgtaccaattttttgcctaaggagaacactgaacacaacgaattcccatcaacagatggatggacaaccgtagcgcattaacgttaacactacaggatgttttcttcaacagaattactcactgacaagtgacaacagtcaagtcactatctgacgcacaaaattgtgttagagagcaacccgacatcatcaattacaatccgtacatatagtcttagccgccataatggcaaagacatcaggatcaagtgatcaacacagccatctatctcatcaccaagaacccgattaactcacgacataccaatcgacaacgccagcgccgccgccgcgagctcgcccacccggaaaccaaccaagaaacaggcggccccggaggggggatgacccagacgcatccgaccaaccaaccaaccaaccagcgggccgccgttcggggggaggaggagagggaagttttaccttgaagagctccggggagaggttggactggaggagcctgtgcagggactcgtaccctccgatcgaccccgccgccgccgccggcgcatcctctccctgcggcggccgctcgccgttgctgctgtccatcctctcgactgccggctgccggtggtgcggttagtgtgatgcgatgcggttgccgcacttgcccgccctcctcgtgattgggctcgtgttagagaggcgagtagggctctctctcttttctttttttaactatggtttccttgtcatcttgtatacttgtattcctcgcatatgcatgtgaggtttgattggcattattgtttgtttgtttgtttggataggatggattagattggatttagataggtgtaatagttggcgaattttctacatcaacgttggtagataaatcaattattatacgctagtattagtatagcttttattatatagtaatattgtaatcttgtaattttttcctgttctatcaatataacttcacaccgtcttgtgcaaatcgttcaaaataaattatatagtaatattttaattgattcctataagtaattattcctaatccattaagtcatccatgaagaacacctctagctgcgtttgtttctcgcttctcccctcctctagtcccccgttttgcacgtgtatgtttcccaaactctaaacggtgtgttttttaaaaaaaaaaattctatagaaaagttatttttttaaaaaaaatcatattaatcattttaagataaactaatacttaattaatcatgcactaatgagttgttccattttacgtgcgtgagagggtagttccctacccaaattgccgaacagcctaaagagtgttcggaacccagttttaagcttacttaaaatgtggcgactctatgttttttagttaagtttggtctacccccaaattatttcaaaagtacaatttatccccctcaactgcaaaactagacaatgatggaggatgtaatttgcaattaatgtgcggatcaaatagttggggatgtacacattaatcccctccccttttcaagtggtctcgacttcccatgtggtactctaacataatgaaggatgtgcctcgccaatcaaatccctctccctctctcaatgggacccacctaccaatggcatgcattggaggtctcaacaagttagccgttgtcttaaggtcacaagagtgttgaaggtcaacaccttaactggaacagagaacgatgcttgtcgagatgcggtcaaaggcagtgaaaaggtcctagtggcggagtagggagtcgatgggaacctagcaaggttccaagctcctactcacaaggggttggggttcggctagtaacagcgagggagcctatgccatcctcgaatatgaactgggtaaggtggtgatgctgctataggatgcatggagaggacgtgacgctcatgcatttggctctcttccatccctcggtggcatggatagctttggtggtgaccaattgttgcttggcagaggttcggtctctagatcgataaccgctaatatgttgtcctccatgagctttgcatagggagggagaggagtggggagggcaccatcactactgaggaaggagaggaagggaagacaaaacgccgacgtcgagctcctctcactagtgccgtaagagcgagcacgtcccttttcctctctctcaacatcaatgactatcatggaggtaagggcaggaaggaataggcagggagaagagaatttagcggttgagcacactatggccagatctagcaagccaagctcaccagaagatgagcgaaacatgaggaggcatgacgcctccttgagtatttcaccatgtagggttccaccactgcctcctcttgggatcatcaagggagaaagagagagagagagagagaggggagcacatctacaagtggtggggggttcctagggagtgccatgacgacggtttctcacaatgagcacggagaaatcggcggctctcatggagcataggcggtgttggcatgtgacgagcacgtggcaagggaggtctagcaactgtgcaggtccatgtcttatgagagtgagagtgagagagagatagagagagagatgggagaatggggggaagacaataactaggtgctgacatacggagccaacatgatatttaaaaaatgatagttttgttaactgggttgccacatagtcaaattagtgccacgtgtatatcacatagtacaaaacaacccttgattatgttggggtggggttgggggtaattcatatggtttcaaaagtttaaggtcttaaatatcttcttccgtagttgagggtaaattgtattataaaactattttctgcatgatgaatggccgattagtttccaccaatgttcacttatacacggtagtttttaatgttcccttccatcctataatatagctaccttagcagttcaaaatataattattctttttctttgaaggaaaaaaaatataacaagatttaagaccttgtatatattcctctttattgtataccagcagaaattcattgcattgagtttttccatggagtgaatagagaaataggaaaaaaaaactctttcgaatgaaaatggaaaaacaaatgcgtcatatatcccacttggacaaagcaaattagaagaatttttctcttattctcatttgttccttcctttagaactacaaaaatatctatatattttagggcgaagggagtagacaagttgtgacgaaccaaaaattttatctagccgagacaaatatacttcctatcaaattacttattattacaacttgtcctaagtcaagaccatcagttctagaaactcgtataatttaacaaaatgcaaattattttaaaaatatttctcattgcgaatcattggtttatgtgttgatataaatatttgcctcaagagaaaactaaaacggcaatatgaaacagggagcataaatgcacacctatattctagtctcacaatcctagtttcccaccgaaatattctaaaattgaaacttaggcaagaaaaaggttaattggatccatgccattacaattgtgtcgaattagagaagtgccattataaatcgcctatttcgaagcatgccatccgtattgatgttaattttggtccatcccataatttggtcgtctcccgtgtttgtacacgtagtatcggatacatatttgtgtatggacggaaatgcccctttcagacgcgctctaaaactgacctggttcagctcaaccgtatgcttgctccatccattccctactccattccttcctattcgagctccagatctagccggcggtggaggcgaggattcgagcgagagagatgcgccgctagcaggtgatggtgctggaaatgtgatggcgacaacccccctccccgcggacccctgggcgagacggcgaggagatggatctaggcgaatccaatccgaccatctgttcaaggccatgagtatccctaaccctaaatcaattgaaacctgtaatgttaagaggcaaagcatcttttttctgcatcatacatctttggctggcattgttcttcatgtgtggtgatttgtttggtaggcacaggttttcggtagacgttagggttcaaggctatgtgacaatagatgctgttggtaggaaaacttacacaaaagggtcaactcggtaatgggttgtggaatcagatagctttaacgttgagtttgtgttgagtagccttgttgagttaacttggggcccaaaccaatctcctaccatatggtatttttgtaagtcaattagtgaggacgtgagactattggagaatggccagattccagagttgtttgaaatatatgcagaagagagccactttgagcttattgtatccatcctggatgctgcaaagggtgtgccatttgctataaatgctttaaatcctatatgtgtggcgcctcctgaattccctgctgaaatccatcctgaaatccctcctgacatccctcatgaaatccttgctgacatccccgctagtattgttggaggttttgaccagcttacaacagaggaagcagaagttagagaggcagatatctttgacaatgaggagtatgttggtgttgatgatgagtgcctatatgttcctgcatctaaatagcaaggtcaacctggatctgaacctcagggggctgcagccactggtcagagtggagagattggttctagtgctagtgctgtggcaggctggcagctcctgaggcacagattacagatgattatcctcagatttataacatcattcatgaccttgagaatccaaacattgtgaaagatgctttgttcccccatgataactctcagaaaagttgtaaggcattatgccatcttgaaaggttttgaatttgctaaaggtatgaagacagatcctacaaggtttattgcaaaaggtgcagctgatggttgcccttggtgtataaatgcatctctgattgaggataagaagactgtaaaggtaaactcttcccaaatttcttttgttttgttgttcaaatgatgtttacttatgtgttgcattactcatgcagattatggtccttccatttgagcacacttgttcttctacaaagctacataaagggaagatggctactcaaggctggtgtgcagatagactctctgattggattaagaagaatcctagcaagggaccaactgatgccaggaagaagcttgaagaaagatatgagatcaagttgaaatactccaaagcatggtctggtatgaagaaggctatggagcagatccatggtacatatgaagaaagcttccagcttcttttcaactggaaggttgcactgcagaacaagtcaccaggtacaattgtagagatagagttgcagaaagtaggcaagaagatgtgctttaagagaatttttgttgcattgaaaccttgcatagatggatttttggctggatgtagaccttacttaggtgtagatgcaactaggttaactggtaaatatactggacagctagcttcagccactgctatagatggacataactggttgtattatgtagcatatgttgtgtttgactcgacaatagatgataaccgactctggttcatgcaacaactaaataaggccataggagacccagatggtttagttatttctacatatgcatgtaaaggtttagagaatgcatgaggcatctctattctaatttcatgaagaagtaccaagggctaatcttcactaatcatctgtacctagctgctagatgctataccgaggataggtttcagtggcacttgaagcatatatgggatgtcaggcctgatgcaatagagtacctagagaagcaccactcaaggatttggtatagatgtggattttcagaacttagcaagtgtgattacctgacaaataatgtttcagagagtttcaacaaccagatcaagggcctaaacggtttgctcatacatgagttggttgattccattagagaaatagtcatggtgaaatttgcacttagaagagattgtgctagcaagatggatgatggaatcctaccaggtgtcatgaaggagctgaacattgcaactagtaatctgaaggttgttaaggtggctagaagtgaccatggatttgctgaagtcacaatggttgagagtgataatagcacctagagggacactgtggacttggacaaccgaaattgttcttgtagggtatggcaggtgacaggaaagccttgcaagcatgcagtggcttggatatgcaccaacaggggaaagattcaggactttgtgcatccatattacagtgtctaatactttagagcagcttatgcagggaggattcaacccatgactgataggttacaatggccttcagttgatcttgggttcaaagtgcatcctccaagactgagaagaggagctggcaggcctagagtgcgaaggataaggggttgtcttgagcctgggagaaagaaggtgaaatacaagagatgcaaacagtttgggcactttgagaaaacttgcaaattggctgagccactagatgaagatgacatggctgccgaagaaacacccaggaaaaggtatgtactgaacccttccattttgatccatgacttcttactgttgttgaattatgtgtcttcttttcacttgcaggaggaggccagcaaatgtggatgttgaagctagctcatctgcaccaaacaaaaagaaaaaaaaactccaaagaagaaaagaacaccacagaagatgagagatcttgcttcttccagtgctccaccaacaactactcctagaaggctatcagattggtttggtgtgtctcaaccatccaacccagcttgatgttgagctagctgattactgggttctcttttgtaatatatgatggcccaagaactgcttattttgtgatgtaatgcatgtgtaagctagctgattagtgggttcccttttgtaattattatgtgatgtaatgcctaagacacacctatgttgtgatggctggcagacctgcttattttgtgatgtagcagtgaagtaatggcactaagaccttcttattatgtattctaaagttggctgtgctatgcaaactatcatatgtggcatagatgaatgaaattgctccatacatgtgacattctcacatttgtgttggtttgcttgaaatacctgcttgaaataccaaaaatttatgtggcacttgacatttgctccatatatgtgatatttatatgaccttatatgaatgaacttgctccatatattgtaacatcctcagatttgtgttggtctgctgaaaataccagcaaatttgttggtctgctgcaaattgtaatgttgctaacattctcacattgccaaattttgacagttttagtgcaactaacatttagtgtagctgaaatttacaaatgaaaatcaagtttgctcacatatgttgctgaaatttgtcacataagtcacatttcctcagctttgctcacatttggtaaatctgcaactagaaatgcacagcccaattacagatttcacaattgctcacatttaactaaaaatgaaactaggattaattccacaagtcatttacagattgcatattacatattgcacactcacagcaattactaactacctaaggtagttcttccctacaactactggcacacaaagaacacacatcaacattagcatgtgcataacccattggagcatgtccttctctgattctattttgtccttcatctctgcaagctccctcttagactgattcagctcatctctacacagctgcaattgctcctctttttcttctaagatactagacaactcgatgttgtgaccctgcgcatctaccaattgccaccgcaactggttgcgtctcccgtaggctattatactcgccggcatggtagtatgccatcatatcctcgacatactcctgaggagacctcccatatccataaatagcatcgtacaccttgcatgaaaaggaaggaaagggaattgggaaagaaatcgaggagatgcaactcaaaatttctcgtggccaaagattcacctctcccccacattgcagccatcgccgggcaggatttctgatagtggacgacgtgcgtggagctgccggccacccacaagcacacttgagctcggggatgccgcacgcttctacctgggaccgctcctcgctacacctgctcaaccaagaaagggttctcgattcgtccatcgcagccgctcccgcggtcccctagagatgcggagggacttgctgccacccgccagctagggtttctaccgccgtcgatagccgccacataatggtttggggacagggaaggagcggtttctcgtggtcgagacgaaccaactcgccgatgtatccatgtatgcaggggcattagcgaccatatgaaactacacactggtcaaattaagtcaacgcgagcctacgtcgtacggcatggcatggaaactattctgcccatattcagatggcacgctttgaaatactacctccgtttcataatgtaagactttctaacattgcccacattcatatagatgctaatgaatctagacatatatgtgtgcctagattcattagcatatatatgaatatgggcaatgctagaaagtcttacattatg

SEQ ID NO: 74925 - DNA, 71057 bp, Oryza sativa
atgtcggggcgcgcaagcaacccgaagggtgaggctgaccatctgcaggtccttggtcccaaaggtggaggaaaacctgtgcgggcgggtccggaatgtcgaagatgaagggcttctggagccaggggacgatgaagtgggtgccctccgacgaggtctccgggagcacgccgcggaaccggtagaagatcacggcgcgctgcccgccgtccaccgtgtacagcgccgtcgacgccgccgacgccgcgatgcccagcccggccgccgcctgcgccagcttcgtaagcagcgacgccgccgcttgcccgccgccggccatggatcccaatggatgggggttcgcctgcttttcccggtgggggattgtttgggaaaggggtttgggtttttttttggggggggggggggggggatttggttgatctggtggggtttggttttaaagccgtgcacgggtttccgcatttcttggaagggaagaagaacgaaacttccagtgcgtgggcgtcgatggttggcaggtggcagggcactcgcattgagattcgtgctcaggcctgatgggccgtgggcctcctccggtcgatgctttgtgacgtccaatttaagtccctcaagatatattccatccgttccaaaatataacaacttttttaccaacattctcttcccaaccaatcacaacatcctcctatttaattctacctactttattaacaacaatgtccaactctaaatcttcttttattatgtaacgggggtggtaagttattttacacgagttcttattgttaagtagctgagggatacaaatcattgaacattttcctcgagtgagaacctcgagcacttctatcgagactcacattcaagatcatgtttgtgtctacttcctccatcttaaaatacttatcattctaaataatttagtataggtcgtgtttgtagtctaccaccgaagaagaggactcgggttccaccagctgaggggttatagtagacggcgacgggacaataatggtgaatccgtgaatagggtggcagcaagcaagcaagaaaatgggagaggaaggtgaccggattctcgacccctctagctcaatcctccaaccgcgtgtcctcgtgcttgtaagttgtacctgtccatccccatacatgtacgggcttagcctggacgagggatgaagctctcaccttgcatttcgagttagtgtagctcggaaggctatgcgggtaaccaaattattaacgctattcgtttgcacttgtgcatgccaatcaggctttatgcaagtaaccagacacgtcttttagccttttcttagcaagagatggttggttagggagatggctaaactttgatcagctagggaagagctagctagcctgataaatccactgaacacttatttttaattacttggttagctatttttagagatggctagtctgatacgtacgtagtatctaggtaggggcctcttacaaatgaatattgtacttatctccaatttaagcaaccagaggaatatatatgcttgtattcgagtagagttctttcatagtagtagatgcttagttaggtaatagtagatgcttaacactaatattagaaaatgccccccacgtgaacgtctaaaatgggaaatgccccgtacgtgaaaacaacaaaacaactcatagttgattcatgctctcgagaaaacattctctcgttatttacatggtatctaaatagttatgaaaaaatatagaaaaaatcaaatagatagattaatatgcagtataacactctacaaatatgtagattaaaatttaacttttacaagttgtaaaaaaaattaaaactatgactagttaacgtatatccacaatattttttttgcaacttatagaagctaaatttgaccttacatatttgtggagtgatttatcatatattaatttattttattcatgtttttcttatttttttacaatcatttagataacttacaaacaacaagatttataacaactcttgtactccaccgaaacaagaacaatggtcccccacacgacagttccacacatatcgcacgcttccccttccctccgtcccttgagccatggcgcgcgtttaggctttgcaaagagccaaagccgcgcaaaaagcctacacagctcatccatgcagctgtgacgctgacgcagatcaaccaaccactactaccgcccgcaagctcacgcagctccagcactggcctcgtgttcgatcgatggacatggcggcctgcgtcgacgacgtcggcaagccgcgggcgtcgaggaaggtgtgcgtgatcggcgccgggatggccgggctggcggcggcgcgggagctgcggcgggaggggcacgccgtgacggtgctggagcaggccggcgacgtgggcgggcagtggctgtacgacgacccgcgggccgacgacgacgacgaagacccgctcgccgccgccgccgccgccgcgaagccggtgagggtgcacagcagcatgtacgcctcgctccggctgctcggcccccgcgaggtcatgggattctccgacttccagttcgtgccggccaggaagagccgctgcggcggcggcgacaaccccggcggccgcgacccgcgccgcttcccggggcaccgcgaggtgtacctctacctcagggacttttaccgcgcggcggggctcaccgactccgtcaggtttaacaccagggtggtgcgcgtcgccgtggcgccgccgccatgccgaggtggccccggcgacgcgctgagatgggtggtgagatccatggacgccggcctctggaagcgatgcaccgatgaccagatggcggaggcgcactgcgtcgaggaggtgttcgacgccgtcgtcgtggcccccggccactactcgcaaccaaagctgcctagcatccaaggtgcgtagcgccgacgagcgaccaaatcagcaaacctgctcttgtctcaggcagaaatcgaaatgctaatctcgccggtaattaccctggtcgaaatctcttaattaatcaggaatgggggattggaaacggaggcagatgcacagccactggtaccgggtcccggactccttccgcgacgaggttaattaactaatttgctgccacggctgtgatttgtgactaatcacaaccacagtgcccgttaatcttggattaatcctggcgtgcgtgcaacgctgcaggtggtggtgctggtgggctgcggcgacagcggcatggacatcgcgctggacctcctcgccgtcgcgagggaggtgcacctctccgccaagtctgtggaggcggccgcgacgccggcgatgtccaagatgctggcgaggcacgccaacctccacctgcacccgcagatcgagcgcctgtgcgacgacggccgcgtggtgttcgccgacggcggcgggggcgtcgtcgccgccgacaccgtcatgtactgcaccgggtaccgctactcgttcccgttcctggacaccgaggggaaggtcgccgtcgacgacgacgacaaccgcatcgggcctctgttcgagcacacgttcccgccgtcgctcgcgccgtcgctgtcgttcgtcggcatcccgaggaaggtgatggtgccgtggttcttcgaggcgcaggggaggtggatcgccggcgtgctgtccggccggcgggcgctgccgtccgaggaggagatgacgcggtccgtggaggagttctaccgcgccagggagctcgccggcgtgcccaaggcgcacacccacgacgtcgagcctcacgtaagcacatcccatggcggtctaatctgttcacttcttgatcgaatatttgaatgatcgctcgttttggtggtcagaaaatgtatgagcttggggagaagtactgcgatttcccgcgcacggaggagtggaagagggagctgatggcgatcatcagccggaacacgagcgacgacatggagacgttccgcgaccgcgacgacgacagcgacaacgtccgcaggtgcctgcaggagtggtacgccctggctgagcaccaggctcaagacgaagaagacccagctgccgctgctgcacaagcacccgtgcacagctcgctctgaagcctgtacagctgtgtgttctgtgctctgcacaatcataattttcttctacagagcatgaaaatttctgaaataaaacagagcatgcagaaatttcgaaatttcgctgcatgatttgggtctctgcaaggccattgcccaatgatacggccgttggatgagatagtgtgtattcgtttggaataagtttacattaggttcctcatcttgaaagtcaagtttgaatcacgtccttcaatcgcaataacaatacataatgcgtctctcaacttcaaaatcaatacaaacgtggtctcaaggtggtttggacaattgtttagctgacgtggcgccaatgtgactggtttaacttagtcctcatcccacttgacgaaaaagtgacactagaaacacgattaataattttaaaattaagacaaaatatgtatggcttataagtcagtaaaaaaagataaacaatatagtggggcccatatcttctacctctctatatcgtcatgtctttatccttctctcctttgcaagcggacgtgctctcctatctagccgccaccttttgatccaactcgctgttcgtggtttcggctcccgcacttccacaacgtcattgtgcgctttgccccagtgcctcgttcttcttctccgcatcatcaccagtttgccacaactcgctggcacaaccatgcaatgcaaggattggattgagttggattggagagagaatggcaatgtatttgtccctcgcgccctcccacctctcttgccttatgacctccgccacggcgccatcgtcgcaacagtctcataccccgcgccctaacaacttcacctcaacgtacgttgataatcgctatagccagatttggcaaggtacgatatcgttttgcttacactgggggtgattggccttggtctatgtcgtctttttgctcattggctaattagttactttccgttgccttgtggtgatgccgtcgccgtatcctcgtgctgcccagcctcgctggccgccacattgttgaaaagacctggtcagactaccacgtggacatcacataagataaaactggtgttgaaaccgttaaaggactcgatttgtgccatttttaatagctgagtaacgttcaatatgcggttttttgcggttgagggatgtgaatgaaactcgatgtattgttgagggataaagtagacttatttctattcgttttcctcccggaaaccggccagctacatgggctaatacaactatacaagcccaccagacctgggcccatcacatacattacggtcccagatttgccacggtcacacgcacaacctgcccgcgccgcctctaccgcgcggtcgaccaaacgctgacctccagggtccacccccaattgggcaattcggcgccagctgggggaggggccctcacgtacgcacgcctactcacgcgcgggtggtagcctctctcgctgccacgttgggccccaccgttgataaagctggactccagtgtagtaccacccgctaccgccactgccagcgtgggccttcaccttgacccgagccaagcgaaaccaaccgcggtcaaagggtgggcccacagccgcctgtttttctatacctcccctgctgctggccgtccgatccgttctcatctcaaatttttgagccgtcggatgtagtaatggggccttcgcgtaaccaccgccgtagcggaatgggagcgaggcgaggggcgcgcgcacacacagcgcgaggcaactgaaacgaaacggcggaaaaaaaaatcagcccaacaaatccagacgttttacccggagggaccttgcatttcctcgtaattacaagttcgtatccgttggttggacctagtaataacgacttgacagtagcatgccatcctgtttctttcctctctttcgagtgttgaaatgggggatttaaatgggttgccatatacattgatgctaagtttagcatcttgacaacaaaggatagttcttatttagtacttcaaatttctttaaccctaaacgtgagccgtcaacagtcttttcattttctcactataataaaagaacatcacttgttaacagcgtgataatttatttttatcgtcctcgtttgatattatgaaaacttattttatttttccacgtaacacctgtatgtagattcttaagtattgtttgtaataaaatgcaacacacaaaaaactattaatctaaagctaataacatccttctcgtatcggtctcttttcggtttttttaattgtttggatccttctagaaattggcgcgtgttagactactttgtaaaaaactcctcaggtatatataaaatcttatataggctctctaccacctaacgtgtatatagtataggtaatagatacacccgcacaacaacgcttgttcattggagagcaatgaaatagtagcaagttagcaacgttgataacaatgttagctttttaagattcacatatagcagtgtcaccacatatgtgcctatcaattcatccgtctgtcatgaatgatagaaatgttatgagtacgatgacacattaaaacacagtcattcaactacacttctcttcatgaatcgtttacttgtagatggtggtacggcatatttctcttggttcataaaaaaaatgctacatcttatctaaatctaaagttatcattgcatttaaaccaacactttcaattacaggattttaaatctacgttataccgaaatctcaagcactacaactcataacgttcacagagctagcgacattatcgagcataagcgactaatagtgtttcttcatgacctaccacttctttatacgccaaagacaatatgtagtgaaggtggcgacgatggagccagacgatctcccgacctacctgagagctgtctccgccactacatatcacccaaccaacttccattgatacacacacaatatctgaacctgggtgattaatgatgtttttatatgacctaccaatttgtttatacaccgacgataatctgtagtgaagatgctagcgatggaacccgactggtcgcccgacctgctaaacatctgtcgatatatgcacgctgcacgctgcacgcaatatctccaaaccacagggtcctctccgcgacgcggagaaacattagggaagttgggcttccgctttccacttccgccctcccgagactcgaagccgcagcagcagcagcggaggaggaggaaaaaacggaaacgagccccccttcaccccaccccaagtccccaacggacgcgagtagtgaaaaaggcgagagcgggagcgcggccgcgcccaccctccctccctccctccgcctccacccccattcgattcccccccttcccttctcttcttccctccccaaccgccactctcccccccaaatcccccacctctcctcgagaatggcggagtcgcaggtgagtggggtggaattcccaggcctccctcttccgttctactccgccgccgccgcgggtggtggtgtaatctggttttgggcgcgctgattgattgattgattgtggttgtgtggggggtttttgggtgggtgggtgggtgtttgtttgcaggtggaggggatgaggaaggcgtacgcggagatcatgctgaacatggcgcaggagtcggcggcgcgggtgctggcggcggagcggcgggcggcggcgctcgcggggggtttggcgacggcgaggaaggacggcgtctccgcgctcgtcaggctcaaggccatcatggaggccagggtacgccacgcccctcctcctccccttccgctccttaggtttttttttcgcttgctcctttcgttggttagttggttggttggttgggtgtttccttcgggtttggttgttcgtaggtgtggttgcgatttcggccccctttcggggattgcgagtttccgcgatttagggaggtttttgggtggtggtatttctcggaattctggtggatgcagattttgcgtttgaatgcggggatttggagttcgaattagagggggtttcgcggttccgtactctgcccaaatgttggttgggaaagctggtgctagtgctttttcatgcttctgcattttggtttatgcagtggtgttgattttgcacagccttcaaagtagaaattttcccttttcggtatctatttcggcagcctcgagggcaactaggctaggctcctttgagtgggtggtagaggggggaatggaagcacaagtttgtgtttgtgctctaactcaaattggtagattttgggttcctcagttccccaaagcatgcaaatagtaagattgttacaatgagttttgagacactagctttggtgataactgataataggtacataacgttcccattttaatgtagtgatgaatcacatttcacttctctctacttatttgtgcttttttcccctgtggtagggtgatgcatgctatttctatttgctgttatacattgaagtgtagtgaactatctagatggcactggtatttttgtgtgtggccaaatttttgagtcctgagagcaacaataggatactatatattttacatttttgtttataacctgctgataaaccatgctcctgcaaagagtgttataatacaaaaagaacactagtgcaatataggctaccatgttgtttatgcaattatgccaatttatggggtaatctcttagtacataataatataattccgatagctgattgaaatttaattgagcaattctctcaactttagtaaaccctcatttgtaaattacattaccatattttgttctcggttgatttctgcagtgcacaatttcttattgggaaatcatatgttgtagcgtcttgcctgaactttttactttttaagtcaatttttcattatccagtccatgtttaggtcatatatgtgtatatggtcaaggtttatgattgttccataattgttccaaccagtcattgtgaccttgatactttattgtattttaaaatgtagtccgtgtttactttgcgtacaaggcatcaaattgatagtgttattggccaagtctgtaccagacatggtctcctgctgctttttagtaccttcagtctattggtgcagttctgctaacaaataataactgtagagtttctttcagtttgtgtaaagcccagggtttttgttggatagcaatggcagaaagtctgccatctttacaaaagttagttaactgtgataagctaactgccctgttgagacctttatttgttatgatggttctaagaggaatgcttcaaagttattttaaatcttgtgatttgaggcaaatttggatatttgtaacaccactattgtgcctcatattggctagctatttgttaagacaacacatttgtgatatgtatattaattacaataactccatgttctgaagtagtggttcttctacctatattggagtacttacttagggtgagtgcagctgccccataggtactctttggccactctagactaaatgaactagattccattcatgaagttttcaaaaattaaatgtagttcacttagttgaactagagtgggtcaagaagtaatcgtgagttggtccttgctcatccgtactatactaatttgtatcattttcagtctttctaaactgttttctgtctgcctcgtgctgtgttcaacattgtgttgaagacaatagatgaaaagaatgcttatccgttaatgtacttgatctgtttgaatggtgaaatgttatacatgtggtggcgcttgtattttgtgatatattttaccatggcctgtgacctttgttccatttgttcggaacaacctttttcaattaaattatagtttttaaatctttttttggtaggtagaaccattgactatgtattagggctatccatattatttgggaaatgcaaatcatggttgtaaaattcattatggattctaggcctataacctggatgattgccgattcctgtaatctattctagtactggtggtaggcccagtcactgcgtataaacatatgcatatgggcatgtacgtgttaaagattagaggacaatcatcactctctgtttctgtaggccccttcttttaccagcaaacgtagcatgtctaaataaacttgatttgtttcccattaactaagcattaagggcctgtttggttggtgccctgaaggatatttgcctgaccagacgtaagcctgagaccagccgggaccttgtttggttggtgccctgaccttagtttctccttccctggcctgagctcttttggagcctcattagcctgagtcaggcgaccgttttcggtcgcctgagctccagggcggcgcagctacgctcattaatcctaattaccgcttataataatgtagtataggtactgtagattgtagaagcagccgaccatacaaatatattttatttgtgctttcaaggagggatacagcccatccaaatattttattttttttctaacactttataacaaccgtaataattaaaagcttaatcacgtttagttttcacaggcgcggaagaacaaccaaacagacaagtgttcaggctgcctgagcaggcaaaatttatcatcctatcaggtagctctcaggcacccaaatttttcaggcatgtaggtgtgggcatcaaccaaacaggccctaagtcataaaacagccttttgcctggttattgtggcccagtgttattaaatataaatgcatgtatactcaaatttgattggccggtctaagtctgtgattgcctggattgtcgcctgaaattttcttatctcaccattttaaaggcatacaaacgaatcataatatttaagagggatagactatggattcacaaataaaatgagaaacgcagtaaagcaacatcacagccaccggttaagcgtacaaggttgccaaaccttgtcaagaattgtaagcagttgatttacatggttaagcatgagcatatgcggataagcggcccacttacccggttaccccacatacaaggctgattaataggcccatgtatgactttcatttattaaaaggcccatgtacttctgtatgacttttattctttaaacctatgtttattgttcataaagaaagatgtgcctcgcatgttagactaaagaaatttaaaatctcttacacggccactttccgcataagatctacaaggtggggtgaccacactgcacagctcactgtcttagaacattgaagaaatttaaatagttaacctaaaaagaattgaatacacatggtatcatttgaaaaggtcaatgctgattacatatggtagaaatccttgtagtttattcaatggcatataagtacttacaaaaatcatttggtaaaaatctggtgattttgatcctcttttgtcctgcatcatatcctgccaaaaaaatcaagttgagttcccttgcagttatctgccatttataacatatcgctaatcattctttcgttgtttaatgtgtaagtaatcagggagagatggaaaagaccgccttccatttgaaactctctagatcttatatattttccagcaatctatgtcaaaagagcgtgatggattgggtcagtttgctgggccctagccaggtggactcgctaccgtgccaagggctgggcgtgctagttacaagggttccgtgcatgctctttattttatacccaaaaaattaaagacactgagaaggggctagggtaaaatgcgttggtcagcaggattcacatgctggcaacagctcatgccaatttgatttaaaaaaagttacttttttgtacataaagcagcttagttatttctcttttgaacttgctttgcaatcatttgttccaaatgtttacaactttaaatagatgtgtcctttctctcatgtggaactgatgcgtgtcaaaacttgtttgtacatgtgcagataaaagaagcagagtcacaatctttggcaaacattaataagattaaggaactacaagagcaattacatggtgctcaagatacagtggcctcccttcaaattgaactgcagagatcaaatactgaactggagcaagcaaggagcactttggctgaggaaagaagaaataaccttcgctcctgcaataagatcaattctaataaaaatagcagctcttcttctagaaagcatctacaaggcagagtatcctcaaagagtaaaaatacggcaaaggaaagtggagctgttgaaaacttggagacactgtaccgttgtgattctgatctgggttcattcatggctagaactaagaatcctgagctgtatcgcaatgggtgtacacaacgtatccgtgcaatcaagcagcgaagtccaaattcggatacatccctggtagaaaacagcaagcaaactagtgcactgaatagccgttctaagactggaaaaactgataccaacagaaacccacagagcacaaggtccatcatggaacagatacttcaaacaaaatttctggccaactgcaagagaaagagaggtaggcgaagcaggccaagttacatgcatgataattctggtgagcatgggcaaacagagtacaagtcgtctgatacatctgatggaaatgggtgtttgctgctacttcaggctcttgaacaagatctttcacctctaaaggcgtcttctggaagtgttggtgagggattagctgaccagaaggatgaattgctcaaggatgaaaaggatgctgacttgaatcttcaccctgcttcccctggaccaaatgatgtactttcagtaaacaacatgcagatgaaaaggaggaaaaggtctaagactatgagagtctttgaatctgattttgaggcaaaagctgcccctgaatttgggaacaccctgccaaaatcaagtaataataatagcatgctaaatagtgaacagagctctgatccacctgctggaaacaatggtcctgttttgcaatgtactgctgaaaacttgatgcacgtgactgatgctgcaaatgctgatcaattaaagtctgagaacagctccccgctagtccctcagtcaacagagagtgaaattggagatgaaggtaccatttagaaactttgtttttttaatttacaacatatgcctctgttattactttctgaatatgtattgagccctgagcatggttaatatgatgcaggtaactcgcgagtggatcacaaagagtgtagaacaccagataataatgcaatagtcttggaagaagtgaatgtggataaaagctgcattattttagcttcagatggagctgattcttcgatagtcagctccctggacaaagaagaaaatgcaaaagaagcaacttctggagttgccgtgcaagctgaaggtgccagatatatcaaatacacattcaatcgcaggaaacgcaaggccgcgcctttagacagcactcctcaaggggctgtccctgagaaaagcagtagtgtggtttgcccatctgagaatcatgagcctcatgcaaagcctgagacgcaagatctcgtcatagagtcacctccaggtgacaatcaactaatccatgttgcccagcaggtatgtgctcctctttacatttggcaccatgtgtgaacttgttcaacatctctgcactcgcttctgaaaaatattctcaccgtccaaaaccgtattgtttttcagctcatattgctgtcagcgcaaaaatgatgaaaattttgtgatacatcaaagcggaaagagggattggttcgaaagaataatgcttaagggacggctccaataagtggatcatggatcgtttgataatatgctaaatgcagttgagttcttcaacggagggggagagacttgtggtggtagcggcagagaaatcaagaaagctagcttcatagtgtagttatacctctacctaagaggtgttattatagtagtgtataaattaggcaggagttactatttattttgtagatgataaattttgaactattggtttaagaaggttataaattttgaagtggtactcagttattaagtcggttcaaattcagaggtgaaacatctgctcatgtaaagcaacttacttttctctagttttggggaaaattttggtcatttgatgggaatattcgcgcagatcgttgcacagtatgtgtgctacgttggaacagtacaagatgcgggggttcaatcaccaacgcgcgtgcattccatcagaagtactctgctactttatggccatacaattacaatcgatcttccgcgcctatgtaacatggggaggtgacgagttagtagcagtaaccgtagtttttttagtccatcacatttatgcatttacagtctatgaccgtattaatacttttgaaaggtatgttattcctcgaaatttcttcagtgtaggccagtatgctttatcagcccatacagatcggaaacagtacagttggacatcttaatacaactaaaatagttgaagtatctagatacagctatggcattataacctgaacccaaatgataaatggtatttcgtccgtttcactgtagttgccataattcctctttatagcgatcgcagagggtaaagctgaaatagccgactcgtaggtcgacttgagacgatatatatatatatatgcttagatcgttgatgcgtttgtcaatcgatcgcgttgtagcgagtgcgactgattgattgcactaatgaacaactccatccatggtgaaaaaaaaaaacaatttctaactttgaatctatacaccctctatattcaaatttatagtcaggaattgatttaattttttttaaggatggagggtgtgctcaagtacatatctttctgtgccgctagctgaaaagcagcctgaactgaaaacattcaccatatcatgcataacatcagagtcagacacatcaccatgctctagcctactcgatttacttcaacctaaacatgagatatacctccgggtcgtactttgattcaagatctgcagtcaagtacacttctacaatactcactccgttgaaagatacaaggcagggtttcacttatcgcatgataatcacacgattatcgcgggggtacggtaggagaaatcgacgatatggtttggatgaattttgaccaaattcaaaattccggaaaaaataaaaaaaaattgaaaaaaaatcatggatatggttcttgatttgtaattgtcaatggtgaagaatttttttgaaatagagtaagctatattcaaatttgagggcaaaaccgagaatagtttacaaattagaaaagggaagataatattgggccttaagtatcctacatattcttccaattattcttaatttctagttttctacacatattcaaccgtattttttatttttttcccctatttattttgtatttacataatttcagctacacagcccgcgataatcgtgcgaataccgtggttatcgcggtaaaccatgcgattatcgtggtgaaaccgcgaaaccaccgagttttgaattcgaatttttggatgtgatttttgtgtgattttagacgattatcacgcgattatcgtgtttatcgcgctaccgcagggtggtggttatctcggcccaaacgataaggtaaaccctgatacaaggtctatcagttttaaatagacttcaatactgaactttgacagttattttctttcaccatgtttcatcaatagtacaaaattaacatgataagaaagcatttatataaatataaatccaatggtatcacttgtgtcactaaacatattgtattgcctttttttttccaaatacataacacaccttctatttgattcaacaaatgaagtagccttgaaaagggcaggggaggtccttaactagtaaactctgacattgtgtgcaccacgatatcacattagagcacccttggtttcaatctgtaaatattaactgtaaatagatttgcataatttcactgtcctacaatatggaaagggaaagcataaatcttaaagcacaatttatgcacatggaagtacctaggttattctgttgatcatttgctacccaaaatttcagaaaagagggtaaattagctcaacagaagcaattgtgcatgagatacgcaaaggaatgtagtaccattcctatgtggtcacctaattagttaagtactcacaatgaaaagacaacaacttcatcatatgacggagataatttaagtagcaaatccagcccaacaaataatgaaccgtattttagagagaaatagaattttaaaacaaaaacgaaaatatcttgtaaaaacagcaatatcaaatcctttatcaatacatttatacactgtccaaagtggtaaacaaacatattttcttcataatccagaacaatatgaaacccaaagcgaagaaaaagaatgcaccatatgagaagtaaacaaacatctttaccaagaaaaaaaagtccattttacttccccgaactatttcgcctgaccacttagccccctaaacaatttttcagctcattaaaatggacctttttctttcaatgaaatgaacttttttctttcaacaaaggctgatcttacaatataacccatatgatcgatttaggaattcaaggtttatcaccgtggttacatgttaacccattcacccattcactttactaggattttcaacaaaggttgatcttacaatataacctatttgattgatttaggagttcaaggtttatcaccatgattgcatgtggcttactgctacctgatggtgcttgtgcattctatgaaagtaaaaactaaataccaagagggaaggagcaaggtaccatactcaattcgaatgactgagatttaattccttgggtagatatcttgaaaagatggagggaaagaattactgatgagcagcctgaaacatgagccaagcgatatctaatagaaaataatagcaaataacaaaacaagtaaatgttgcacgctggaacagaaaatgacctggaaagagatgcatttgtccctagataacatactactagctccgtcccaaaatacttgttgctttattatcaaaagtactttaagtatcacttatccttttttatatttgcactaatttttcaaataagaggaatggtcaaacgttacaagaaaaaagacaaagtgaccactaatttaggacggaggtagtactagataaatccaatttaagtacacccatagacaaaggcatgcataattcgtcaatgataagattacctattaagaaagaccagaaaaatgtaactagaaagtgcagaagattgaaagaaccataaagggtttacaagctaatacaacatagttactgagtagataatgtggattgtggagaacaaatagcagatttcacaagtcgacaacaaacaccctgtatagctattatttatagactcccacaccatgaataacaaagggtcctctcagcaacatattcaccatacacaaagcaaactcatcaaaagtcaacaaattactggggaactttctattacgattaaacagcctatgccgatattcacatttctttatatgaaaaggcaaacgtaggtaacataccaaacagtaccatgcatagagaagaactgtgatgattaactaggtcataaccctgccatcttagtatcttggacccatactacaagaacgggacagacgtaaattccccatctcacgttcacttccaaccgtttctccacctgaagaagctgagatgtactgcttcctgcaggcaggacagcgcccatctgcctcaagaattctcttgtggcagaacagacacagatgaaaaccgcaggggcaagggaggaagcttgaatctgttggatcaaggtcctcgtagcatatagggcaggatgtcggctttgaggggactcccttttgtgcagatcctatccccattgccacccaacagttacccatgctagctggaaagctgacttgtttggagaggctgggtaaactctgtggacggaatgcatcatctgggctccaagctcttgtactactcttgattggttcttgccttgttgctgcattagcgggcactggacaagatgcaggtacaactggtggatctgccggcactggatcctggtgattatggttgtcatccactgagagtgcatcggcaacagcttcccaatcatccaaaactccatcatcatcattctcggggctaccaccagtgtcatcgtcagaatcagtcacactccgagagctggaccaagcactgctgccgctgctgaagctacggccaccaccattgcccgagcagtgcttctgctgcaagcagccaataggagggttgtaggagacagggctgtgcaacggagactcatgatcactgctaccaacatcctggctagcgccaactgaatcctccttgaaatcctctggatccccttccctcgtccgaatctctgcacgccggcgagggagtggagggtgcggggatgcgaggatcggcgacccggagttggctcctgccgctgctccaggggataccacagccttcacctccttcccatccttcactagaccaatccaaacagaagatggatcagattctgagcaaatggccaaatgatcaactaatgattgaagctttctcaccccagatcccaaatcaagcaaaacacatcaaaatgggaccaaaagaccgaaacaaagattccaactttctcacccgacagcgcagaattcatcaaaagcatcgcctaaaaacccatcaaagcaaaaaaagaatagctctctttaggcagactccaccaatacaatgaaccgaatttgagggcaaattgaaacccaagatcccaatttccccccccccccccccccacccagatcacctgggccgacccaacaacatccaaaatcaaacatgattgggaaaacaaaaaaaaaaaacagattaggagcgcgagagatcagaccctgcaaaagccactgctcccgccgcacgtcgagcttgctctgcttcagcttcgccgaccgattcccctgcaaaaacagaaacacccaccaccaccaccaccacccaaaaaaaaaaatccccacggatcagcacccccatctcatccaatcgaaaacatccgaactcgaatcggagagaaccccccacccttatccgcttcttcttcgcgtcgcgcgcggtcgacggtgaggacgcgtcgtgggccatggcgtcgtatcccatcccctccccttcccttctcccttctttacacactgccgcagcacacacgcgctcgcaacctcgccgccgctggagccggaggaggaggaagaggaggaaggagaggaggagtaaaccctagcgcgagccgagacgaggcggaggaggaaggaggagcggaagctgcagctgatgaggataatacggcgtggagaaaaacgagtcgatgagctgacgcaaaaataaataataataataataaataataattaaaacaaaacgttttctgcttccgcacgacgagctggacgacgacgacggcggcggcaacgggagaaatgacggaaatgccctcctccgccgcggcggagcgcgaagcggtgtggggatgcatctgggccgtcggattgatacggtcggtgccaatacgtgtggccgggcagcatgccacgtcgtcagcattagtaagtgagagggaggatggatgtgctggggagaaaatagaagtgtttttgttttgtcccgtttagattctaacttttttttttcaaactttcaacttttccatcacatcaaaattttctacatacataaactttcaacttttttgtcacatcgttctaatttctttaaacttctaattttgatgtgaacaacacaatccttgttgaaggaaaaagattggaagtggttgcgtattctgtaggattttctatcacacttttcttttcaagagttgcagggttgacctacaggagatatgattagagtatttggtagtacgtcgaatgagttttatgcgtctcgaaatttaagtaaccattcaatgcaatgtcctaacataaaaaaaagggtgaatagccaaagtggttctccaagtttcatctgagactcagtttagtccttgatgtttcaatatatccatattagtccttcaagttttcactttagttcaaacttatccttgaaccaacaactctcttcataaatgacacttatacccctcatcattcacatgtataagagagaaattgcatgcttgaatttttttatagataatgcatagtatattatgtaaaacgaaaaaaattatgtactagcaagtgtatacaatagcaattgcttaagtttcatgtgcatatgttgaaataatgggaagtacatctgtaatattgtttattcaggttggctttctcttttctattctagtatatagatgtatacaaattaagggcaaaaatgacattttctaatagaaatattgactagaaatagccatatggcatattaagtggacccaaggatgatttcaaaccaaaacaaatatttgaaggatctatgtggacaaaatgaaacgtgaaggaccaaattgagccttcgctgaaacttgagggactaaattagctattcacccaaaaaaaacttaaaatatgccggacggatatgatttagtagtgcatgcgtaactgtgtagatataaatgaagatgcaatcctcactgacttatacaacgatagtggtatattcttaaaaaaaataaaagaagcattttcaatcctagcaaaaagaaaacgaaatttaagtagttattatagtgttattacattcttttataaactacattctgatacctatagcttctctaagaatcactctaaaactacattcttttataaacaaatgttttatggtctatttacgggagtttctgatacctatagcttctctaagaattacaaacttccataaacaaatccatttttctttgttgtacaaagaaaatgaacaagaagtcacaagctagttgcttaagttttaatttttttttcaccatctagattctcacgaggtgcttctcgtaatataaaactctacaaacaagcccttaagtaaaactacactcttctatagatctttgagagagagagagagtgtgtgtaattttatcacaatcaaatacatacattttccatgtacacttattatactatattcctcgtcataactatttggcgtgcatttagaattcacctaagattttataattaaccattaattttatattaaataagttataaatctaatacatttatgatattatgatagtacttttcaaaataattgtgcacatattgtttttatttttaaattaattatcaagaagttatcgaggataaatgtcctaaaagtttaaacatgccttgtcataaatgtactaaacaaagttttgaatctacaatttacaaccaactaaacctacaactcaacgtacaaacatgtcacgtcatcatccactagctataattgcatatcaaactcacaagcatgtaaaatcatcgacaatttattgagttctacaggtcatacatgtatatctaatcatcacccctcatatcattttcacaatatttcaatatatctattcattatttttacaatacttaacaaatatttatcaacatattctacatcaaagtgcgaggtactatttagtttgtttcataattagagcatgtttggtagagctcgtctggagtggagttgtggagctgcctaaatctaactccatctctctagtttattttgtgagagtgctccacctagctccgctcgtttaggtggagctaaaactgtttagttggactctaactccaaaaaggatggagctggagttgaagctatgccaaacaaaaatactaataaaaactgatcgtatttaacaaaccgatctccgacagttaaaaaaaagcgagctgttttagtgaaaaccgatcagttttattaacattgacaatgtgttttcatagaagtagttctgaaagcaaaattgaaagctctgggaaatttacaacacttttttttttcaaaatatcttcacttggcaaacattacctcagctcatctatctccattaacatttttcaggagattgaagctagcatcatatcatatcatacactgcactctgcacgaaaactgctacgcacactacctcaaaaacccaaacctctatactacgattgcacactaacattcgtacacactacacgtctacacatccatcccttctacggcctccttgaccacgacgaagtcgtccatctccttctcctcgccggcgccgccgtccttggcagcggcgggcgccaccaccacggcggccgtgccggcgggctgcttgtactcgtggcgcctcgcgaacacgaggaacacggcgaagttggccaccccgagcacggccagcatccagtagaagaggtccagcctgccggcgtcgaggtcgttccgtatccacgccccccgcgtggcggcgtcgacggcgaagacgaggaagctgctgaggaagaatcccatggacagcgtcaccaggaagagccccgtgctcatcgacttcatccgctccggcgcctcgcggatgaagaactccagctgcccgacgtacgcgaacgcctcgccggcgcccaccaggaagaactgcggcaccagccagaacgcgctgatcatgccgccgccgccgccgtcgttggcggcgtcgcgccgcttcttctcgacgagcgcggaggtggccatggcgacggtggcgaggacgaggcccgcgccgacgcgctggagcgaggtgaggccctgggggcggcgggtgaggcggcgggccgccggcacgaggacgcgctcgttgagggaggtgaagaggaggatggagaggaagaggaagacggagagggagcccgccgggatggcgaacccgccgggggcggcgcccgggcggaggtggcggtccatgcgggtggcctgctcgacggagaaggtggtcatctgggagtacaccgtccagaagaggatgcaggtcgaccagatgggcagcagcttcaccaccatcttcacctcctccacctccgtcaccgtcgccgccggcgccgccgatgtctggttcgtcttcgccggcgacgctgccaggtccgcctccatgatggccgccctgtccaggcacctgcatggcaaaaacccagtcagcaacgtatgtacggatccaagtatctaacaagctaggtagcaagtaaaaaaaaattgacacgtgtgtacatatatatacgacagagatcatcagatgattttcagttgtgttcgtgttagcaaaacgcagatgccagatggatgtgaataagtgattttcagatggagatttaacaatagaatcgttcttttgataagtgtctctctcttcttcgatggtggccggattttatccattatacaaaaaaagatggatgtgaatgattgggcatcttttgtgatcaaaatgaagcgaattctttaaggatctgaacttctctagcaatgcacgtataggccggccggtgcaccaatctgactgtttcagatatgcatctcgagcctcagttaatgcaatttgtgttgtgtacacaacacatccctgtgtcaccaccccacatatgctcgcgggcacaatgtcaaatttattctttttatttgcatatatgaaatttggtttacatgcttattaagtgaatatatcatactaatacatcttgtattttttttatatatttttacttttaggtgacggaaataaacgacaaaaaatccacctctagactactgaattcacggctcgtcactctacttgtgatctgcttcgtccatcagccggccgcccaatttggtgaatgttatctctaattaattgggtgtctcacatactaattgggtgttctaatcaattcgatgtctcactcactttgaccactcattcatttcatctagtaccatgcatgatttgctcttgcgtgctgtgttagcaagagggcgaactgagttgtcgtcctcagcttcttctctatagctcgtgtccatctcagccttgacagtgacctaaccggtgaagccaattaagtaccgtgctaataatagattatagacttgtgatcgatagctagattaaccctcatgcctaggtagaagtacatactactagctagcaagctctaccagttcacatcctattggcaccagttgatactaaccatggaaaggctatgtggctagagctgaaaaaacggagtgttttgaaagctcagttctgccatgtattttcaaacgatacgatcgattgatagaatttaaatagcaagcaaatgttttggcaaaatcagcagccacaagaatccaatcctgaaatctgaaccctgatctcctatatgcaccggttgacagcagcagtattgtactatcagcagagcacatcgtgtcacgtaaactctgaagaaataacattcatccatgtctacttagcaatataatgcattttgcatcccaaccaaaacatgtttcttccagctatatattaatcaatcaacaaagctaggacagcaacgagttaactactaacggatgatgcctgatgacaaccacgagtgtatgatctgaagctaattttctatagtcgaggagatcatatatctaactgaactttgtatattattaggagaaaagagaaccacgtggcgattatacattctacggtttgagactgaggtggtattcttttcttctgaagatgaatattaagttttttttacgtaaaacgagatgatattaacatataattgattttgagttttaattatttcaaatttaaaaaataaattaatatgatattttaaagcaactttcatatagaaagttttcacacagaacacaccatttagcagtttgaaaaacgtgtcacgaaaatattaatctccattcaactcttgtgggagaaaagagcgggatctcccctcatgaaagattgtgcgttgattacctgaggcggtcggtgtaggcaaccttggatgtgtggtagccgtggagctcgccggcgtcggcggggagcggcaggcggcgcttcctccacgccgttgccagcacccgcccgatcacggtgagcgggctcccctcggggcggcggtaccggtacttgggcgtgccggcgacgaggacggcgacggcgaggaccatggcgacggcggagacgccgtagccccagccccggccgacgttgtcctggacgtacaccagcacggtgaccgcgaagagggagccgaggctgatgcagaagtagaagcggttgaagaagaacaccatggcgcgctcctcccgcgggtcgccgccgtcgaactggtcggagccgaacccggacacgttcgccttgagcccccccgcgcccgccgcgaccgtgtacagcgccgcgtacagcatcgccagctgccccccgcgcgccggctcgcaccgcaggtgcgccccggcgccgcgcgcgtccgcgcacggcggcggccgcatccccggcaccatcgtgtccaccgtcagcaagctcaccccctgcatggcagcagatcgtagtgagattcctgcaccgcgcgaggatgatcgaagatgtgttgttctgtgtgtgcgagagcgagagcgtacggtggcggcgatggtggcggagatggcgatggtgaggtagcggccgagcttggcgtcggcgaggaagccgccgacgagggcgaggaggttgagggtgcccatgaagttggtgacgatgttggcggacttggcgttggagaggtgcaggtcgccgacgaggtacgtcaccaggttcatcgagatgcccatcacgcacacccgctccgccagctccgtccctgcaaattaacaaccaccgccgccgccatggcatgtcatctcgagctcaaatcaaccaaactttttcccacgatcgaactcgcgagtcgcgaccagcagtgaagacgacgcgtacctaggataagcccggcgccgagccatcccccggtcttggacttgtccaccgggttaccccggtagtcgacaaccatgccgtcgtcggcgccaccaccatgacctcctccggcagcaacctgcacaaacatacatccagcttaacaactcaatcaccaaaccaaaccaccaatgaaaacatgcatgcactgtcggtgtgtgcgtggtggtatatattttttttctagttacggctttataggcttacaggattgtaatcttgttatttttttcctgctctaatagaacttcgtataaaaaaaatacatgcatcctgctgcatgcacagatacagcacaagcaagcattgtttatgttaccattttcttctgctgctgagatgcactgtctaccgctgctgcaagcagatgagaagagaaggcagcaggcacaggatagtgaggagagaaaacgtttgtgcagtgaggatgaggaggccggcctgatcgatcggaggatttatagagtggaggcgtgcagaggtggagaggttttgatcgcgagattttctctcgcaacttttttccttttccgcttgttggtttcgggtaaggtgaggtggacgagatgattgctgcacgtacgtacgtacgtacgcacgctgcctgcccccgcctttggcgcggaaaggacaagtaggtgatgacctgctggcgagttgtgtcgtgtggagggtggcctggcaaaatctctgggtgagggggattttgggccacggattgcagggctgggatcctctgcatgtgcggccccggtgaattgaatggaggtgtttggtttccgtgtcttttattatctacagtaaattggattcatgtcattgcaaatatacttatttagatgaatactttataactcatctatttgtagccatgtcactatcatcacgtttttcatccatctatttttttttccgttttcttctgtcttcttcccttgagcgatggcgatgaggtggcaacacggagaagaagcacagtggtgttgtccttgccgcacgacttgcatgaccaccaggccgtggtggtggtgtcgtcattgggtactgcagcggcgtccgccttcatctcgaaacagtaggactgggcattgtcgggcacggcggtgggcagtgttgagctcaacttccttctcaccacaaccgtcgcgctgttgacgccacgtgcaccaacgcctggcactactgcttccaggcctgctctacaccaccacgtcgacctctgtattcgctccaccaagtggctcaccgacgtagcttctccagcctggcgtgcatccactcgttctccatccgcaccaccgcgtcaatctctgctctttgcaggcacaactccgacactagtgcatctcccaccgctgtagctgaggcggccgaccaccctactcatcgacgtcatcgtcgactccaccagtgcagccgacacaaccagcttcatcatcctcgagatcgatagcagcaccgcagacgataatgctattgttatagcaaccacctgctgccaagaacattgctcaaggaaaaaggacgggagaaagaaggaacaaaacagaaaagaaaaagaaaagatggatggaaaacgtgacggccatgatactattttttttataaaattttatgaaagggtatgtagcctagtggttacaagagcatttaacggtatcgcactttcagtggtaggcgatgtatacatcgacagacgagtcttgttaatgaattactgatgttggactgtttagctaggtgaattaatgcacagaaacagcatctattttgcttaagctggcttgtttacaaaaaccgagattaggagacggcgtcgcaactcggcacagccaccgcggggactccgtcgtcgccgtccgtcctacgtgtgcgcgcgcggcaggtgccgccccgcccagcggcccacacgtgcgccagccgcgtacggcaccccggccttcaccacccacgtgccagcctcgggttggccgagagaggcgccggacgacgtggacaggtccgtcctccgtcaagcagggagccgagccgaggactgcggagatggacagcccgtctgctgtatgtacgcgcgcgcaggcaggtccatgtggctgtggcctgtggcacgctgaaaatctcgccggtgaacgcgagcagccaaacagcccaaccaagtaaccaaactgcatgcggtgggtggcatatggctagggtgcgcagaaaaagatcgaaccaaaagactgaaccgaaaagaccgagaccgagaaattcggtcctaggtagtgaaagaccgaattttgttcggtcaattcggttagtctcatcggataaccaatagaccgaaaagaccaaattataaaaaaaagtctaaatgcaacctacaatctactatgtttaataggattaaactctaattttcacatccctacttcttctaggcatgcagcttaataggagtctttactcataagtgcttacgaatttttttaaagatttttatgttaaaaatttccattatttctttgcatatatgaaaatattgttgaatttcggtcaggactgagaccgaatttgtcggttctgacatttttgcgctgaaattcggtcttcactttttaaagaccgaagactgagaccgaaattttcagttagaccgaatgcccacccctgcatatggcacgcaggcgcagcgttctttttgtcgcgtgttgcatggctgaaatgtttttttttttctcatctgcgtggtgtgttttttttcctcttcggcgtagggttgaaaagtcaccggcacgcaggcatgtggaggcagagccgtataagcgtacaaccacatggtattttaatttctttcgaaaacgagccaccacatgatcttttgctcaaaaccggcaggggctctgctccgccgctgcgacgtgcgtgcgtatgccatcttcttttgtctcttctccttttgtggccgtgcacgcatcggcgcgcgtctctgtctccgtggcgagaacgcgtcttctgaaccgcacgatcgccggctaattccacgccgtgtactggtgtgtaactactcctacgtggtaatgcatgatgcaaactacagaacttcatttgttccaaaataaataaatttaatataaaatatgatacattctaataccataaattcagcatctgtaatactataccaatcttaatatcttatactccctccgtattttaatgtataacgtcgttgactttttgacaaacgtttgacatttcgtcttatttaaaaaatttatgtaattataatttattttattgtgacttgatttatcatcaaatgttctttaaacatgacataagtatttttatatttgtataaaatttttaaataagacgagtggtcaaacgttggttaaaaagtcaacggcgtcatacattaaaatatggaggcagtattaaatttgtttactttaatatgacttaatatagaagaaaaaactccactaggcatgattatgccatgtgtcacttgatgctgcctagtcgtgaccatttttgaaaggatccatttgtcgtattgaagtaggagcaactgaggaaggcacaacggcagattttttctgtctccttttttgctgatatttttgttctcataagcagcatatgcgagctttatgattaggcccggtcgattcacgataagtagataagaacacacaccaaaacatttatcttcattttattacaaagagacggcacagcagcacaacgcacaaagagatgaaacgatagctcgtggaacacttgtaagcaaaccgatcgaccgatcatcgatcgttagcactgcagcacggtcactcgtttataccttccaacatctcttgtcccaatctttatcacgatatctttgttttatgctttcccctttgggtcatcctaaaagaagaaaatatagatatggcctaatcatgatatgttcttgaatattctcaaaatggacacattaccccatctagaattctagatgatcaggtcggcacatgcctatggattaaagcatatgctttgattttggaatatgatatgcatggatgcttcaattaaccagcctatcacaggggtgaacagtagtggacgataaaaatgaaaaaacttcaccccagaacaaatagcaaagaaattccacttgattatttgactcacacaacctgattgaccgtccggatgtttattagttattactttctccgttctagaatataaaaaattttagagttggacacgaataaagtaggtagagttaaatgaaaaaagttgtgatggttgagaaatggatgtagatgaaaaaagtgaatagtggagggttatgattggttgggaagagaatattggtagagaagttattatattttaggataatttttaagtgttagaagttgttatattttgggacggagagagtacctctaatccttgattcttttaaccacgactacgatttcacaaaatgtcacacctaatgacctatcattagtttagctctgggttctttttttttttcttttcataaatattacaacacgacatcccatccaaacgatagctcatatatccttttttccctagctccctcttcctctcccactccctcctgcctttccccacttcctcctgccttttctcctcttatgcagggaggccgtcgaggaggacatcacctaatgtgggctcctcctcccgggtgcgttgtcgaaggtgattgaagggagaggccagtgaaagctactagatttggagcttggtcagcaacaatgtagtggtgatgacatcatgctccttgctagtattgtgtgcgggtacatcatgtagcgcagtagtgttaatgtcaaaatttgataagcccgaaatcatcattagcttagagtcaatattagctttagagtacaggaatcagccgatggaagtcgtcaagtcaccagtagttgtgttcttgatggagtcggatcaattaaaagaagcttatctagaagagtccgagttcaaggataatgcggcatggcaagttatctattaattaggaatagtttattagttttcttttatctttaagaaagtgtgtttagtgtctgataaggactttatgttttccttttatctttgggaaaatttatttcttgtcctacaaggaatattatctccccatgggtataaatatgtacacccggggtcattgtaatatatctctccatcaatacaactgctctcggcgcatcgccaccttctttaccgaggtttttacttatcatccgacggaacttggcacctgacgcggggctgcattggtttgcgatctccggcgaaggggtaagtcctacgttctgccggccctggtgaatctattgactacattagtgttgttcaaggctgcatcgcttcgatctcttggatcgctctggtttggttgatatatttgcttacctgatatctcaattctatctctaattgcattgtgtttagagacgcatcggtttagttggaactgtcttggttaggtctgatcttctgtcttagccgatatatctctacaatcacaatgctgttgtaaatagatttgttatatccatcacattagacagatctatcggctcatcgagtattagattatcatatacaatctcgtgatgcatcggttaggttcgacctactagattgttgttgataatataaatcttgttaagctgataggttcatgctaatgttttatcggggtgctagccgataagttatctggacgttgcatcggcttgtaaggattgcatgtatatataagttggatttagccgatcgcaacaaaggttttactgtttaatctaatcttgtggattttatgacatcagacatccagccgatgtatgctttaacctttggatcagtgcttattctactatatcatattgttagctgattggtttctactggattatattatcatcagccgattgcctttatatcattatctacattggacatatagccgatctctcaaaaccctatcgctatcggctggcatcggctatcagctggaattactccatcggcttgttagccgatcggctatttgattttcaatttatatcttgtcatttacagggtcaaactggctggcacgcccgcatctcatcaacctttggtcctgcactggagctaagcagatctcccaggccagtgtgtgtttttcgcgtcaacaagtagaggtcgggttgctcctttgtaggaagtaccaagtctaccagtggtggcggtggcggcaacagtgacaagagggcgaaagagagataagggcaactacacacgtcggttgtgctggtagttgccactgtcctcatcgtcggcaggttgcagttgtcgcttgcggggaggacggggaatgccaaattggcatggaggacaacagggaaggcgatgatgaacgacgacggcgaatgggaaggccatggcaagagatatgtaggagagagggggacggggagaaatccgttgtgggacccacaaatggttagccaaaatagcatggggctagtgcataagagagtttggctagtcgaatggcttatccgttcgattggtatggctgttaaagttgatcttaattgacatataaaatcgacccgccagatttttgtgggtgagctgaacccgaatatcagtggaatattaccttttgagccaacccatcccacctagtcataaccaaaaccaaacatctataaaaatataggtttgacccaacccgaccccttcaaccaaatacatgcaaacatatctatgtaaaattgttaatagtactttgggctccgaagaaatgaatggtgtaactattttttttttttacgaaagagtaactaaaaagttattagtaatacatcgaacaagagacatgctctaaattaacctagaaactaaggctgtgtttagttcagcgtaaagtttggattttagttgaaattagaaatgatatgactgaaaaattatgtgtgtgacaggttaatgtgatggaaaatgactgaagttttggatctaaacacaacctaatttaaaacctgctaaaacttgcgagaagcaaacagagtccaaacctgccccaactgtcagactgtcagtccaacacccccattcccgctcctccggtgatctcccagatccaccaccgcgacggcagcgtcggcgcctaccgcgcaacgcaagcaatggccggccgcgcccgcccgcagccgcagccgcagccgcactcgccgtcggcctccacgcggcggcgcgagcggtggctggtcgtcctcggcgtcgccctccacgccgtctacatgctcagcatcttcgacatctacttcaagtcccccatcgtccacggcatggcccccgagccgccccgcttctccgctccccccgccaagcgcctcgtcctcctcgtcggtgcgtcccccctctactcatccccgacgattgtgaccccccgatttggttgcgatgtttgattttggtgaggattttttggttgcgtgcgtgcagcggacgggctcagggcggacaagttcttcgagccggacgagcgggggaggtacagggcgccgtttctgcgcggggtgatcgaggagaagggcaggtggggggtcagccacgcgcggccgccaacggagtccaggccaggccacgtcgccatcatcgccggcttctatgaagaccccagtgctgtcaccaaaggtgtgccatcccatctcagctctaattctggccatttcttcatgttcaatgcaaactaggatgtcagttggtaagaattcaaatgtaggggttattactagcttgttcatgtcatagctggtagacacagatatggtggtccaaactccaaactatttaggaaaaccatcaaacatggtatcttcggtgctagctagactgctacagtaagttcagtaggactagaatgcaatgcggtggcatggtactcagagaagtttcagctctagttctagcgtgccgctactggttatttttcatgtttgatgcaactaggatgtcagtcggtaagaattcaaatatatgggttactacctagttcatatcataaatggtatacatagattatggtggtccaaaccatagaggaaaaaacaccaaagatggtatctgcagtgctagctagactgctagagcaagttcagtaggactagaatgcagtccggtggcatggtgctcagagtagccgaaacctttaattggctctgatttagcgaatccttgttagtagctatgcttcttctagaaaagttaaatataatttgcttataggttaacttctattttgcagtattgtacttagcggctgattttcttagcctttttctgtggtgttcagagaaaaaggctaagaaaataatcattcccttaccagttacatattcattttttctttgaatttctaaatattctggtaaagttcaattaaacttgctgtaactgaactttaccataatatttacaaccattcccgctgatacctgtggtcagtgtacaactatagtattagtgctactagttttccgctgacatggcatgtcaaaactcatgtactggtatttgttcagttgtagaaactgtgagcattgttctacccattgatatcctaggttatcttgtgctggctgtggcctgtgggctactttacttgagatttattaaggacctattttgtgttgaaaatttgggatacacggtccgttcagacataatttagaaattgatgatatgttttaagagaatcatgttttaattccatatcaaatgtctgtaatgttcacaaaattttcttattacttttttgcaggatggaaggccaatcctgttgagtttgattctgtattcaatcaaagtagacacattatctcgtttggcagtccagatattgttcccatattctgcagcagcctacctcacagtacctggggtacttatccccatgaatatgaagactttgcgacaggtcagatttaatgcagtacatttaggttgctgaattatatatttttttatttccattcggtttttgtgatttccagagaatcatcttctgtttttattgacataattagaaattttttgtacctactcattacttgtaagttgtaacacacaccttttcggagtattccaatgactctaaaagtttatcggcagacttaatgatgataatgtgtaataaatggaaaaagggctctatagctcttctcttagttttggttagagttttttttttaaaaaaaatgaaaactcacaactattattgatgaatccagcaagcttttgtacaagtcatgggtccaaacttgtaaaaattcacaagaagggatttacacgtccaccagaaaaataacaagggatttacctgtccacaagaaaaataaaagtatttttaccaaacatcgcagagtatgaagcatcaaggctctaccttttgaatttggtttgctttggaaccttgtgtttacttgttctgagaccttgattgcagatgcatcattcctggatcattggtcatttgaccagtttcaaggtcttctcaacaggtcttttgaggatgctaaattgagacaattgctcctacaggataaattggtcatatttctgcacttactgggttgtgatactaacggccatgcacatcgaccctattcaaacatctatcttaacaacgttaaggttgtagatcaaatagctgaaagtatgtacaatctcatggaaagctacttcaacgataaccagactgcttacgtgtttacagcggatcatggaatgagtgacaaaggtacgcatactcacaatggtttcatcaattaatttcaatgacccagccttatatggtttgacaattcatgacatgagatctaaatactttctaatgcacttatttttgttgaactttccctgagacagcctcatcagaatggtgactgtcttttacctgctactaatagcaatgccttattcttttcatattaggttacaccatgttatacattatttatgatgtcaatataactcaaagttctactgataggaagccatggagatggacacccatcaaacactgatactcctcttgtagcgtggggggctggaattagaagcccaaagttcttggcctatacagacaaacctgatgatggctttcggtttgttgatgaccacaaacatgatatgcccacaccacaggattgggccctcgaaggatttgaaagagtggatgttaaccaggctgatatatctcctctaatggtttaaaattttccctaggcaaacatattatcatttttccttcagcataattgcttttatcctcaattgtttacaaaaactgcaggctacacttgtgggtctgccatgcccgctgaattctgttggaagcttacctacgcattatttgaaattaagcaaggtcagataataaacactgaaatattatgaaaaaaaatatgtttatgcttccgttgttttctgctcttttggattttctgtttatttccccattatttctgttcaggctgacgaagttgaagcggttctagccaacacaaagcaaattcttaatcagtttcttcgaaagtcacgtatcctttcagaacatgatttaaattttgcttactccaattgtctaaggtccttggatattcttttcttgatggtctcctgctgtcctgctgaagtgagttattgatgagactatataattattaatctgctgttgaagcccacagtttactagctgtgagcctgtgaatatcatgtcaattactttctatatttttatgcaacattatactgcctccgaaatggatatggtggatcatattcatactcgtgaacatgttttccctaacctgtctcagagatgaaacaatcaagttcactctacttcaagccttttaagccactggcaaactattctttagtccttgatcaaattgaagatcttatatctgcaaaggactatgaaaatgccatgaagcattctgaagaactccgaagtatggctcttgctggtctccattattttcaaacatatgactggttcatgttgatgacaacaattacccttggatatattggatggatggtgaacctcattctacatgtgctacagtcttatacatcatttcctgctaatcttcaaaaaaggactcaagtgtatgctaagaacacctctgtgaaagtaagatagccaacctacctgaccttcagttcttcacttaatgagtttatgtctaaaattgatgtgttatgcatgtatttttatgttgctatcttttccagattactcaatctggagtgtagtcaacattttttttccaacttcagtatgtttgtttctatccatttttccaagaaccttttctttaaaaaatatatcagaatttaggttctgttaaacttcttattgtatttaagaggtttgctgctgtctagagctacaggcatttggtagaactctgtgcacagtataggcttgatactagttcattgttgtgaactgttcaaagttgctgttcgatattgcagaattttattggtgtgtgtttcttattaatcctgatgtgtttttcttacactattttggtctatctcatctctcctggttgcaggtatacatagttggatgcttcattatgggtttttcatccattatactacttttagagaaatctccacttctttatcatgcttatttatttatgacaatattcctttggacaagaattgttcaaaattttgaattcatcaaggcagtatggagagaattatctaatatgccattcaagtacaccatgaatcttctgaacatttcagtcattgcgctgttcatattggagtttctggtatgtaccttttgttattggcacccgaagcgtttgaggactacctagatttggcatgaatttcgatgctttctgtgcaggttatgagcttctttgataggaagctttatacttggtgctttttgatccttgggatacttgcttcatcttgtgttgcaatatttatacaagctagctctgcacttgcagtctatgtgtggctttcatgctggttcctatctttattcacattgatgccagctgaaattccagaaaacaacaacttggtgtatgcttctttggccgacaaccccccacccccttccttttttttttccattttgtcaatattagttgcgtgttcattctgtcatataaaattctcttttctagagttaatgcagctggtagcccttattttttttataattattacgagcgtttggttgaaactttggtctgatgaatttttatatgcagaatttttagtggggccttgataatactgactgcaatggcatcgagatggatggccacaaataataacaacttttggctatatcttactcgagcaaataaacgggatcctcaattctctaagctattttttgttcaggtgaaaaatgcaggcaattctttcttgatgttggtatttgttttgtggaagtaatattttggaacaatgttgactgctgttacaatgctttaggttgtatttgttgcgatatcttctataatggtgtggatatcgacctcgcaccggtctcagaacaaacagctgcacccattgcaccagatgatcaactggttaatagctggtaagtgatgatcaactgcaccctctcatctctgctgctaatttctccaatgtttccctggttgacttgtccatgtcccttttcagtttttcagggccatatctgatatgttaacttacaagtgaaaatggctctttaacagataatcttctctagtagttcaatttcctaacatgcgtgcacattgcgccaagcttgaatatggtttgttcagagcattgacaactataaatattccctcagattacatagcattgttgtaacagaagtacctctgattccaaactaagccgttctagatttatcaattctttcccaaatataagacatccaagaacctcaaggcagttttcactcctttttttccccttctttgccctagctaaataatcgttattattctcatcaataaacgatacaccttttccaatgtggtataaatggaaggcaacagtcatttaatttcttaatcttatgcacatgtcttggaattaaaagggagcgcaaacttatttatgcatcaacgatccatttaatcaggataattatatcacagaattgagaacttccccagacgatgttcagtaaccaccttctttcagggtaacagcaggggagagtcataccaatatacacggtacacagaaagaagcaaaacttaatttatcccaacctattggaagttgccgtgaccttagtcagagtcattttatcttctaaaaagtatatatcagttaacaaagattttttcatctaaataaagttatctggcagcttaaatatgaattgatttgtctgaaatcacaggccaactttactctttagttaatgttatggcctggtctattgctcttgctaaaattctaagagttttggttgtactgattttgtgctttaactgattatgttttgacaggttttgctatggtgctaccacttttttcaccatcaagtgttctatctcgccttacatctatcttcttgggatttgctcctccatttctattgctctctattgggtatgctgttaacttctcttatagtgtccacatatatcaagttctggttgccgtaatgttcatatattcatatatcatcaaatcttgacatctgcagctatgaagcggttttctatagtgcttttgcaatggtacttatgggatggatatttgtggaatctgccaacttgtattgctcagaacaaaatggttctgcacgccgtagtagcattgtggagggctcaattttcggctatgatgaaagatgcttacaactatctgatctacgaatccctctgttatttgtaagatgacattctctttcccttgttatattgtgggttgctatgatttatgtaaaatactcaatacattctgtatcttaccgcctttgcagacgatcttatttaatgttgcgttctttggaactgggaattttgcgagtattgcaagctttgaaatttcatctgtgtaccggttcattacaatatttagtgtaagtgtttgtgtcttatgatttcctctttctctataatattaggttttcttttctattattctattactgatcgtctttcatcctctttccttggcagccgttcctgatggcagcacttcttatcttcaaattgttcattccatttatgcttgtcatgtaagttttctcagtgtttactatgatattggaccatcctgcggtgcagtggcggaggcaagatttttgtcatgggtgtacaaaaccgattaaatactccataaaaacatgaattttttttagcaaaaaatatgaaaaagtagttctacatgtgatatgatgagctgaaaattgttgtttctagtgaaaagacaggtatttagccaaaattatattatgtatacccaacaaaaatatcatagttttgacttgaagtaaaggaacttgggtgtacatctgtacactcatgaccctatacagcctccggccctgttgcggtgaatggctgataaaataagttgatacgttgaacatattttgtacttctgtacatccgcttcacaaaatataacgttgaatcattttttgttgcaaaataggtgatgttttaagattcaaaaataagaaaagaatacatacttttagcgaaactaaaaaatgtatccacactctacgtttgtttgttttgtgcgcgataagctatctgaagaacaatatttagagtttggagaagattaattgttgtagcgacaacatatatatttgcctttattccttcatcatgcttttgttccgcagttcataatataccgtgtttgattttaccttcgttttgatatcctaatgggatttaatataagatgcgtaatcttcaaattagttattagtggactgtttaagattgttttagagttcctttttattccttactctgaactctgaagcataatagtaaaggaaaacataaacaaagatgagccaccagattagatgcaatttgtgattaagctgattcatatgttgcgacttattgcagatgtacatttagtgccataaccaaggttgtacgtataccacggctgggctgttatttccttgtaatactgctgtctgatgtaatgacgattcatttctttttcctggtatgtgttcttttcccctgtgtactttgaattatcctttatagtactttgtgctgtagctcttgcttgtacagaaaattgtaagccaaatgttcttcattttacccacaggttcgaaatacggggagttggatggaaattggcaatagcatcagccatttcggaatcgtgagtgcccaagtagtttttgtgttgctgcttttcgccctcacaaatatattcacaaaagatattgaggtctcatctcggcaactaagctcaaggaaagttatgtaattgttccatttgtttggagatcgacattatactttcagttttgttagagtttaacttttgggcgtggtttcgatttttctgcccaagttttgtaacttagctagtagatggtgaactttgtattagatggttccagttatcatcttctttacatgtaagagcattaggagcatagaaaattttctcgtcgagaatttagttcaggtttgtcttcatgggctcacggctaccgtagtcgtcaacacgcatttttttcctccgatatatttcacggctcgctcagtttgtaaacatgcagtagtgtagtgttggggaggcgagcagagattggcctcctgcattgattcaagatttccaaatggtaattgctgtaacttgagtgatttctaagcaagattagcactaccggttttgtatgtaaatgttgttgttttgtgatttcttgctctgctatcgctcgacaaataaaatgagtagttactactgatcgcatgtttgtaacttggcgtaatccttcacggcgagctatgcttttgcccccacgagaccacgaccagtggaagcatcactgcctcactggctcactgcatcagttgatcgcctccgtgcggtccgcccgttcgttatccgaatccacccaaacatcccgcgttatccagccacgcccccctcccgccccgccacgtcaccacccaccgccacgtggctcctctccactggctgagcggcgcccacgcgggataaggcatttctccctccccgaaatcctcaccttaataaccaagcatacacacccccgcgccgccaaaagccgccaccacccagctcaccgcatcacacgcagcagcggaagaagcagcagcagcagcagcagcagcaatggcgtcgctcaccatgatggcgtccctctccgccgtggcgccggggcgcgcggcggcggcggcgccgcggcgcggctcgctggcggtggcgagggcggccgccggcagggccgagtgccagcacgaggcgcaccactgcggcgaggggtgcgggtgcaggggcggcgccggcgccgagggccgccgcgccgtgatgttcgcggccgcggccgtcgcgctgtcggcgatcggtgccggcgccagcggcgccagcgccgcgttcgccgagtcggacgtgaagcgcgggacgcccgaggcgaagagaagtacgcgcagatctgcgtcaccatgcccaccgccaaggtctgccacaactgagctgtggttagagggaagaggggctatggatgcagtaaatacatgtacggttttttaatctcctgtctattaaaaattcgagctctgattagactgtcgccatggatggcatcgaaatcaagttgttgtaatatgatgatcattgcgaattcgaggtgaaaccgtacgttctcttgtttcgttcgttgcgttggcgttgcacatgcattcacgcatgtatcgtaggacatgcattggctgacgcattcacgcataaatcgcagtaaaaacagacattgtttgtcacatttatgccttgaaataagtctattttacctccctcatctcttgccccctgtttgaattgtctccctcaattgcaaaaccggatataacgtttcccccatcttacaaaactagttgaattgtctccctcaattacaaatccggatataacgtttcccccattttacaaaacttgtgtaaattaaccctttaggtaatttggaaagtagtttttctgacgtgtcgaacccacatgtcatagactctcctcttccctctctctctcttcctctctcttctctttttatctctctcgtcggccaccggtggaaggaggacgcgggagctcggggaggccgtggtggtggcatcccagctccgtcctcgttctctgagacgggggactcgacaaggtcgtggcggagcaggagctcgtggaagctgcggtggcaagagaggacgcacgagctcaaggaagggggagcggatcatcgatcgcgaggtcgcggccgccgcagacgaaccccgtgttcgcggcgttggcgccgctgctcgcgtcgaccacgccgagctcacactaccgtagcgtcgcctcctgtgcgagcggctcgtgcacgtgaagcgtcgcgccgaagcagacggcgccgacgccgtctccgccgccggagtccatgacgaccccgtcgctcttgttcgcgtctcgctcgaccaatgcgacgcacgcgcgctgggctgctcctcgatgcgctccgcctcaatcgaaaggggtcacgaaccttgcgatcctagctgcggccaatcgaaagggtgcgacgagaaatcccggtgactcctctcgcatggtctcgattacgacgaactgcggattattggcgagcaaagaactgaacccatggcaacaaatttggtcaagccaaacgagaaaaatcttttgctgctaatgggcaggggcggatccagaacaagatttaagggggactcatctccttcttccttcttcagtccccctactcttcattttcttcctattttttccctttcatctccacttctatcaatggtgatccagcggggtaggggggactcgagtccccctagcacccacgctgaatcctcccctgctaatgcggtaagattcctttcgagagaatccactcagcaccactgagtttttgttcttggcgagagcgagaagggggaagggacacaaaatattagaatgactgccatgtggagttgttaatttttatttttttctcacggacaggtatgggtcccatgagcaccacttaggataaaaccatttctgaaatcaccgaaagagacgatttacaccagattttaaagatgagaaaatattatatccgattttacagttgagggggccattcaacctgggcaagaagtaagggatgtcaaatagacttatttcttatgcctaacagggcctcaaggagcccatcgatcaagctctaagccttgtttgtattacataacatatatctcttctagattctactcgaaatgaatacgtactccctccgtttctaaaaaacaaacctaatacgagatgtacatctagtactataaatctagatagatttatagtattagaatgtatatcatattttatactagattttcttttatacgacggagagagtacaagttacacacttgaccattgtttggttgaggccttgagagaccatggcaacatttgccaatcttgtggccaccaactttgttgctactccctccacgtacaaatatatatacaacactattgacatggtctttaatatactactttaacaaataatatctataaaataaattattttaagaataaagagttacatatttaatagtaaaaatattcttacgaaattaatctatgtttccttttttttcaccgatagtaaaacttgaaaaatgtttaactctacactgttccaaaagtccttataactagacatagggagggaacgttcgataaaaaacaaatctagggccggatgtgacatattctagtacaatgaatctagacagatgtatatctagattcgtagtactagtatgtgtcacatccagtattatgttgttttttatgggacagagtgagtatgcaatatgcccaattgaacatcgctatcctagtttaggctttaatgagatttattgtagagggctaaatagttccactttctctgtccgaaaagtatgctactagaagggaaatgctacaagatgtacggtatccggttaagactagatgatacctcagaggcatcgcctaatacctgatagatgtcagctgataccccgttcgaacgggatggtacctctgaggtattgtctggtacctaataggtatcggatgatacccaggtatagaagatacctctgaggtatcatcccgtctgaacgtaataccattatgtactagaattgaactcgatcaaacaccaaacaactctcaatgacaaatcatcaatttttcccccaatctatctcactaccttcggagttcagacacataaattttctgaattttcatgtaaatcagttcaatcttcacacaacaaaaaatcatacatttaaaaggatgcatgaccactatactacccgtatcagtatggcatgcacatccaaacaaacgggccctagcatccacatacgttagcctaattaacggcctaacagtacgacacgtttgacctgttgaacgattagtttactacgactgtgtcagctgtgtctcaacaagtagcgtgtatacctaacaagttcacttcacgtacggcgccgaacattcttccagctacatatattcaaagttgcagcgttgctttgcaggccagggcaggatttagaattaattaggcaatgcaaagttcttagaaaaaagtacgcattcagctggagccgatcgatgaaacgatccatcgatgggattccaacaaagcatatgcacgccggacaaatttgtactgaccttcctatacgggacattgtgtacatgtgttattccaagagtattctcgagcactcttgagtctaatacttgccattttgttttctctgaatacctttacgtctgatgactgacggccagctgcatatatgtacctatacagcatgcacatatcttagttcttcgatctgcaccctctgttctgtttacacacaggaaaaacgctagctacgcaacaattgcaaatatcttggttctttttccaaagactcgcacgagacggtgcgaagttttattgatagagcaggaaaaaattacaagattacaaccctagagggtcgtaaccaggcgaaaggaaaaaaataccaccacccacataccgacatcgccaacacacaagcccaggagaaggttagcaccggaccgaccgccgctaagcgtgaccgacctccactaaaccaacaaagggacacagatgagatcgtcccctaggggatgccaaaacaacgtcttcaagaacagaagcgacggaaaaaccgccgccgccgtccgtcgggactcaaaggagccaagactgggctttcgcccggcaatcacccttgaggggtgagacagcaacaacgccctcaggaggggaaatgaaccatcattgtcggtccggccaaggccggactgggttttcacccgccgctcaccacctgcgaatgcacggctgacgcaccgatgctccaccaccacacaagctctgccaacatgtgggacccctgcaccggcatcccctgccggccagccttcgtgtgtccaagaccgcgccacccactggcagctcctcctcacacctaggtcgcctcctccactgccggccgtgcctctcgcgccaagccagcctccatctccgccgcccgcgcctctcgcatcgagccggcctccgttgccatcggctgcgcctctctgtgccaagccgatctccgacttgattgacaaagcaagagtggtgaccttgcagattgcacggctagcacattacaaaatttctcatacataatagatatacttacacattttattgtgaaaggaaaatactaaaagatgacaatataactttaaactctggtccaacttgatcatatatatattttatgcctgatgttccaattaacatgtaatttatttattccctatgtttatttattcatgtttaacatgcattattcattaatatatttaatctatattcagattataacattcaacaaattttatgaaatttgcatggcaattcaattgctaattttcatattaaagattcagctatattctccattgaatggtatcggtatggactcttttgttcaaatttgtaatgtttgcaatttttttataccaattcttagtgttttagacattttctatgaacttctcagtggaatcaattaatgttttattttttcaatttatagttaaaataactctaatatttttacatggactatacttttggtattttaattgtaacttcagatatttatataaaaactgtcaatgcaaaatttacattttctttcatatttatttatttatttatctatttattttgtttctaatgttggtgattttaatttggaattcatattgaaataaaattgatggctttattttttaattttgaattgcaattagtaccatattgtgttgtacattgacttttcttttttcttttaatttaactttatttgattatcatatattttaaattgtatttctttatgaactctttgctttaatctatactgccataatttagacccacaatttaatcatcggcttaatattcttcctttacctcaaatgctgttgtgtttttatgctgaattgtttaataccaacataaccacactatcttatcacaaatctgaaatctccagctccaatgcatctcgagatgacctgttgacacatgattaatttggaagcttcacgatcaggttggtgagatatataacacactatccaaagttcccctgttgcgtttcaagccggtcgatatgatgcagcgcaaacgacgacagagacgcacctaattaagccaaagccccaaaaatcaagataacgcctttagattgctttatgcgatgccatacggatcgatgcatgcacaaaacagcagctaagcatactgtttgccagtacacacatgtagctttatagtacttgtgtagctatacttaatttggagagatgggatctgccttgatctagcatatgcttagagcttaaggatatgaacattatgtatatatacatgtatccatacaggcgtacatggtatagatgcatgtaaagtagtaaaactgtatctagctggttaattaagctgtcactgaattttacatatgtccttggcaagctctagctgacagatggaggaaaagcatacaggtatatatgcacgcagcatcagagcaaattaaaagggggattatatatttgatgatcgacggtgtgatctgatctgatgagatgtacgttcctcgttctttccagtggctgagatgcgttccccagaaagactatcactagaaaattagtttaaagataagactacattaattattgctccttatattccttaatagtttgctcattatttgtatattaatgcttcttcttcttcctggtggcttcgtggctcaagggaagggtggcgggagagtatttcttttcggcctactcagctgctgcctgcagcacacagatcgatcgccggtttgccagctactttggaggcagaaaaaaaatgcattaatcattatgtacgcgtacagagcctgatactggaaaaggaggctgatcacccttgatcagtactgatcaccgctgaacaaactaatcaatctagcttctgttccgcttaaatgccttaatcagtacttatatataagtagagtgattttaggtgtataatttgatatctctttataccattcggtactaatagataccaaaattcgtattaaaaattttgagaaattttactatcattgggaggtaataagaggccggtactaatttttttttatactaacattggtaccttttaaaattagaggtagcgagaggtatcaaattttacactaaaatgttgtaccttccagtcgaggtattgtaataaatcactaaaaaatttagtacctcttagtattaaaaattataaaatttctcatataaattaattccatggctgatctaatctagacatatgacagtataatagtatatactcccttcgtacatcccgaaaaaagccaatattgtatgtccagattcgttgtattacgatgtgtcacatcctagtacgagattatatgtctgccctaaattaataagggatagattacgtgtacccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggagctagttaaacgcatacacagaatacaaaaagaagcgacacacactacgtacataattaaattggatttacgaatccaccaggggccgcaaaacggaaggttcgaagctaggcagcgcgcctaactatttatggttgcaatttgcaacatagtttatccttaactttaatcctacattgtaaaagagctgtcctacgtgcatggtggcatctataaaatgttcgacattttgtgtaaagaaattgagaagtggaagtggcgatcgaatttggataccccactttgatctcttctcatatcattggacaacggtatgtacgtacaccgatcatatcgaaccactgcacaaaacagaatggaagctcgatcgaggctgcagtgctccccaaaatactcgacaacttgggccaccagtaaattatcacatgcttaatttaagaataatatatattggttatgtccctaaaaagacttgacttacaccattaattggttgatactccctccattctaaattgatctacatatagttttttttaggttatttctaaatgatctactgtacatatttgtgttcatttattaaatatattcgttatttgtgcattggagtaaatggacattgatgcatgcatccatgcacacaagtatttataatccacatgcaatatcttgatttgctattggctaggaaatagtggggatgttgcatgcatcgagtttgttgctagggtaaatatagtattagagagttattagtttttcttggtcttggtgtaccttacaaaatatgtaaatcaatttagaaaattatgtagatcaatttagaatggaggaagtaaattacaagcgaggagaaaaaaatgcatgcatgggtgctccttgttaataagaaagtagtgttatcaagtgattacaaggtatgtgaggggtgttgaaagaataaaacttcttgctttatgactcgagagtaggtaaaaggacaagtgataacaaggtatgtgaggggtgttgaaaggataaaacttcttgctctatgactcgagagtaggtaaaaggacaaaatgaactatttttgacaaattttaaacgtaagaaaatttgaggatattcataatttattggtcttgaaaaaagaatctaacctattcttgtttaaatgtaaaatatttaggcaaattttgctatgcggttcaaagtttgggtaatttgctgatggatatcgaaaaacgtgtcacggttggagaacacccaaaaactggtaatttgctaaagaattaatatttttgtcaaattggagagagaaattcttttagaaaaagagagaatgcccctggggccataagtttcgaacctaactgagatgcagctctcaatttgccttcaccccaactacatattgctaatatatatcatattttatttttattccagcgtcaggttagaaacttgtacctctagagatactttttttaaaagaatttctctcttcaattggaccgaaacttttctctaacaagttattagttttctgggttctctagccgtgacatgtttttgcggtatccaacaacaaattacacaaaaatttgtatgtcatgtattacaatttgctaaatatttatgactggagcaacttatgtaaaatggtactactcgagactgtaggattgttcaaggaaggctaaacgagaccaacttgcagtaacccttaaatcaagtgcttccttagcagctgcatgcctgcatgtaaggtacagattcaaagggtaacctaattaagttaactaaagcagattgttaaattgaattttgaccccctttgccttttcaaaggaagagcattccacttttgtgttaattaggagagagcatgcacgcagctagcacgcagctgcaagctaaactatagtacaactttttacactgcatgttatgtacctaattaaactgcaaattaagcttatttcatgctatgtttaactgcaagttgcgaaatgcaaacaaagccagcccagtacacggtaccacacacagcttaattagcaacgcacatgagatgatgagatattcttttcttggatatttttcatatgccctttctgcatagtgctctccaaagctctctttgagagtgagagagatagtgatgtatatatgctgccaatgatcatcatcgatcatcgattcatcctgcaattcaattaagcatcagttgaatcaagctgtgcagcagcaaggacggcccagagagagatagccagtgagagagagagagagagagagagagagagatcagttcatccatgcatgctttgcctagcttttttccaagttcttttttctccttggtctctagcttagctatagcctagcttagcgaaaactaaagcagaggactggaaaccgcgctgccctgcccttttccgccatagctaatctagctatcgccggtttcgtcatcaataatcttctctgcctcttcctctctaatccaatagagagaattaaacatacatgcattcgctttagcatcttgccccttttcttaattggcatcgtttttcgcgcgctcgcgatcgatctggtccgtccaatacctgcctcctccctaccccgatccccctgccgcgtatacgtacgcgtgctccttaattttttttagagccctagcttaattaatcagcttagctagcttgcatccaccatagtacatgtacagttccatccatcagcctctataaattgggggtttgtgctccaagccgagcacctcagcctcagctcaccttgtgattagcatagccactgcagatatcgaatattgcattaagctagctagcttaattggcatcataagcagcagaagaagaagagaagagaagagaggaagctagaagatataggagaggaagaggggatgggagggaagtcgtcgttcctgtgcccgatcttcagcttcctgtcgtgcaagtcgaggaggtacgaggacgacgacgacgacggcgagctgagcggcgagtggccggcgaggtacgggagcaaggtgaggtcgagcgacgaggactacggcgcgtggtgggtcggcgagcgcgacgtcgaccgcaaggcctccgactacatcaacagcttccaccagaggaagcaggtcgccgccgcctagctagctcgatctacacatctcgatctccaaccacacccacagctcaacgataccaatctttcattggatcgagggggactagcgtacgcgcgacggcgacggcggacgacggccgccggcgcggccatatatatgtactgcatctgttgtctcaaccggccatttgtgtaccgcaccgcatgtacgtacgtaggtctccgtttacataattaaattcttctcatatatgtatatgttaaattgttatgtatgtttgttgtggattattatgttatatatgtttatttagaccacgaataattgtaatgccggttcacagatcgagatcttgccatgtgtatatgtatgtggagcatgtgaactcttttaatcctactgtcctatggtactttgcatatcgtttaaatagttatatttttttaacaaaataataagataagtagtatgtgatacatctcactatatatataaaatatagggttaaattaatttgacttatataagttgaaaaatcaaatatgactatgagcatatgtatactagattgacttaaatttattatttttgtcacatgtgagcatatgtacaacttatatagagattgaattttaacatgcatataatttcgccttttattaattcgttgcaattttcagaaaggagctagctatgatatacctccaacttttttaataatagaatagaaatctcaaacgactctacatcatatatatgacacacagccgacttcggccccgtatacctaaaattaagaaacacaaacaagaatgtggaaattaattaagcagcaacacatattaattatatataagtaattctcaaaaatatatatataaagataataaacatattttagcatcacacttttgcatgcatggaccatctttaatggaaaatatttatgaatttgatgtttctagatcatatcggagtgtatgtcatgcagactagaaatacctgttttaattttccatgttttttttttacgatggacctgctgccttctgatctcccttatatatttactgctccctccgttccaaaatataagcatttttaacatagtaacaagttaaacatttttaactttgactattaatagaaaaaaataaaaaacatcaatcatgtaaaattgatgttactagatttatcattgaacaactattaaaatatgtaactatttttatttaaaacatcttactttgatagatattgttggtcaaaatagcatttcgaagaccgtatcagagtaaaaaatgcttatatttttagatgaagggaatatgtgtttttgtccgctctgtgttattgtactgactgatactactaatcattagttcgatcatattgttaaaagggagtcaatatataccaccaatacttcagtcactcatgtcagtccgatccgatcgacttgaatagtgtctttttcgagatatacgtagctttaacatagctatatatcttcttttctaaccatccatatatatcagtgatgctaaatagccgaatccctcaaaaaagcctcaaccagaagacactctttaatttgtactcccctttgactccaaatactatatatgaatatatcattttagagctgtacatagaaaataagagaactgttaaaatgatcttgttgtcatatacagttatcgtatacttgaaaggatacttcatttatatatttctaatttctatactactaaaaaataatagtgatgatggtgattcgccaacaccactactacttttgcaattttacaagaaaaaaaatcacctatgacatattattatatattttatttaattaccaatagtaaagcatgggcattttgctagatttttaaaacactccattgatatatgagagtggtacgtagcatttaattaacaagagtatgaaagaatattatactaccttcgtactcacaaggatgttttgaacatttgacacaatctcgaatttacgtggttaattactttctcaaactatatgtctataagaaaactaaaaataaaactacatgacacaatctttcatgacaaatatgttgaaaatctaatcataattcagtatattttaattcagaaaattattatactaaacatgacataaaagtaatagatgattcaatgatagtgctaataatattaatatcatcatagtaacatgtttaacactaaaataaaaagggtgcgtaatgtacagaagaataatctgaatccagagacggtggtgttggtgtagtcgccccagtggtcattgccgccattgtctctgtttccggtactaatcaacatggtccggaggttgatgcagaggaagtagagatggctcggtgtagatgaagtagcgtcagtttgacgcagagcagtcgcatgaaggatgcgctccccaaaaatttaatcaccacctgcccttgcaggtactctggtggatggagttaagacctgctcgtccgaatacttgtgtgcgcaagtgctcaggatcggggagaacctaagtgcagcttagaaccatatgaatggaggtgtctaacggaggagagccaaaatcaagggagatagaatccacgcctcgcccggctcggtgcgcgttcccaccaccattttaaccgctcaacagacgctctcaattagcatcatacttttaatttgatacactactaattagaaaggtctagaaaattctgaaagacattttaagctgcaaatagcctttgcaaagctagccgcaaatgcatggggagcgtctcctccggttgattccgcggcatcgtcacgcgcagacacgtacggcaaagcgggagcgaacctgccagaaagctctgtagctatgcatgaagagaccaaagcggtgggtagtttccatgcatcgctttggtgagcaacggcctgcacatagcgcccagaaggaagctaggctagcctcaaaagccgcgatgctatcactttctgcctcgggcgattcattaattaattgctctccccgtttgaaaatatacctcggtgacatttcctaaaatttatattcgttgtacatgaaaatatcttagtttttttttattttttttaatgagagaagtaagtagtactgtacccatctcaatataaatgtaatctaatatgacccagttcttttctccaacaagagttgaatgaagattaaaattttggtggcacgtttttcaaactgctaaacggtccgtttcgtatgaaaactttctatataaaagttgctctaaaatatcatattaatctatttttaaaatttgtaataattaaaactcaatcaatcatacgttaataccacctcgttttgcgtaaaaaaacttaatcttcatcttcatctccatcttctggagattcaaacaccacctatatatgtgatatatctcaacatagggttgttcatcgacggtttttagcggtttggtcagaaaaggcaaaccaacccagaaatactagtaccggtttatacggtttgttttgaacggttttgacaggttaaaccgggattaagcagaagaacagcaacacaaccatggatgtccttccaagctcaacagcgggcgattgcaccatggctcttagcctttccatgcgatggaggcaggcaggcaggaagccagcggcggcggcgagctagcgattgtttcctccttggatgggagccgccgtttggctgcctcggcatcctcgccggcatcggcgccgccggcaccaacgtctacggggttgttcacttacgtgcgtgctaaatagccgatgcttgcttggtttcctcgatcacgcagatgccttcgccatggcgtcttgctgccgcggaagctatcaggtaatggcagcgcaggtcctgaaggacgagacatggccgggttcaatgggttaagctggtcccaaaccagcccgtgaataaatggaaaaacggtttgggttggtttggtttcacgggttgaacggtttgagcccaaaccgtgaacaggctgatctgaacacatatcgcacgttcttttctcctgaagatgaagatgaaatgaaaatgaggatttaagttttttacgcaaaacgatgtggtattaacgtatgattgattgagttttaattttcacaaacttgaaaaatagattaatatgatattatagagcaactttcatatagaaagtttttttacacgaaacacaccatttagtagtttgaaaagcgtgtaatcttcatctaactttggttggagataaagaaaggaccatatactgcacacggacgtacacagtccaaaatcttgctgagaatgctgctcctctcctgtacacttgtcatgtcgtaggtgtaggggaagaaataccgggtgaatatggcccagctgcccgcggtgccgtggtggggggcatgtgggcgagacggtgtgtggcccggtggtggtgggcgcgcggtgcgtgaccggccggccatcagcggagctaggctggcaggctgcctgcctgtgcctctggctcgcttgctttccatcgccgcgcgcgtgagctagcggcgtgtcgatcgatcgatcgtccatgggaagattgaatttgcgctgctccctagctacccttccgacgtcacggtcgtggattccctctccgagaccatatttctcgggggaatcttggcctcttggggttaggagtagtcccctactccgagcaaatatcggccagctttgctttcgcgatttgggtgaaaggagagagagggagagatgcagcggcgcgcacacaggttcatcgattctccatctgcttttctgcacaagcttacaacgttagcgcctcccttcggaggtaggcccgtccggaaatcgcgagacgtttttttcagcttagttatcgaattatgaactattattgttaccacggttctcaaactacaatttctctgtcaaaattttctgcaacagcgttgcttatataacctgttctaaactacccctattattctaaactagaaatgtagctcacacattctcacggacaccttattgaaattgtcataattttttgctattggcattttgaccattatgatattgtattattttgaatatttttttgataattttaatatttgtattaaaattattttgaataatttggataatatttgaatattatatatttttaataatattgtaaacgtgcgcacagtcatctttatgaacgcacaacatgcacattgtaccctcttaataatctgttagacatttttctagacaaacgaagtctactttctttttagagatgacgaagaagatagtagataattaaaggatgctacctccattctaaaataagttaatctagaagagaataatgtgacacatactactgctatgaagaagctatgtggctgcttgaaatccttttggagaagattaatggacttttagtatatacgtgacagtttgggagtgttttgagaaagccacgtgataacataagagcgttttgaggaagtttaaagtacttttagtatataaaatagatattgacgatatttctcttagttcatatcgacttctctctaagttaataatatttgtcgttttatataaggacagtctccaagaaacaacaaatggtcactattttataatatatatatataaatatcaataatttattgaagtatttttttaagacttatctataaatatggtttccatatttctaagataaatattttagatgttataaagatcttaaaatttgacaatagtcttattcaaatcagagtattatcgaccagagggagtagctcgtgtgctttactatacaaatccatgtggcttcattcttcacataagactggttacaatatggaacctgggaagtgaaataattatcgcttcacacttcacgattcgcagttcatctcgcaagatgcaaactgcacctcccagcatacaaagtgatcgtgggcagctgtaatgtagtttaatactgatagaacgatagtaatagtacacaatttcatataatggtcatatggtatacgtatcttacacaaatgaccaagaaagggttttagtatatgtagactgcatttctggaattatatactacattttcgctactggtacacctttcggtacatttcaatctctacaagaactgagaagtcaaagaatatcttctgtgatgatcagccagagggaaggttcggagtgcgacctctcgtgcatacaatgcatcaacacacaaatatcctaccgggacagaggaaatgattgctcggctctgtagcgaattcgcatgaacaataatactcatatccaaacaatctgcacatgttccctcatccaggaaaagaattcatcataagctgagatattggcgttcctagcatcatgagaagatagaaaccagatggttcagcaatcaatcttcatgctcgtcttcaccttcagagtctgcacataaagcagaacagttttagatggtagcaaactcaaaataattttcaactcacaatggtggttggagtaatgcatgttataagcagactttgtcttgtcccaatgcagatgggactgaaaataagaccatgcaattttgcatgctcatcctgtgcaaaaacaagattctaagggggcagagcttaccagatcgaacatcatctccaacatttcttgtcttgatttgtctcacaagcatccgatatatcagaacccaccaatatatgtgaagaacaagtagtgaaaataggagagaattgaacacatagtaatatataggaccatcaaaattgtgcttcttcttgtccaaggtcaacaagacttcatagctgaagcaatcgggacttagtcagctcatgtaacttctaataaataaggaatgaaaacaccattttgttacatgctgggacaatgggacagcaagatactattgtacatagtattctagtctgctatcacacatatattttgtacaatataagtatgattatcatggcatagaaaggatcggaaataaaatccaaaattaatttcagcatgcggtggcatgatctagataagtttgttttcaagaggcataagatactgtgctatgttcaaaggtctttttcctactggatacaattactgttttctaactgaattacttgttggcttgggtttcttttctccccttaaaatgaaggcattggcaagaacagcagaattcaccatccaaagttcatatggtacaaatttcgcatagtaaataatatgcttgcttttgacaattcacaacatctatagtacttaaaatgttagaagtggtggtgtccatccccacaccacccctaccactaacatctgaaccccacaactattacaccacctttcaacaagtcatcccccatttcactattggctcccctaaatttcaaaatcacttgttcaataagaaaaatcatagtattacttagaacaaataagtgcttattgattgatttaataagctaaaaactcaatttgttttccattgcaatgcacgggttctaggctagttttcaaaaaaacttctttctcacaaaattctggctgacttttctaggcatatctcaacaaggtcagtacatcacatttaccttgtacttctgagaatccagaacggaaaatatgtgagacggagaagaacccatgaaacgacgaaaagaagaaatgcaacattggcaagcaaatcacaatggctatatttggccattttccctacttccaggaacacatcacttgcatcatgaattgccaatactactgagccaactctagcaaacctggttcatgaagaaaaatttcagaaataaattagttaagtgttaataaaaatgagtgaaataaactcagtgaagataaaatattaaggccctgtgctactaactcatagagtaatgcttgaatcaaggtaaaaaaagttcatattcaagaaacaacaaaaattaaaagttagacaaaaagagacctgaacacataagataaaactatcagcgcaacagttgcaacatgatgtgacattgacacgccaaaatctgaacgccttgtttcccaaaacataagtgcaaatatggaatatgtgtagaatccagcagcatacatatagacagccttaagtttccatctgtagataaggggaaaattgttagatatacaccagcctgagaactagtaagaacatgaagcaataaaggaccaattcgtattactttatcttttggtcaggccaaacctggtcaccaggtccaacccagaaatatttagtgtttgtgaaccaaggctcattatatgtaactgacaaagataaaatctctccagataggaaatagacacatttccaagctgattccttaaattttcttatcttctttcttgtttcctccttctcataatcaaccttttcctttccaaatataagttttcttccaatccactgaaacgaaaataaaagaaaaacaatgaaagtgtcaacattaagctttagaattacattaacaattgaaaatgttaattatttaaagtaaaaatatctatgatacaacgtggagcctgagagaatctattagaactatacaggaacaagagtaattttctggtgggttcggaatacagaattaaagtagctgttgtgctcaacctttcaccaatcatgtatttaagaagcataaattactttagaatcataataaccctcatagtgaagcaaatgatctcatctagcaaacaaaaaaaatgtctcaaacaaatacagaacaaatggtaaccagatggccatgtgccataattgcagtaccctgtgatgtctgtatattgtagtcatgcatctgtctaaataattttcttgtgaaaaaagctatatgtaatcaacttaggtatcgcactccaacctagactttgagttagtaaatgttcataaagaaggcatcattgtgtgcttgtgcttaagtccatccatattagaagtgaaagaactctccctcactagtgtcttagttctccgtcctgatgacttgtaatgatcagaattaccttttaaataacataatggtatgtaacataaagatgaatagcatgctaacatatacctcaacatacatatcaagattatctaaaaaaaatctcaagaaaacatcacgacacaaatgttttcctggttacagatagcccagtggaaaggtatactactcatacaataaatgtggcggttgcaactattcttactgcaatgagatggttgcaatttgcaaatttataaccgcgaggtatttctagtttttgagggatataaattacattaaccttgctcaagatgctcacacgagagaaatactgctctctttatgccagaaaccactcagatctactcgtggtctgttgctgcactgagctgctgacaacctcaaattcgcagcacatcgctgccttatgccactgataaacagtaaattgtatagtcgtgtgataggttatgagagatatcaactcaacttgcaatccatttctctgctcgcaaaacccttctccttgcatgaacttttaccttaataaacttgtgttcaggctggcccagtaagtccgtcattgttcgcctcgaaaaatacattatatatgtattttcttaatggaagacaaactaacccagggaatcatatatggatcttgatagctaaatcactaaattcttattgtttaagatgttgaaactgtataccattattgttatagttgatgcgcctatgcctcagagatcacactattcatcaccaaagaacaaaccttaaatcttaaaccattatactccctgactaaccactgcagcgcaacacaacaggggcccctccgtaacaaaaaatcagattcagagtaccagataatcattagacaagagaagaggacgactctccaatacagcaatgccatgatgtaccagcacatctctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgccgccggaggccgaatcgagtaggagcaagaaatcgatctctcctccgccgcgccggccgcgaagctggatgaagaaggatcgagaggggaggggaggcgaccccggttggggccggggtggattccgattggacttccctcctctgttcctcttcgccctctgactcagccgacgcctctgttttaccactacgagtctactactactccccacttgtttatttttattttatatttttcctttttttattattagtctcgcagtggttgcacggagtggtacaatagaaagcgcgtaatgaaccgtgttttataaggggtgtctagatagggctaaaactttttagcccatgttacatcggatgtttggacgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatatgttttataattaatgtatgtttaatactccaaattagtattcaaacatctggtgtgacatggacttggaataagtccgtggaaaccaaacaggcccctaatcccaggaagctgggaattgtattgcatctaccgttgaaaagaagagatgggaattgtagccaggttgacttttcaaccatttttgacattttttttttgacttggtgtactatgattaataatccgaaaatggttatgataacttgtttagcgagttttgtgggttttttatcctatgggtaggattcatcgagattcaaaaataattgtatatttcttgtgtgtttgtaaataatcaataggtgaattatttgtaacttattcatacagctgaatataaatgttatcatacaaaggaaatgcatttggagaaaaaataagatcagaaaaatattagaccacaaggcaatgtcggtgttttttttttggtgtaaccttaacatgtatcccataaataattgatcattgttaaagcaattctcacaattctatagataggatttggtcacaagatagacccacatgagataaaaaaatgctttggctctgattaatgaggtgaatgcgagaggaaaataatgatttctttttcttgtggtagaccttaagcataagcataaggtataccataaggtaatactactttccacaatgtatatgactcactttataacttcaatcgttattttaaggttatcttttcatacattgtggttgtcctaagggtttataattattgttccttaacagcactgatacatcttttgttagagatattcttaaaagattcattttaaaagtattcctacaaagttagtttaacttctaaatcatgaatattgcacatctaggaattgtgagtgtattaatctactatataacaagatttagatcatagtgcccataagcatgactatgtgtagagtattggttaatacattcacccgaagttatacttctattgtaaaaaaaattaaagtactcaagtacaaaagtcaataagtgcatcacatatgaggattacgatgtaaatagaacattgcaaaagaacaatacatgatgtgtgagaatatatagtcgttttcccccttaagtatgttattttaagtttctaaaataaagtatttaaagatataacttgtacagtaaagtttccccttatgctatagtaattttttttcttatgttttgtaggcataggaactgttcgagtgttgaactattgtctttatactcaattctaagtagtagagagtcatatcaatccaaaataataaaggtctcgactaaagacgcacaagaataaaagagttaaaccttagcacatcttgatattgtcccttttagttagaggcttagagctatatcgtcaacatgatcaccatttgtttatggtcttagcaatgttgaagatggaggagcttgagttgtatggagtggttgctccttctactatgatgtgacaaggctaccgacatcaagttagatcaaccctaataacccatggataatatagatcaacctagaaagcgatgtttatctatggattagttttggttccactaaaaagttaagtttagttttggttccactcaaaagtttaagttcagtatgaaacctaccaggcatggatgcaagtaaatcaaaccataaattcacttaatagattaatcaagtggattgaccctgtaaattacccatctatttagtccaagttgatggatcaacccatctctaaccctattataaccagaattaaatttgaaaatacattgttcgttcaattttttctcaggaatattcgggatacaaatttttttgcagaaatataccgtcggtttcgcacaaccgttgcgtgaaaatgacgtggaatgacgtcgcggacggtattgcgcaaagaaaatgtgagaccgtgcggtctcgcgtagcgacgcgacgcgagaccgcgcggtctcgcggattataagtgcgacactgttcggtctcgctcaagcaaggagcgataccggtgccattatgatttaattagcgattaattatcctaattagtgattaattaattattaattaattgctaactaggataattaatcactaattattactagttgattgttaattgattaattaattactaatcaaatggagatattggacaatttcgctgtttgatttcacgagagcgtttggtctcgctctttcattccgcgagaccgcgcggtctcgcgttatctcgtactttcatcgtgcgataccgtccacgacgtcaccatgttattttcgcgtaacggttgtacgatatcgataatatatttctgcaaaaaaaattgtataacgaatatttctgaggaaaaattgaatgaacattatatttggcatggacgatttgagatattttgattgggccgatctctagcccatatatacgtgtaggccggaaatctgaaaattctgtccacgtgggcccagaaaccttatcccctcacattaaaaattgcttaaaaatttcgaacactacacctgccgtctcctcctattcactccacccacctcgccggaatgctcgccgtcgtcttctcctccggtcaccgcctcctccccctccccgtcctccccggcacattcaccacccctcctcctcctcctcctcctcctctcctatcccctcgccgtcctctgctcgcccctcgccggcgccgctgcctatgcggcggcggcggtggcggcctcctcctccttcgcgccgtcgccgcgaggcgcgcgggcatcgtgatcgacgtcgacgaggtgggcgaggtcggcgaccgcgacctccccgtggacgtgtcgttcacccggaggctgccgccggtgctcaccctcggggacggcctcgccgcgctgcggcgggccggggaggaggtgaaggcctgcccgcctgccgccgccgcgagcggcgtcatccggttcgaggtgagccgcccagcgaggctgtgtgggaggggatatgtcgtgttttacagatttgcagttggtttcgttgtgagcagccgctgcaatatttgctgcgcggcggcgaggcgacatgctcccccccctcccttacgaattttaatccagcactgtgaaattattgaataatccactcagctccttgacgcaataggcgtaaatcgagctcgcgtctagctcattgtttatgctttgcgatgcatttggatttgtttatcccttacggtctaagcaacaagtgaaacaatgatgattaattctcagttctgacaatgcaacggtgcaggtgcttgttccacccagtacgaaggcgctcaaatggctgtgcacacagtttaagagatcatcattgtttcctcagttttatttgtcgaggaagcaaaccactgattcatcaattcagcttgaaatctctggcgctggctctgcaatttgctttcatggttcctctcgagtagataatgggtttgatttgatatcaaggtgcctcctctctattgctttccgtagcgtacgtgtgatgcagggtgtttctaactaaattaggacctgtttgtccctgcagatatctttcgtttaattcacacttgattagagcctatggatcagtaggtgttaaatatgacaaggaactattgtctttagaggagagaattggttcattttacttctttattcctcaggtaacaactttcagtattctgtggtgctactctagctacctgaatatttatcaagttggtgcgagatacagactatgtgtacaagccattttgaatttagcaaggaaaatcctcgaagttctgtgatatgacattccctgtataaatttggttacatggtttaatatcatattgtcagacaacagaaacagttttacacctgaatttttcttgttagcctttttatgattgtggtggggtcctcaaagtaatccgttggtgcaaagaaagtcctattctgaacatgcatgagtggcacaagtactgcacttatatctagaaaaatgacatagaagttagcctattagaacatttttttaatgtattaaaaagatctacataaacaatttacaagaggatcacaacgctttatgacctactttgactggtaagttattgcacagaaagtaatgcaaatgcaaagggttaaaagtggaggtcaacttggttgaggatttttcttgcattcttgcatacaagtcacataggaggcagtaagaatttacagaattctttcttggttatcttctgcaggcataatgtagatatttgatcttatagcattcgtgatgatcagcaaaattgaatttacaggttgagctgagtgaatttgatggctattccatgttatcgtcaactattgtttgggatgactccgtgtctcacacatttgaggattctgtttgtttatttgaatcttgtttcagtcaggtatgtggaactaactagattaagaaaaaaatatatttaattctgtttaactttctttcatattaatatagcatttccatgttcttttaaaacaattaattttctgttttgtattttcccctgtaagatatggagtagctatgattcttcagctactatctgttatgaaaacatggtaacaagttacattggagaatcgcgtatgtcagagagcaggaatactcagttggtacatatttctatcaatcttaatcactttgttaatttcatgaatttacgcttgtgccatttgttctccactctgcaaagtccatctgtgatgaagcttcagttgtatcaggccttcacatgaacactcatattcactattccgatgttcttacttctatgccttaattagttcacagggttttgagtctgaaacattatttagttatattacggaggattataatagcagagttttgtgatgtgctctactgaagtttgcaacaattgcttctccaatctctaatggccattcttcccaccattttgtttttggttgaatgataaaaaaaatcctctttttcaacaaaaatagataaatgaaacgtctatgccttttaacatatagaacatgctggcttccaaaaaaattagctatggctaatgatatagattgggtgctcatattgtattccatacagagttttggctattcatcgttaaccagtttgtgagttatggaacatagttctagtttgcacgcaaacactctttatagctgtttatgtatttcgacagttatctgctattcctattatcatcagacatcaaagtgctcaatttgattttgttgaatccactgttccaggtatacttggatgctgaatttctcgctgtaatagatggcaaagctgtcacggaaaaggtatcctcttaaccctggtaagcttctttaagctatttcattactttgcaattgagattaatccctggttttaatataagaaatgccccttgcaaaaaggaatattatgtttctttctttgcggtttatggatattttgtctgtatcttgctggaaggcacattcacacctatcacatttataatagtaattcaagattattttttttacgtccctgctgccctgcattacctggtaactaacaagtttgcctacctgttagttagttgaattgcttttgaccaactccacaaattcatggaccaaaaagttaaagtcaagaagttcatgggtacacatagacctcgccacaattattaggacagacataattttcctattatttcctttttaaactttttgttgttcatgttctcttataagactagacacaataaacttgaatttatatccctgatcggatatggaacttattcttttgtctgtaggagaattgcccaacttctgatcagtcatttgttcggttttcgccgcagttcttgttttgtgcaaacatggtaatggtttctacctgagtttctttttttcataaataaccattaaattattttgttaaatacttcctccgtttcacaatataagtcattctagcatttcccacgtttatattgatgttaatgaatctggacatatgcctatctagattcattaacatcaatatgaatgtgggaaatgctagaatgacttacattgtgaaacggagggagta

SEQ ID NO: 74926 - DNA, 8703 bp, Oryza sativa
cgggcaatttgtttccctccggaagaatgttcttgacgagtttcaataaatcgccaaatgccttgtcactaacattattttttgccttccattgcatgaactcgagagtggtatccaactttttgtgcccctgctcggaacctgggtacaacgacgttctgtggtcctctaacatacgcttcaatttatgggcctccttttcactttcacagtcctccttggcatcctacaacatctgaccaagatcatccgcagcgtcgttattattagcatccctgtccacctcgcccgtttgatttccttcaaatccagcgtattgagcccagtccggaatgttctcgtcttccacttcatcttcttccatctcaaccccttgctcaccgtgggatgtccaacaattatagcttggcatgaaccccgactgaaacaagtggaaatgagtagtcctggatacataatacttcttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaacaaacaattcttatttattatttttgaatttttaaactaatattaatgttgtacttcttttaattttcaatttagtttgttttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaacaaaaaacattggaggatgaagttactaaccttttagacacctccgatttgtatataatcaccaaaaaaaaaattcacaagaaattttggcatgacctcccctcttttttggagaaaatttgaagcttgctcgggctggaggaggaagaagacatatataaagagggagataattagtcccggttgatgttatcaaccaggctaaagatcgccgagatctttagtccctgggggtctgacaaggcctaacatctttagaaccgagactaaagatgatcttaccaaccgggactaaagatcatatatgcccgctgtagccaccaaccgggtttttagtggaaccgggactattgtggatttcggaactatgataagatctcttgtagtgacggcttgtttggctattagagaggcagtttgagacatacggcacacagtttcataccgtgtgcgtgccaagttggcaattggatcctagtagcagcaaattttgaaacactcaacccaacccaatccttcttctcttaatcttctcttcctactcttgtgtttgtgtgtgtgtaagaggctagtagagttagctagcctaattttttttgcacgttgcagctactagctgtgctgctggcttgtcgtcctctgcttcaactttaaagagagagctaatagatcggtgatccgcttgggtttctggtgatcatatgcaacatggactagctacttggatttgttcaaaggatctgcttcttggatgctgtccggccacgtcgccatgcatgcgaattttgtggatggagtcaaaagctgcatgcacggagctgatttaattaagggcatgttcacattgtagtcaaaataaaccttaccaagtttttagcaatgccaaaattttggcaggatttcttatgtattaaccagatttgccaacaactaaacgtagatattttttggtaactttggcaaaaaatgatatggttgaaaatggcatcaaagtgaacatgccctaattaatttgttgacagctactccctccattccaaaatataaagtataactacccttaactcaaagaccaagaaaaaaatattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaacatctaagaaaagtggttgtgccttatattatggaatagagggagtagtacctaattaagcacgtgtgttaatttattattaactagtaatctgcccgtgctaatgctacggcgacattcagaaatacaaattaagatcgatggatatagttattatgttgttaattaaattgccacatgcataaaataacatagttattatcctggttcaaatggagtcattagtgacaacataccatggtaaaagcaaaagtaattaaactttggaacttggcaccttgaagcatcaaatccttgtctaccttgctgtctccctgtcaccccggccccacttaattctaaattaaatggatgagagaaagagattaatatagtttagtgtgatagtgccaacacatggaaaatttagagcttctagttctctccttctacatctctcttaaatgtgggaccaagtccttatggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctgcaaacaaccttggtgaatcatctctttgatcctaaattatattttcaaagagagaaagaaagagagagagggagtgaaagtccaatttacacccaaacttcaccatacctctcatcttctcataggaaacatctacatggggccactagacagccactcatacttggttgagtgaagtacaagtgggatcacagcctcaaaccactgccaactcctttaaatcgtttctacccctcatgttgacaactagctctcactttgcacctttacttttaccattcactactacaaccaagatttttgtgtgagggctaaaacgatttttccgcgcgggtaggcggcccgcacgcacctaggggtctgggaaaatgatgatttttgcgtgcgggtggtgcacccccacgggaaaacaaaaatccgaaataacatatttttttttaaaaaaaacgaaaccctagaatctggcggtgggcttccgcccgacggccatagtgccgcctgcctcccgccggcctccccgccacccgccgtgggatccgcgctcccctccggccgcaacgccgccgtcgcccctcccctccgccggatctagggagggaaggaaggggagaggaggggagctggatcccacgtggggagaaggaggctggctaccggatccgtgcggggacggctaccaccgcaggattcttgcattgacggccaccgccgccggatccacgccctccaccgccgccacgtggaggaggccggcacgctcctactcccaccgccgccgcgccgctgctgtcgccgcgcgccgccgccgctgacgtcgtcggcgttcccggtgtccagagtgccaccatcgccccactttgccattccagtcgactcgaatcatctcctgctgtaccattgcgccactgacgtcgccttggtccctggagaacgacgcccacatatgatcaagccaatacgccgccacgaacgctgtcggtcgccgttgctctcctgctgcctctgcttctcttgccgccgagtcaccgacatgtgggcccggttgtttagccacttcattaggtgctaaggactttaattagtagaaattgaaatcttgtaatgttctttttgtaaaattgctttgtttgccatgtgggcttatggacctaaatgcaattcaactaatgcctagggacctttttgtatagggtttagggtttaccaactcgacccgaacaaagcctaatcctcctgatcatcaccttcactgaagcactcctcctctgaagaatgaatattgcaagaatgagcatatgacatactcaacaagccacacagcaaatatgcaagtgcacaggataacaaaggatggcataattaagctcatttgcataaacagcatttaataaacatttgagagaatagtaaaacagttaagtaattaagcaatattaaataaacactatacaacacacccattttgcataggcccaaccttatctgaacaaccaacccctgattgtacaaatcaaacctccaaaccaggaatataccattccaaaccaggagtcaatttagttatcacagtattttcattaatagtgagtaatgtgagactaatcacgaaaaatattgttagacccacccataaccgcgggcacggctattcgaatagttttacactgatcagagatgtaccactgtacccacaagacacaactccacaacatgtcaccatgcgcctcagtaccaccacggtaccttggaaaagaactgtgacaatacctctcacacaacacaactcaccacagtgcactgttccgggatcatagtctccccctcataaccagaggcaatggagtccccagcgacccccacggacttctcgctgcttcacagtctggcacccccgtaatgaatcatgctatacaaaaggtaaagccgttgctcacgctggcttgtcgttggcacggtaaatgtttcacaacagtagctcgtgaaccggtccttaattgttatgagcacgaccatcaaaacgatgtactcacaacccacctttcatcaggtttatgtatcaattaattatcataacacgattaaccatcgtaagctaccactaaatataaccataagtaatatcgtaatatgattaaccccattggtgagctaatgtttctaagcatggctaagcaattatacctatatagcacttagctgaaccaaaccaatacataaggtccaagctattcaatttattacccataggaaaataaagtgattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatccgagttacgatgatttagttatgaatttccagagtttaatcgattttcaactaataaaaaaactaataaaaatgatttatgacgtcatcgatgacatcatcgccgggcatggcacggctccacgtgaccaccggcgatagagagctcggttgggctatccgaggacacctacgcgaagaggacgacgacgcgaactcaccggtgcaagaaactacgacggacgacgacgtacggcgaccggcgacgaggaccaacagcggcacggcttggcttgacgacggcggcggcgttccagtggcttgcgacgacggcgaaggggcagccaaggtactcctccaccgtgcgaacccggcggcggcgacggacagcgacggaggtgacgctagcggcagcgcggcgtgactggagagtcgccagcgacgacggcggcttgagctacgcggcggcggcgctacgagcaacggcgagacacgggacttggggcaaatggaagaggacaactaggggatgctttatataggcttggattagagagatcggactccaaccgagaggaatcgagctgggaaaaactagggttagttaggagagataaactcaaaacgaattcgatttggtttatccgggcaaaattgatctccgaaactctaggggaaagggagaggataaggaggagatgatttcccctcaagcaatcggactcgggggcgaccggttgaggaggaatcgaaggagaggcggcggtgctcgggctcggctcggcccagccggaggtaggggatgaccccgacatgtgggcccccatgtcgatggctagaggagaggagggacggctgggcttggattgggccggcgtggctgcacggccacgcgcgagggagagggatgttgcgccggaaacggccaaacggcctaggggaggattttaaagactttttcaattaaaataattcgtgaaatgatgtttcatttattaaaaatacttcccttgctcaaataattcccagaaaaatctagaaaaatagataaccaagcaaagtatttaataaatttttatctagctcaattttatgttgaaatttttcctagattattagagtttaacttgtaggtttttaaaataatttcaaaaaatgcattaaaaattgaattattaaattaggcgattttcagggcgtgacaaacctaccccccttaaacggaatctcgtcctcgagattcagaagaactggcaaaaagatgaggatgagttgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttctttaactgcgacacatggaaaacgatcatgtattccctccattgacagaggcaactctagttgataagctacttcacttcttcgactcacaatcttaaaaggtcccacaaaacgcggtgccaatttctctttggtctgaaaacgatgaactccccgcagcggcgtaacccgtaggtatacataatccccttcttcgaaagtcaaatccctacaacgattgtctgcatagctcttctgacgcgactgagcaactcgcaacctttcttggataatcttcactttttcttctgcctctcgcaatacatctatcccaaaaacttgacgctcaccaatttgatcccaaaggagcggtgtacgacacttacgaccatacaatgctttgtatggagccatttgaagactagcttgataactgttgttatacgagaattcagcatacgacagattcttatcccaacttccaccgatatctagaacacaggctctcaacatgtctcctagaatttaatttactctttctgtctgaccgtcagtttgagggtgataggcagtactgaaattcaaacgagtacccatcccttcttgtaagttctgccaaaacttcgaagtaaactgactacctctgtctgacactattttcttgggaacgccatgtaaacatacaactcttgccatatatagctctgcgagcttatttcccgtgtaggttgttttgacgggtatgaaatgagcaactttagtacgcctgtcaaccactacccaaatagaatcatgtcctgccgacgttctgggtagaccggtgataaaatccattcctatttcctcccatttccactctggaatcttcaacggttgcagcagaccggctggcttctgatgctccgccttgactcattgacacacatcgcatagagccacatattctgctatctctcgtcgcatgctggcccaccagaattgttgcttcaggtcttgatacatcttagtgctcccgggatgaatggaatacaaagtttcatgggcttctttcatgatagtatcctttagctccttattatcgggcacgcaaattctttctcctagccacacagttccttgctcatcctctatataaccgatggctttacctcttctcatgttctttttgatttcttggatatcaggatcattcacttgagcctctctaacttgatcaaaaagagtaggctgagcttctaaagcggcaacaaaacctttgttgactattcccaagttcaacttttcaaattcctcgcataactcccaaggtaggtgtcgaccttctgacatattacagtagcttttcttgctgagagcatctgctacaacatttgctttacctagatgataatccttgatcaactctaaccaccgtcgttgacgcatgttcagatcaggttgagtgaaaatgtacttcaaacttttgtgatccatatacatctccgtacggttaccaaaaaggtaatgacgccaaatcttcaatgcatgaaccacagctgccaactctaggtcatgcgttggatagttattctcgtgggggcgtaactgtctaggcgcataggcaatcaccttcccatcttgcatcaaaacacaacccaaaccatgtctagaagcatcacaatacacctgaaaacctttccttggatcaggcaagactaacactggcgcagtcactagccttttcttcaattcttggaaactttgttcacactcttccgttcacttatacttcacatccttctaaagcag

SEQ ID NO: 74927 - DNA, 2855 bp, Oryza sativa
acatgattattattatttgtgtgtgcatgttctttacttaatttattcttagcggatttctgatgtttttgtgagttttagactatgggagataattaagattgtcatgccaaagagtattccgaatcctactaggaaagcaaagggaggggggaggaaacatggtcaatttctcggctgctatcacattccttgtattcttagtcttgggagacatatagccacgctaaaggcaatacagccgaggaatggcaaccttactcacaaggacaaatagtcattaaaaaattatgacagcactaaccatatctaatttcagttcaccaaacatacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgcagtggaggattccacatataatttcatagcataagtacataatacaatatggtataatacacatatgcgcagtactttgaaatatgcataccaggacatatgctttagttcactccattcattcttgcattcttgcacattcaacatcagtcagatctaccaagcatccttgtacattcaaccacaagcagatctaccaatgaatcactaacttatgtagcaatgggggaaatcggaggagaattaaaaccattcctcgtcagacaacggaaggacaggaggcggcagaagattcaccggctgcacaccacggcgcgcgaatccctgaggtgtgggcatcgcatctatcagcaccaacgacatcggcagaggcaggggtggactggggctctttcgtagaccgatgtaaactagacttgttggcttcgttttagggaggggagggaaaagagatagactttacccggctggcctttgggcctgcgtggagagggataggagttggcttggtttcagccatggtttcagccaaaaggtaggaagaggattttaaataggttgcatatgcatgctttgtctaaagaaaattcctaaaaataaatgaagcaacaataaatcccaccaaaattctcataaatactaaacaacaccctaagctcccagcaattttagtttgaatttatcacatcaattgataacccaaataaatccttcaacacagctaaaaatctggaaacagcataccaattagcctagtttgcaccttcaccaaaattaaaccataactcctctagcaaaatctcaaggtcagaatgttaaacatactttaccatctggtgcaatggcttagtctaattcaaaatgtaaccacatgaaatgtgagccataaattacgtaaactttggaacttggcaccttgaaccatcaaatccttgtctaccttgccgtctccctgtcccccaccccccccccacccacccccctaattctaaattaaatgtatgagagaaagagagtaatatagtttagtgtgataatgccaacacatggaaaatttagagcttctagttctctccttctacatctctcttaaatgtgggaccaagtccttgtggggcccactcatcatacaaccatagccaacacatcatctgctcttctctcatttaatttttttttatttctcaaaaggtgagagaacggtttaaattcaatttccactcaaaatgccactctaccactccaagccttctaggaaagatctatatatgggcccatttgtcgtccaaacacagcaaaaaaccttggtgaatcatctctttgatcctaaattatattttcaaagagagaaagaaagagagagagagagggagttaaagtccaatttacacccaaacttcaccatacctctcatcttctcataggaaacatctacaaggggccactagacagccactcatgctaggttgagtgaagtacaagtgggatcacagcgtcaaatcactgccaactcctttaaatcgtttctacccctcgtgttgacacctagctctcactttccaccttcactttcaccattcactactacaaccaagatttttgtgtcagggctaaaatgatttttgcgtgccggtaaacggcccgcatgcacttaggggtctgggaaaatgacgatttttgcgtgcaggtggcgcacccccacgggaaaacaaaaacccgaaaaaacataaactttctttaaaaatgaaaccctagaatctggtggtggcgccgccgctcctgcttgccgctgccgcctcctcgtcgtcatcatcatcgtcagcggcggcctccacgccgctcgcctcggatctgtgctcccctccggccgcaccgccgccgacgcccctcccctccgccggatctagggagggaaggaagaggaggggaggggagctggatgccacgcggggggagggcggccggccgccgtatccgtgcggggacgaccgccaccgctggatttttgcgttgatggccgccgccgttggatccgtgcagggacggccgccgcccgccggatcccacgccctccaccgccacaacgtggaggaagccggcgcgcgcctacgcccaccgcggctgtcgccgcgcgccgccgccgctgccgccatcgggaggagaggagaggacaatggagagaggagaggagaagcgtgagagagagaggactgagaggagaagctctgcgtggaaattttaaagttgaaaatgggattgaggggaggggagaggagagaaaaaggagaaattttaaagtgtgtgagtgggaaaagagggagttagtatttttgcatgcggctctcttaataggtccgcacgggaaaatcg

SEQ ID NO: 74928 - DNA, 27794 bp, Oryza sativa
  unsure (1)..(27794): unsure at all n locations
cgattttcccagaagcaacgagttgccgcctgcacggaatctaaaagggtccctgtagtagtcattaatctagccaactcgccactgtgaacctcatctatttctcacagtgttccactatgcaaaccaccaaaaactacctcggaatctccaagaacttccacttactcttttcacctgaaggagtttcatccatcgcatgtattctctggtgagcttcaccgcactccaaccatgggaacgtgaagttccttctctacctaatcaatccattttctttgtttctattttggcatagatcgaacagttagtgatatgctcgtcggcattcccggtgtccatagcgccgccatcgccccacttcgtcattcccgtcgactcgaaccatctccggccgagccattgcgccaccgacgtcgcctacgtcccaggagaaagacgcccaaaaatgatcaagccaatacgccgccgcgaacgccattggtcgccgttgccctcctattgcctctgcttccctagccgccaagtcaccgacatgtgtgccccggctatttagccacttcattaggcgtaaggactttcattagtagaaatttaaatcttgtaaggttctttttgtaaaattgctttgtatgccatgtgggcctatggacctaaacgcaattcacctaatgcccatggacctttttgtatagggtttagggtaagtcctaaaccctactcagagattactatttcatgcattcattacttgatataatagcttgatgagtatgttgtactcaccattgctttaaccctctctttgagaatcaatttggagtttttgccgaaccatgagtttaaacatataaattagtttcattccaacttagttcccaattatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcagttaccgaatcttcaattttgggacctgatgtcacgcccggaatttctatccaaaattccgaacgcttacatgtgtgttaaaccctcgtccaggaatcagccgaggcacacaataacaaattgataatagagtacaaataaataactatttaatattcacaaataataaatcattacagaggtagatagtttctctcaaagaataactttctacgcagcggaaaaataaaactaaaacaaactgcggaacagctatggcgactccactccacagacatcttaactagaacaaacttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaacaaatatttaagagaatagtaaaacagttgagtaattaatcaaaactaaataacaccatacaacacacccatgttgtatagtcccaacctcatttgaacaaccaaccccggttgtacaaatcaaacctccataccaggaatataccattctaaaccaggagtcaaattaattatcacaattaccattaatgaataatatgggactaatcacgaaaaacattgctcaactcacccataaccgcgggtacggctattcgaatagttttactctgatcagaggtgtaccactgtacccacaagacacaatcccacaacatgtcaccacgcgccttagtaccaccacggtacctcggaaaggaactgtgacattacccctcgcacaacacaactcaccatagtgcaccgttcctggatcataatctccccctcaaaaccagaggcaatggactccccagcgacccccaccaacttctcgccgcttcacagtctggcacactataatgaatcatgctatacaaaagataaagccgttgcccacgctggcttgtggttggtacggtaaatgtttcacaacagtagctcgcgaaccggtccttaattgtcatgagcacaaccatgtcacgcccagaaattcactagtaatttccgaacttatttgtgcataaaaccctcgtccaggaatcagccgaggtacacaaactgacaatttaatatacaaatccatcataatattaacgttacatacttacaaaagaaaagaaaacagtagcgaaattaacgatctagcgatggcttcagctccactcccacaggcagctcaactggggtataagccaaacgtcttctccttctggatcctttttcttcaactgaggtttggttgattattgcaaggtgagcatatgacatactccgcaagccacacagcaaatatgcaagtgcacaaggataccaaaggatggcataatatagggttcatttgcgaaagcagcatttagcaaagatttaagagaagtaaaacagtaaagtaattaatcatcaattttaatcaacactgaacagcacacccatgctgctcaggcccaaccaaacctgaacaaccaaccccggtcgtacagatctaacttccaaaccaagaattatccactccaaaccaggagtcaaattaattatcacattattaacattaacgagtagtgtgagactaatcacgaaaaacattgctcaactcgcccatgaccgcgggcacggctattcgaatagttttactctggcaagaggtgtaccactgtacccacaagacacagcctcaacatcatgtctaccatgcgtcgcgatactggaaagtacccgaatagaggctgtgacaataccttttgcacaacacaactcactacagtgcaccattcctagatcataatctccccctcaaaaccagaggcaatggactccccagcgacccccacggacttctcgccgcttcacagtctggtgccccgcaatgaatcatgctatacaaaaggtaaagccgttgcccacgctagcttgtggttggtacggtaaatgtttcacaacagtagctcgcgaaccggtccttaattgtcatgagcacaaccatcaaaaccatatgctcacaacccaccttaactaggttttaattatcaattaattaacatcacacgattaaccatcgtgaactaccatttaacataaccataattaataataataatataatttataattaatccctttagttagctaatgtttctaagcatggctaagcaaacatacatatagcatttagctgaaccaatccaatatataaggttcatgctaatcaaattataacccataggaaaataaagtcatcttcggccattaaataattgggaaaggttcaccacccgatgacattcgaaaataatgcatagttgaaataaaataatagctttaaacgggttcaacatgctcaaagggttgtttaggatctgtgtgacttgccttgcaataatcggtcttcaattagtcttgttgaacactttcgacgcactcacgaaccttcctcaacgaaaacgctctcctccggaacgtcggaaactaaagcgaaagaacaaaataaacaaaacagtaaaaaagaagcataaacagtatatgtggatatttttaacatgtagatctcgattttagatgaatttagcaacttgaaccactcgaatcggagttacgatgatttagttatgaatttccgaagttttaatctatttaatctattaaagaaaaactgaaaaagaggagatgatgacgtcatgatgacgtcatcgacggcagccacggcacgggtggcgacctcgccggagctagggtggtcggccggactaaccaagggcatctacacgtagaggacgacgacgcgatctcaacgatactcaccaacgtgacgaacgacgacggatgacggccggcggcgagcttgtgcggcggtggcgactcggtcgtcggcagcggcgactctccggtgaccggcgacggcgctacggttgacgagagagctcgggagatgggtcaaacgaaagagggcgactagggggtgctatttataggcttggattgaagagatcggctcaggaacggatggatttggtgaaagaagttaggatttatctgagttcacccgaatataaacggccaaaattcgtgagatatataacgaatttgatgggggtttcttcgggattaggtagaggagatagagaggaatccgtttttgcaatcaattttagaaggggatcaacggatgcaccggatttgatggaggaggaggcgacggcagcaggcacaggacggcagctcgggctctgcctggagctggaagacgacactgtagcgagagggaggtagattagactttttgggctgggccggaagggagcaacaaaggacttccaatttaataaattaatcaatgagatgatctttgaattgttaaaaatagttccaacgctcaaatgatttcaagaaaaatcttgaaaatacttggacactcaaagtatttaacaatattaaaatcagatcatttaatgattaatttaatatttaaataattgctgaactgctctttgtatgattaaaattaagagttgagctccaaaaaatccgagaaaattccagagaatataattaaccatggagaatttaataaaaattaaatccatccatgctttacatttaggaaattttatttcccacaattaacttcacttgtaaattaacgaacatttaatataaattctaataataatttattaaataatttataaatcctaagacgaaaatcaggatgtgacaaaccatcaaaaccacatgctcacaacccaccttaaccaggttttaattatcaattaattaacatcacacgattaaccatcgtgagctaccatttaatataaccataattaataatataatataatataatctatatttaacccctttaattagctaatgtttctaagcatggctaagcaaacatacatatagcatttagctgaaccaatccaatatataaggttcatgctaatcaagttataacccataagaaaataaagtcatcttcggccattaattaattgggaaaggttcaccacccgatgacattcgaaaataatgcatagttgaaataaaataatagctttaaacgggttcaacatgctcaaagggttgtttgggatctgtgtgacttgccttgggcttccacaaatgtttcggaaccttcctcaacggaaacactctcctccggaacgtcggaaactaaagcaattaaacaaaaatcaacaaaaccttacagaaacaagaataaacagtatatgtgaatatttttaacatgtagatctcaattttagaaaaatttagcaacttgaaccacctgaaacggatctacggttatttagttatgattttccgaagatttaatctattagaaaaacgggaaaaagaaaaagatgatgatgtcatgatgacatcatcaatggtggccggaccgagatggcgacctcgccggagattggatggtcggctgcgaacatggaggacatgtacacgtagaggacgacgagacgaacccaacggtacttaccctcgagccaaacgacgaacgacgacggccggcgacgagatgaacggcggcggcggctccggtcggcggtggcgagtaggctccggtggtcggcggctacgggggacgggcggccgggcttcccctcaccttggcgcacctattggcggcggctgcaagcagcggcgacaacgaaggcggcggcgcggcgctaccggagttggccggcggcggtggcgagctaggcggcggtggcggcggagctacggagcacgggaaggcttgggagacggggcaaacgaaagaggaggactaggggatcctatttatagccttggattgaagagatcggactcctcccgcaagaaatcaatccgggaaatcaaaaactcggttttagagataaactcgaaaacgagttcgattcggataaaatactcaacgattagctccgatttttcggggtaaagatagaggaggatgagaggatcaaaatcccacaaacaatcggactcggggaggccggattcgatgcggatttggaggggaaagggggcggctcgggtggcatggctgggctcggccgggcgactgctagaggttagggaagggtccgacatgtggggcccacatgtcggtctcccgagtggagggggcggctggcgggttgggttgggccggctcggcggctttgggctggcccgggcgcgcgggagggagaggagttgggccggaatcggcccaacgacttagggaagggatttttgaactttttaattaaaataatttgtgaaatgttgttccaattattaaaaatacttaccttactcaaataattgctagaaaattctagaaaatagaggaacaagtaaagtatttaataaaattttatctagctcatttttatgttgaaaattttcctagattattagagtttaacttgtaggcttttaaaataatttctaaaaatgatttaaaatatgcatttttaatttaggcgatttttagggcgtgacacctgacaaggtgtgtgggtgggggcctagagcggccatcccgctccctcctcccccccgagccggccctgactacatgggccttaacaggccacatggcatcttatcataatttctgggcttgatagtgacgaagatgaacgtcatagactgtatgacgacagaaggatcatcactatattaatgacaaaaagataagcattctttatagaacgccattagagacgcatgataggttgtcacgcccggaatttctatccaaaatttcaaacgcttacatgtgtgtaaaccctcgtcctggaatcagtcgaggcacacaataacaaattgataatagagcacaattattactctaattaataagcgaataaaatgtcattacagaggtaaatagttcctctcaatcaataaagttctaagcaacggaaaataaaagaaacagcgcaggcgactcctctccacaggcaacttgactagggctacgcctaatcatccacaccatcagcatcactgtagaactcctcctctgatgaaagattgcaaggtgagtatatgacatactcagcaagccacgcaataattatgcatgtgcacaggataacaaagcatggcatagtatagtctcaattgcttaaatagcatttaacaattatttcagaatttaataaaacagttaaataataattaaacaatattgatccaacgctatacaacataccccgttgcataggccaaccattctgaacaaccaatcccggctgcacagttctatctccaaaccaggaattaaccattccaaaccaggagctatcaagttattaacagcatcatttagtatggtgagaagtgtgagactaatcacgaaagacattgttagacccgcccataaccgcgggcacggctattcgaatagtttgaactctggccagaggtgtaccactgtacccacaagacacaacctcaacatcatgtcaaccatgcgtcgcgatacttgacaagtactcgaattgagattgtgacaataccctctatataatacaattcaaagcagtgcaccgttcccggatcataatcacccccttataaacaaggtatggactccccagcgacccccgtgggcttatctccgcaacttcacagtctggtgctctacaatgaaccgtactatacagaaagtaaagccgttgcccacgctggcttgtggttggcacggtaaatgtttcacaaccgaaactcgtgaaccggttcttaattgtcgtgagcacgaccatcaaaaccatgtgctcacaacccaccattatcaagttttagttggcaaattaattaattaaccaatcatgattaaccatcatgagctattattaaaccatcattaaataatagtgaagcataagttatcccagtagtgtgctaatgtttctaagcatggctaagcaattatgactaacatctagctgaaccatcatataaagctcaacttgtcaaattacattaacccaaggtatcaaagaataaagtaatcaagaacaaaagggccataataagcaataggttaattccacccaatgacattcgaaaataaatgcaatagttgaatagaaacaatagctttcaatgggatcaacatgctcgaagggttgtttgggatctgtgtgacttgccttgctggccttggaaatcctcaaagtcttctcctgcaaaattggactctcccggaacgtcggaatctaaagagaaaagaacaaaatcaccaaaacagcacataaacaagcatgaacagtatatgtggatatttttaacatgtagatctcaattttagaaaaaattagagacttgaaccaactaaatccgagctaagatgaattagttatgaattttcaaagattaaatcgatttaaatcatttatgtagattttaattgaattatgacgcaataattaattatttttgaaaaggaaaagggaattattgcatcagcgggtcgggtttacggtggaccgggtgcacggcggcggttcatgaaacggacggccgagatcgatccatccaaaatggacgaccgagatccatcggtccacggctagaccacgagggacgacgacgatgacgtcagtgacgacgtcaccactggcagcggcttgggcacacatgcttgccggcaaacgatggcacggcggcgcgaatggagggcaccgaaacgatgcgggcatcgctgcgaactcaccggtgaccaaagcgacggcggacgagcaacggacgacgtcggcgacgaggaaaaggcggcggcgaccttcggcttgacgacggcgacggcgttccggcggtcaacggtgacggagaaggtgcggacggagacagcaacgagacggcgatcacgacggtggccttcccgagtggtgacaacgaccggagcgacggcggcgacggcggctcaaggtctcacgcggaggcggcgctacatacggcggcgggctaagacgagagtggcgacgggtagaggggagctcgggggtcaatttataggggctagggagcggcggcgaaggcccacggcgaccggcgacgggaaggaaagtttagggttcggaggagagagatcgatccgaatcgaactcaaatccggcgatttccaaagcgatttagacgatgttttcaaaagggaaaaggtagagtggatcacggggatcctttcccctcaatcaatttcaccggaaacggaaaggggcggccggatttggaatggcggcggcggcgcagctcggctagggtttcggcaagaggaagacgacgactgacgggtgggactgtcacgcctaaaactcgtctaatttaaaaatgcgttgtttaaatcatttttataaattattttaaaagcctacaagttaaactctaattatctaggtaaattttcaacataaaaatgggctagataaaattttattaaatactttgcttgttcctctattttctagatttttctgggaattatttgagcaagggaagtattttaatatttggaacaacatttcacaaaatattttaattaaaaagttccaaaatccctccttaaagtcattgggccattttcggcccaacattttccctctccccgcggccaagccagcccaaaaccggcccaacccgtcgccgagccgccctcccctccccagccgccgacaggtgggacccacctgtcggggtggtcttccacctccggccgacctcaggccgagcccgagccgggcgcgccgcgccgtctcccgtctccgattccgcctcaatctctccacttttagtccggttttttgaggggtttttatcctctcatcctcctctatctttcccctcaagaatcggagcaaatcgttgagtattttgcccgaatcgagttcgtttcggatttatccccaaaaaccgagtttagattttcccggagcgatttcttgcgggaggagtctgatctcttcaatccaaggctataaataggaccccctagtcctcctctttcgtttgccccctctcccgcgatctcccgtgcctcgtagcgccgccgccacgtgctccaccccgccaccgtcgccggccatcctccatccgcgccgcgccgccgcctccgccgtcgccgccgcttgccgccgccgccacttggtgcgccaaggtgtggggaagcccggccgcacctcccccttcgccgccggccgccgtagctcaccgtcgccggtcatcccgagccgccgccgacgccccttcgtcgccggccgtcgtcggtcgtcgtttggcacgagggtgagtaccgttgggttcgtcgcgtcgtcctctacgtgtacatgccctccaatttcgcagccgaccatccaatctccggcgaggtcgccatcttggtccggccattgatgatgtcatcatgacgtcatcatcgttttttttctttttccctttttctaatagattaaatcttcggaaaatcatatctaaatatccatagatccgtttcaggtggttcaagttgctaaatttttctaaaatcaagatctacatgttaaaaatatccacatgtactgtttatgcttgtttttgtattgttttgttgattttagtatttttgctttagtttctaacgttccggaggagagcgtttcggtcgaggaaggttccgaagcgtttgcggaagctcaaggcaagtcacacagatcccaaacaaccctttgagcatgttgaacccgtttaaagctattattttatttcaactatgcattgttttcgaatgtcatcgggtggtgaacctttcccaattaattaatagccgaagatgattttattttcctatgcgttataatttgattagcatgaaccttatatattggattggttcagctaaatgctatatgtatatttgcttagccatgcttagaaacattagctaattaaaggggttaaatatagattatattatattattattattaattatggttatatttaatggtagctcacgatggttaatcgtgtgatattaattaattgataattaaaacctggttaaggtgggttgtgagcatatggttctgatggttgtgctcatgacaattaaggaccggttcgcgagctactgttgtgaaacatttaccgtgccaaccacaagccagcgtgggcaacgactttatcttttgtacagcatgattcattatagtgcgccagactgtgaagcggcgagaagtccgtgggggtcgatggggagtccattgcctctggtttgagggggagattatgatccaggaacggtgcattgtggtgagttgtgttgtgcgaggggtattgtcacagttcctttccgagataccgtggtggtactaaggcgcatggtaacatgttgtgggattgtgtcttgtgggtacagtggtacacctctgatcagagtttaatctattcgaatagccgtacccgcggttatgggtgagttgaacaatgtttttcgtgaatagtctcacattattcattaatggtaaatgtgttaattaatttgactcctggtttggaatggtatattcctggtttggaagtttggtttgttcaaccggggttggttgttcatatgaggttgggcctatgcaacacgggtgtgttgtatggtgtttatttaatattgattaattatccaactgttttattattctcttaaatatttattaaatgctgtttatgcaaatgagctatattatgccatcctttgttatcctgtgcacttgcatatttgctgtgtggcttgttgagtatgtgatatgcttattcttgcaatattcaatcatcagaagaggagtatctcagcgaaggtgatgatctggaggattaagcttgttcttggttaagatgcctgtggagtggaatcgccatagctgttccgtagtttgttttagttttaatttccgctgcgtagaatgttattctttgagaggaactatccacctctgtaattatttattatttgtgaatattaaatagttatttatttgtattctattatcaacttgttattgtgtgcctcggctgattcctggacgagggtttaacacacatgtaagtgtttggaattttggatagaaattccgggcgtgacagggacccacctgtcagcggcggtcgcacgcgcgcgcgcgggcggcgctcggcttgggctgacttgggccaagggagagagagagagagcggtttcgtcccaaaaccaaaagggaattttaaaaacctttttccatttaaattattcattaaatgaaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaaacctacaccccttaaacggaatctcgtcctcgagattcggaagaactggcgaacaaatgcggatgagttggctttaattcatcttctcgttcccaagttgattcttcttccgagtgattactccattgaactttacagaaacagataactcgattcctggttcttctctcatttgtttccaaaatacggattggtttctcaacatatgttagatcctcttggacttcaatctattcaagatttgcttcttcggtaggtacccttaaacactttttcaactgtgacacatgaaacacattatggacacctgctaaggattgaggtaattctaactgataagcgacctctcctcttctactgacaatcttgtaaggtcccgcgaaacgtggtgccaattttcctttggtgtgaaagcgatgaactcctcgaagaggcgtgacacgaaggtacacataatctccttcttcaaaacttagatctctgcggcgattgtcggcataactcttgtgacgagactgagccacacgcaatctttcttgaatgattttaaccttttcttctgcttccctcaggatatccgtcccgaaaacctgacgttctcctgtttgatcccacaaaagcggagtgcggcacttccgaccatacagtgcttcgtaaggagccatctggagactagcttgataactgttgttgtacgagaattctgcgtaaggcaaattcttatcccaacttccaccgaagtctaaaacacaagctctcaacatgtcttccaaaatctgatttaccctttcggtctgcccatctgtctgcggatgataagcggtactaaaattcagcttggaacccatctcctcctggagcttcttccagaattttgaagtaaattggctacctctatctgacacgatcttcttaggaacaccatgcaaacacacaatcctggccatatataattccgctaaacgacttccggaataggtggtccttaccgggatgaaatgagccactttggtaagtctgtcgactatcacccaaatagagtcatggcccaatgatgttctgggtagaccggtgatgaaatccataccgatttcctcccacttccattctggtatcttcaaaggctgcagcaaacctgcgggttttctgatgttctgccttgactcgctgacaaacgtcacataccgctacatattctgcgatctcacgcttcatacttgcccaccaaaatctttccttgagatcctggtacatcttagtactaccagggtgaatggagtataacatatcatgggcttcctttagaattgcatctttcaaatctttgttgtctgggacacagattctctcacccaaccatacagttccttgctcatcttccaagaaaccgatagctttacctcttttcatattctttttgatctcatggatatcgggatcattgatttgagcttctctgatgtcacgccctaaaaatcgcctaatttaaaaatacattgtttaagtcatttttagaaattaaattaaaagcctacaagctaaaccctaataatctaggaaaattttcaacataaaaatgagctagataaaattttattaaatactttgcttgttcctctatttctagaattttctgggaattatttgagcaagggaagtatttttaataattgaaacaacatttcacaaattattttattgaaaaagttccaaaaacccctccttaagttgttgggctgtttttggcccaactctccctctctcacccgcggccaagccggaccagccggcccagccagcccgccagccacccctccactcgggagaccgacatgtgggccccacatgtcggacccttccctaacctcaggccggctgcaagccgagcccaagccggccgcgccacgccgcctcccgctccaaatccgcacccaatccggccctttttcttctgattgtttaggggtttttatcctctcatcctcctctatctttacccccaaaaatcggagcaaaccgttgagtattttatccgaatcaaactcgtttttgagtttatctccaaaaccgagtttttgttttctcgggccgatttcttgcgggaggagtccgatctcttcaatcaaagtctatatataggaccccctagtccccctctttcgtttgccccatctcccgagctttcccgtgcctcgtagccgccgcgccgccgccgtttagctcaccgtcgccgccgacgactccatccgcgccgcgccgccgcctccgtcgtcgccgccggtcgccgccaccactgttaggtgcgcgggagcgaggagaagcccggccgcccgtccctcgaagccgccgaccgccggtgctccgccgccaccgccgaccgagccgccgccgccacccacctcgtcgccggccgtcgtcggttgtcgttagccgtgttggtgagcaccgttgcggtcgtctcgtcgttctcgacgtgtgcatgccttccaaatccgcagccggccgctctagctccggcgagcttgccatccgagccggccaccattgatgatgtcatcatgacatcatcggtttttctttttcccgattttctaatagattaaatcttcggaaaatcataactaaataaccgtagatccgtttcaagtggttcaagttgctaaatttttctaaaatcaagatctacatgttaaaaatatccacatgtactgtttatgcttgtttttgtactgttgtgttgatttttgtttaattgctttagtttccgacgttccggaggagtgcgtttctgttgaggaatattccgaagcgtttgtggaagcccaaggcaagtcacacagatctcaaacaaccctttgagcatgttgaacccgtttaaagctattattttatttcaactatgcattgttttcgaatgtcatcgggtggtgaacctttcccaattaattaatggcctacgatgactttattttcctataggttataatttgattagcatgaaccttatatattggattggttcagccaaatgctatatgtatgtttgcttagccatgcttagacacattagctaactaaagggattaattatatactatattatattatattgttattattaatgatggttatattaaatggtagctcacgatggttaaacgtgtgatgttaattaattgataattgaaacctggataaagtgggttgtgagcatatggttttgatggttgtgctcatgacaattaaggaccggttcgcgagctactgttgtgaaacatttaccgtgccaaccacaagccagcgtgggcaacggctatatctttcgtatagcatgattcattatagtgcgccagactgtgaagtggcgagaagtccgtgggggtcgcaagggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacagtggtacacctctgatcaaagtttaatctattcgaatagccgtacccgcggttatgggtgagttgagcaatgtttttcgtgattagtctcatattacacattaaatggtaacggtggtaattaatgtgactcctggtttggaatggtatattcctggtttggaggtttaatttgttcaactggggtaggttgttcaaatgtggttgggcctatgcaacacgggtgtgttgtatggtgtttatttaatattgattaattatacaactattttactattctcttaaatttttattaaatgctgtttatgcaaataagctatattatgccatcctttgttgtcctgtgcacttgcatatttgctgtgtggcttgttgagtatgtcatatgctcattcttgcaatattcaatcatcagaggaggagtatctcagcgaaggtgatgtcctggaggattaagcttgttcttggttaagatgcctgtggagtggagttgccatagctgtttcgtagtttgctttagttttattttccgctgcgtagtatgttattctttgagaggaactatttacctctgtaataatttattatttgcgaatattaaatagttatttatttgtactctattatcaatttattattgtgtgcctcggctgattcctggacgagggtttaacacacatgtaagcgtttggaattttggatagaaattccgggcgtgacatctgacttgatcaatgagagtaggcttcgcatctaaagctgcaacaaagcctctactgacaattcccagattcaatctttcaaattccttgcacaattccaatggcaactgtcatccttccatagcattacaatagcctttcctactaagggcatctgctacgacattagcctttcccgggtgataattgtcacaccctgaagttctcctcccaagcctaaaattttatttataaatgaccctaagaaaatgccggtgcaaagcatgagaaaaccctaagaaagtaatacaaataataatcgaatctggcatgtggaatttttcttgagttctacatgtctaaattcgctaacaagttttttagtggaattttcagagccctagaaataattttaaccaattaaaattgagcaagcaatattttaattccagggaaaatccttttctttctttttctttttctttttccccttcccttttcgaatgggccgccggcccattctctccttttccccctcccagctgggccggccgcaggccgaggcccagccaggccgccccgcctccctcctctcccggggtcgccgacaggtggggcccacctgtcgggtccttccccaacctccggccgcccctccacgtcaccgccgccgccgaaaccgccgccccgcctcctccgggccacttcggccacgccgcgcgtgcccccgccttccccgctcccacccctctctctcccgcccgcgccctcaaccgagatgggtgggattcgttttttgaatcccgccactctctctctttctctccacctcccacctcccacgtcgccggcgaaatcgggcgtgctcgggccgttcccgaccttccagcccctataaaatccatccccgagccctcctcgtttttccttttgccgcccctctctcccgagctctccatcgcccccgcgccgtgcaaccactcgccatcgccgctcccgctactccggccgccgctagccgcgctagggtcgccgccgcaccgcgccgccgtcgccgtcgggttcgcgaggccgaactccacctcgtccgccccttccccgtcgagattcgtcgccggaatccgcatcccctcgcgctccggtgagctctacctctactgccgccttcggccatggatgccggccgccgtggttcatctccctccctctaatctctctctcttgcttccttagggcatcccgaagctcgtccgcccgtcgccgccgtcttcccgtggctcgccatcgccgttagccatcgtctccctccgcgccggccactcgcggtgaggcatccctcccctcttttccccttcctctccctcctagtgccgcgccgccgcttcaagtcatgcgccgtcgccttcggccgccgccgccgcctcccgtgccgccgttcgccgtcgccgtcggccgcgtgccgtcgccactagccatggctggccgaccggctttgatgccgagccgagctcggcggccgcctctaccgccaccgcccgatcggctcagggccgatctgggccgtcggtcccgtggaccggcggtggaccacccgcgtgatcccggtccacattggaccgccccccttgagccactgccgagtggggcccgtgtgccggcgcccttccccctctctcgcgagccaccgaccggtgggacccgcctgtcggcgccgccccccccttgatgacgtcagccctgggaattattgcccaataaattatttaaggcctttttgttatagtaataaacacagtgaatcttctgaaattcataactaattcatccgagctccgtttaagccccttcaagtctcagtaaatcaagaaaaatgtgtagaatccattaaaaatggttttgttctctgtttcagtagacttatagcctgtttgcattgtttgccttgtatgtcgttagattccggctcttccgacgctccggcgtacttcgaaatagtcgccgaggttcctccagcagcagagcaaggcaagtcatgcttgtcacttgatcatgttgatcctacattgcaaatgttctattgttttccttcaaatagtgcatttgttttgcaataacactatgggatgtttacctattgttacagccatgctattttggtaccttgctcctttgttagcttgggttatgacatgaatagactttggactaggaattgcttagccatgcttagttcaactagcacacaatggggaaaactcatttaaaatatagactgtaggtttatatgataatgttggattaatcccaccgctctggtgttggttaattaaaatgaatcacatggtgggctatggttgcatggttttgctagtcgcgcccatggcaattaaggaccggttcgcgggaaaccctggaagaactcctcgtacttaccacaagccagcgtgggcaacggctgggcttgtagtgtagcttttctctagctgacgcatccaggcaagggtgagcttgatggagtggggcgggccctgcgacggcctctgtcgcttccggattcacctaggcacgagaggcgactgcccgtcgcctgctggggacgggggtgaaacctggggtgtggtgtgcttggctagagaggggttatgcgaagggtcatgtcacagtctctttccgatatgtcgtggtggcatgtcggcgcatggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacgtggtgtaacgttggatagtggatgattaatatcgtttaattattacaactattttcgcattcgacttctatttataaatgccagtattatgcaaatgaacctgtatagctatcccttgttgaatccctgcatcatacccccattccggtatgacttgctgagtacagtggatagtactcagtcttgctttattttcccccaaccccagagtgtgagtatgtgtctgatggcgggttctccgaggagtaggcttcgtccgtgccgtcaaggatgcctgtggagtggtgttctcgctgcagttccagtcaaggattagctcctgttatctttctttttccgctgcatttatgtaagacttttataatgtttgtaagacgtggatctgtatgtcaacattgtcgtttgtgtgccccggccggtcctggacgggggttttaatgcacattctgcttggaattctattcgggaatttctgggcgtgacaagttggtatcagagccgaccttgaccgtaggacaagccaaatggaaacctaagggccctctgaatccttttcattgcatatgttctttgcaattggaattgttccgggaaaatttggggatctgttcttgtggttcaagggacaaatcttgttgctcgtttaagtgagatttgttaagacaagtaggtctagggttttagtaaaattatttgagatgtttttgaccgttagttgggatttgatgggcgaaatgcattaggtcttagctcaggaatatgggttgtaaggtatttatgcttttcttgttattataagtatgtatctaatttccccattattttatcgctatgtaagtccgtcttatttattcgctctcatgcaaaataatctatgcataaaatttcgctcttattcgattctcttatttgagtcctttatttttatttaaattggatttgagcatgcattgatcctacccctttgtcttctctagatggccgagcacccacccaaccaccgcggagaaggcatgggtgatttcgtggcagagttggcacgcatgacactggtggtgggctaccccaacgcgccggagtacacgactgttccaccgctcagtggcgagcttcctcaccgtgtccgcttggaggtccatggctacatggggacttgcctcgctaaaatggtggttgaggcgtctggaggcacagcagatcacgcatgtcaggaggcagcatatctgatgatggccagactacgggagcgccacaactacatcttccacgacacggcgtaccggttccaccctcgtcgagccagcggcagtgatgtcagttccttccgtccgacagccggcgagaacgacaccacctttggtcacatgtgcgctgtgatgagggggatggacaggatgcactcggacctgcacaaggcgtccaaggccttgaatgatgggaagcttgtgaggatcattgctctgaaggacgagatagcgcgtctgaagagggagaatgctcaattgaagggtcttcccgcgccaggaggagttcggatccgcactacgccccgcaagtcgacaacggcacccgtgcgcgtccagcttgcgcctaggaacccacctccgtcagcagctcccgcagctccagcagttcccgcagcacctccagttccgcccgcagctccagcagttcctgcagctccagcgccagctccagctcctgttcccatgtcagctcctgcatctgctctctccttcgctcctgcatcagccgtcaggggccccgccagtggaaatggaggttggttgccagctactcccagtggcaaccgcgaccacagcagcagcagctccagtggctcagagccgggcagcggcgagacttatctgccaggctccaggagtcgctcagaaggacgtggtgacgagcaggaggacgccttcgactccaccgaccgcaggagccgttccgagcattaggctggttttccattagcttatcgactgcctagcttctgcttgttagtttgtgtgtttaggttgcttgcttggggtcagtcgacagtcgatatcatgtgcctatgatatggctgtcctaataaggatttttgcttgctgtttaaagtgttttaattcagatcagaacaattgcagtttaaatttctataataaagcttagttcctgagtaactgtttttctccgtttccccgtctgctcttcctccagatggtctacaccaggaatggcacccgcacgacaagcgagggcagcaacggcgaagaacgcgctgatggtgtgcaccccaacagtgattccggcaatggtccgccaccatttcccgagaatctgacgctggcccaagtaatggcacatcagactcagatgatggcagccatgatgcagcagatgcagcagcagcaccagcagatgcaccagaggatgctgcagcacgccgaacagcagcaccagcagtttggtccccctcctcctcagtccaagctgcccgagtttctacgcgtcaggccacccaccttctccagcaccaccaaccccatggaggcgaatgactggctccatgccatagagaagaagctgaatctcctgcagtgcaatgatcaggagaaggtcgctttcgccacacaccagcttcaaggtcctgcgtcagcttggtgggacaatcacgtggccacccgcccgccaggcactgaagtcacttgggcggagttctgtcgtagcttcaggaaggcgcaggtgccagacggggtcgtggcacaaaagaagaggggattccgggcactccatcagggcaacaggacagtgacagagtacctccatgagttcaatcgcctcgcgcgatatgcaccggaggatgtctgcaccgacgccgagaagcaggagaaattcctagcaggcctggatgatgagctaaccaaccagctgatatctggagactatgccgactttgaaaggttggttgacaaggcaatccgtcaggaggatcagcgcaacaaaatggacaggaagagaaaggcggcacagttccggtccaaccaaggaaaccatcagcgaccgcgcttcactctcggacagcagggtggacctaccaccatgatcgtccgccagcaccgcacgttcaagtctagcaacttccaccagggcgccagtggcagtcagaaccaccatggaggtcagcctaaccacggtgcagctccacacccaccagtggcaccagcacagtcaggcccgtccgcgcaagccaaggagactggagcaaagccagggtcctgcttcaactgtggtgagcttggccacttcgccgacaaatgcccgaagcctaggcgtgccgggtcaaagtttgtccaggctcgtgtcaaccacgcgtctgcaaaggaggcgcaagcagcaccagaggtcgtactgggtacgtttcctgttaactcaatccctgcaacagtactttttgattctggtgcaacgcattcgttcatttcaaagaagtttgtcaggatgcatgggttaataagagaggaacttagcacaccaatgcgggttcataccccagggaatagctccacttcggtacaattcagcccttctataacaatagaaattcaaagatcaccatttctagccaacatcattcttcttgattccaaagacctagatgtcattcttgggatggattggctgaccaagtttaagggagtcattgattgtgcgaatcgcacagtcaccttgactaacgagaagggagaaacaatagtgtataaatcactagtctcaccaaagcaaggggtctccttgaatcagattgaggcggaaaccccagtggtcaccgaggggatgaattcgaggaaattggaagaaattcccatagtctgcgagtacccagaagtgtttcccaaagacctcaccaccatgccacccaagagagagattgaattccggattgatttggccccgggaaccgccccaatctacaagagaccgtataggatggcagccaatgaactagccgaggtcaagaaacaggttgatgagcagctgcagaaagggtacatacgaccaagtacctcaccttggggtgctccggtcatttttgtggagaaaaaggataagacgaagaggatgtgcgtcgattatcgcgcactcaacgaggtcacaatcaagaataaataccctttaccacgaatcgatgacttgtttgaccaactgaagggagctaaggtgttctctaagatagacctgcgatcaggctatcaccagttaagaattcgggaagaagatattccaaagacggctttcaccacccggtacgggctgcatgagtgcacggttatgtctttcggacttaccaacgcacccgcattcttcatgaatctgatgaacaaagtgttcatggaatttctcgacaagtttgtggtggttttcatcgacgacatacttatctattcaaagtctgaagaagaacatgagcagcatctccgtctggtactcgagaagttgaaggagcaccaattatacgccaagttcagcaagtgtgacttctggttgacggaagtcaaatttctgggccatgttagacttctggttgacggaagtcaaatttctaggccatgttattatagctcagggcatggcagttgatccatcgaacgtggagtcagttaccaaatggaccccaccgaagaccgtgtcgcagattcgaagttttcttagactggcgggttattaccgccaattcatcgaaaacttctccaggatcgctcgacccatgactcagttgcttaagaaagatgaaaagtttaaatggacagctgagtgcgataagagctttgaggagctcaaaaagaaattagtatccgccccagttctgattctgcccgaccagatgaaagatttccaggtctattgcgacgcatctcgccacgggcttgggtgtgttctaatgcaggaaggcagagtggtagcgtatgcctcgcgatagtcgcgtccacacgaagggaattatccaacccatgatctggaattggcagcagtggttcatgctttgaagatctggaggcactatctgattggcaaccgctgtgaagtatatacggatcataagagtctgaaatacatcttcacccaaccggatctaaatctccgacaacgaagatggttggaactaatcaaagactatgacatgagcattcactaccacccggggaaagccaatgtggtggcagacgcattaagcaggaaaagttactgcactgctctatgcatcgagggcatgtgtgaggaattgcagcaagagtttaagcggctcaacgtgggaattgttgaacacgggttcatagctgttggcggatggcatgagtcccttcgaccgaatctgccgaaacccatggcgaagaccacgagccaaggatgatgcgaggcgaagggtcgcgtgagtgcatgccgaagaaggacgacttcgccaggaccggttcgccccggcatccagcccagagaaggacgacttcgccaggaccggttcgcccccgcgagggccgaagtagccttctcggcccaccaagcttagaggccatagggccggcgatcgcccgatggcccatcaagggcccatgagcccccttgacgttatgtaaccctgtaaacgtccctttcataagggcaactatgtaaattcctcaatacaaactagaccctagaagtgagaatctgtaacggggctataaatagcccccaagggccatgtaataaagagagagaaatccaagaaatcaatatacttcgtttctttccaaccaaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccgggaaggggcttatttataccaagcattccttttatggctagatccaaccttctggtccctgcggaaaggaaaaagaatttcacgttcttcctttcaggaagggaggattagggaagtcctattgattgctgctttcttcagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacggggggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 74929 - DNA, 21874 bp, Oryza sativa
gtccctgtccaagaaaatcatttctgtagtagtgattcatgaagttccttctctacttgatcgatccattttctttgtttcttttttggcatagatcgaacacttggtggtgcgctcatcggcgttcccagtgtccagagcgccaccatcgccccactttgtcattcccgtcgactcgaatcatctccggctgtactattgcgccactgacgtcgcctaggtcccaggagaacgacgcccacatatgatcaagccaatacgccgccacgaacgccgtcggtcgccgttgctctcctgctgcctctgcttctcttgccgccgagtcaccgacatgtgggcctggctgtttagccacttcattaggtgctaaggactttaattagtagaaatttaaatcttgtaaggttctttttgtaaaattgctttgtttgccatgtggacttatggacctaaatgcaattcacctaatgcccagggacttttttgtatagggtttagggcttaccctaaaacatgaaattactatttcatgcattcattacttgatataatagcttaatgagtatattgtactcacccttgctttaaccccctctttcagaatcaatttggagtttttgccgaagccaggagtttaatcagataaattggtttcattccaacttagttcccaagtatagattagatagatggtttaattctatagcaaaacattagacttggctcatcctatagcttctacagtaatagttagccactaccctattatttcatgtaaagaaatctcctttggagccttaatcaaatgtatgcgatgaagattcagattgttgaacctgtatcaatctactaatacaggggttgatacagtttaaatatgtcggttaccgaatctttaattttgggacccgacatggtgtgtgggtgggggcccctgcgatttgggagcctagagcggccgtaccgcttgcgccccctcccccctgaggcggccctaactacatgggccttaaaaggccaaatggcatcttatgacgaattctgggcttgatggcgacgaaaatggatgccatagactctatgacgacagaaagatcgtcactagattaatgacaaaaagataagctttctttatagaacgccattagagacgcatgacaggtgacgaatcatattcgtcacacgaatgtcacagatttcatagcatgacttgaaattaaatttttatgacgtaaatgagcgtcacctatcataagattcttgtagtgatggcttgtttggctattagagaggcagtttgagacatacagcacacagtttcataccgtgtgcgtgcctagttggcaactggatcctagtagatgcaaattttgaatcattcaacccaacccaatccttcttctcttaatcttctcttcctacacttgttttgtgtttgtgtgtgtgtgtgtctaagaggctagtagagttagctatcctaaaattttttgcacgttgcagctacaaactgtgctgctggcttggtcgtcctctgcttcaacattaaagagggagctaatagatcggtgattcactttggtttcttggatgctatccagccacgtcaccatgcatgcgaattttgtggatggagtcagagggtctgcatgcacggagctgatttaattaattaacttgttgccagctagtacctaattaagcatgtgtgttaatttattattaattactttgctagtgttaatttatccttagtttttttattcgaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatgctgcttcacgtggtcggaactatatacgttaagatcaaatgtgctcaacgtggtctggcacatcatggaccatgctgcttcatgtggtcggatctagatgcattaggaataatcctttttgtagtagtgaaactaaagaacttcacttgccaactacttcctctatttcacaatgtaagtcattctagcatttctcacattcatattgttcctaatgaatctagatagatatatatgtttaaatttattagcattaatatgaatatgggaaatgctagaatgatttacattgtgaaacggagggagtagtttttttagagtctgaacaaagatgaaactttttggaaaggtgctcctgatgaccaagttcaattcaccaactgaaatcgcacactggatttacatgaaaaatgcgagatagacaaaaatgatttctttcggttctaaattaatactcccggccatttgggaggagcaatatgtacatatgcattcatcacacttcagcttttttgtctttttttttccttggagttttaagaatgctcataattagggcatgcaagttgatccattgatatattcgcaatatttgacgatttttttttcattttaaaaattgttgacgatattagcttaattttggtatggaaaatatcggttaatttatccccaatttttatcaagagagaaaatgaaccatgagagttggggtgctaattaaccacaagcagatattcattttaatttgtggtatatatatatatatatatatacacgagcatgcatgtaaggatggaaatatgtgaaaaatataatggtgctagtagatttgtctaaaacacttccataatactatgatcaggacactcgataaggacaaagttcaattttagggattgtgtcattatcaaaattatcaatgaataattggccatagggccgggattagcaagggtctactactgtcctgccatttcattaattaattagattaagtccccgattccttgcatcccaaattggcctacgagaaccgacaaaaatcgcaagatgggaggattgtggtaggttatcttcaccaactgtgcctctcaagtggccataacatattagccagaaggataaataatcatcaatctgccttcacagttttgatcatctcatgagacatatatataaaccacccattagcaagagtctcctaggtgaattaattaactatgttgatacacatatacttaattggtataagaaaaattagtggtcgttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagcaagagtgcgtacgtttatagtagaactgagggggtgcgccttatatacaccggacgagcaacagtgcgtacgtttgtagtgacgtctccaattttagtttctatggtagtaaaatattcgacgtttgacacctcaaactgcagaaaaactggagctgtgaaatgttttcttttttcatatgcgtggagctctaaaatattgacagttttgtttttttctataaaaaaagccaagaagagttaacgacttgatgggtaggcgctcctggatggagggagatgagcttaaaaagttgtagtaaatggacccatgcagtggaaatgcggaatggagtggagcagtaataaaatttaaaatgccacgcgcagggcatctcgaccacgacaggactctccttgagatcttcaaacagtgtgtgcttgctagctgaactgcagcagtggaacagtaataaaatttaaaacggatgtacagtgttcacagtggacgagtgtgctctgtgttctctgcatgtgaatagatatggcgatctctgcttgtgaatagatttggcgagtactattactgggtatacgtggttaggacagatgttagtttgttctgcttgtttggagatggatttgggagcaaatgtacatggttagggcgcaaatgttagtttattttgctgtggaggggagtgggttttgctagaagtagacccatgaattttgctattccaaaattcctcaactagctatcagcctcatcgtttggcatattttctgaatatgccaaacggcatatttgcaaacgaaaatcaatttgtgaataaaacttttatatatgtgttcttagcgatctaaaagcaaagggtgaaaaataaacttcgatgaaaaaaacctcaaaatcagctccaaatttaatgttaaaaaaaatcaaattttggctgataagcatatgaatatgccaaacgatgaggccctatatatctagctccaacaaatctgtgatgcctatatctcactagtcttgctatgtgctatgtcatgtacacgtgggtaaatacctaatttatgaattttgctgtctcatcatgattatggcaaatatacatatacctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctagaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttctgcctatatataggagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgactttaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaatttctcttgctgcttttaataaggccatagcactatccaatgtatcatctgttggtctctgaccttagcaatttattgcaacatgattattattatttgtgtgtgcatgttctttacttaatttattcttagcggatttctgatgtttttgtgagttttagactatgggagataattaagattgtcatgccaaagagtattccgaatcctactaggaaggcatagggtggggggggaggaaacatggtcaatttctcggctgctatcacattccttgttttcttagtcttgggagacttatagccatactaaaggcaatacagtcgaggaatgacaaccttactcacaaggacaaatagtcattaaaaaattatgacagcactaaccatatctgatttcagttcacgaaacatacatttaaatttaggcagtattacggagaactaaatcgacaaacaacaaaccatacttcattgtcaaaacaaattgccttcaatgtactttacaaattctcacaagatcatatttgcaatttttcctaaactaattaaccaagagcaaatatgcaatggagaattccacatataatttcacagcataactacataatacaatatggtataatacacatatgcatactagggcctacggcaaaagaggaaaagatcaatgcgcatgctaacttgtgtataatacagatatgcgcagtactttgaaatatgcataccaggacatatgctttagttcactccattcattcttgcactcttgcacattcaacatcaatcagatctaccaagcattcttgcacattcaagcacaagcagatctaccaatgaatcactaacttatgtagcaatggggggaatcggaggagaattaaaacctttcctcgtcagacgactgaaggacaggaggcggcggaagattcactggctgcacaccatgccgcgcgaatccctgaggtgtgggcatcgcatctatcagcaccaacgacatcggcagtggcaggggtggactagggctctttcgtagaccgatgtaaactagacttattggcttcgatttagggaggggagggaaaagagatagactttacccggctggcctttgggcctgcgtggagagggataggagttggcttggtttcagccaaaagataggaagaggattttaaataggttgcatatgcatgctttgtctaaagaaaattcctaaaaataaatgaatcagcaataaatcctaccaaaattcccataaatactaaacaacaccctaagctcccagcaattttagtttgaatttatcacatcaattgataacccaaataaatccttcaacacagctaaaaatctggaaacagcataccaattagcctactttgcaccttcaccgaaattaaaccataaatcctcttgcaaaatctcaaggtcagaatgttaaacatactttactctaccatctggtgcaatggcttagtctaattcgaaatgtaaccacatgaaatgagagccataaattacgtaaactttggaacttggcaccttgaaccatcaaatccttgtctaccttgccgtctccctgtcccccacacccccccttaattctaaattaaatgtatgagagaaagagagtaatatagtttggtgtgatagtgccaacacatggaaaatttagagcttctagttctctccttctacatctctcttaaatgtgggaccaaatccttgtggggcccacatatcatacaaccatagccaacacatcatctgctcttctctcatttaaattttcttttatttctcaaaaggttagagatgggtttaaattcaatttccactcaaaatgccactctaccactccaagccttttaggaaagatctatatatgggcccatttgtcgtccaaacacagcaaccaaccttggtgaatcatctctttgatcctaaattattttttcaaagagagaaagaaagagagagagggagttaaagtccaatttacacccaaacttcaccatacctctcatcttctcattggaaacatctacatgggaccactacacagccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggaacaccaccacgggaaaaaaaaacctgaaaaaacataaattttctttaaacatgaaaccctagaatctggtggtggcgccgccgctcttgcttgccgctgccgcctcctcgtcaacatcatcatcgtcagtggcggcctccgcgccgctcgccttggatccgtgctcccctccggccgcaccgccgccgacgcccctcccctccgccggatctagggagggaaggaagaggaggggaggggagctggatgccatgcggggggagggcgcccggccgccggatccgtgcggggacgaccgccaccactggatttttgcgttgatggccgccgccgctggatccgtgcagggacggccgccgcccgccggatcccacgcccaccaccgccaccacgtggaggaggccggcgcgtgcctatgcccaccgtggctgtcgccgcgcgccgccgccgctgccgccatcaggaggagaggagaggagagtggagagaggagaggagagtggagagaggagaggagaagcgtgagagagagaggactgagagaagaagctctgcgtggaaattttaaagttgaaaaggggattgaggggaggggagaggagagaaagaggggaaattttaaagtgggtcagtgggaaaagagggagttagtattttgcatgcggctctcttaataggtctgcacgggaaaattggctcattttcacgtacggtccatttaagagaaccgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactatgaacctcatctatttctcatagtgttccactatgcaaaccaccaaaaactacctcggaatctccaagaacttccacttactcttttcacccgaaggagtttcatccatgtcacgtattctctggtgagcttcaccgcactccaaccacgggaacatgaagttccttctctacctaatcaatccattttctttgtttctattttggcatagatcgaacacttggtggtatgctcgtcagcgttcccggtgtccagagcgccgccatcgccccacttcgtcgttcccatcgactcgaaccatccctggctgagccattgcgccaccgacgtcgcctaggtcccaggagaaagacgccaaaatatgatcaagccaatacgccgccgcgaatgccatcggtcgccgttgccctcctattgcctctgctccccagcaaccaagtcaccgacatgtgggccccggctatttagccacttcattaggcgtaaggtctttcattactagaaatttaaatcttgtaaggttctttttgtaaaattgctttgtatgccaagtgggcctatggacctaaatgcaattcacctaatgccaatggacctttttgtatagggtttagggtaggtcctaaaccctacatagaaattactatttcatgcattcattacttgatataatagcttgataagtatgttgtactcagccttgctttaaccctctctttgagaatcaatttggagtttttgctgaaaccgtgagtttaaacatataaattagtttcattccaacttagttcccaagtatagattagatagatggtttaattctatagcaaaacattagagttggctcatcctatagcttctacagtaatagatagccacaatcttgtaaataccctattattttatgtaaagaaatctcctttggagccttgatcaaatgtatgctatgaagattcagattgttaaacctgtatcaatctactgatccagggcttgatacagtttaaacatgtcgattaccgaatctttaattttgggacctgacaaggtgtgtgggtgggcgcctagagcggccatcccgctccccccccccccccgagccggccctgactacatgggccttaacaggccacatggcatcttatcatgatttctgggcttgatggtgacgaaaatggacgtcatagactgtatgacgacagaaggatcatcactagattaatgacgaaaagataagcattctttatataacgccattagagacgcatgataggtgataatatatatatatatatatatatatatatatatatatatatatatatatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatctaaacatataattagttaggtatgtaataatggattgtgaaataaagttaaatttgagttgttttgttgctaggtataggtatgaatcgaatacttataactaggtatatactcacaatttaaaaattttgaaaaatttgggcgaatttatgtatttcataccatggtgcccgggcaccatggtgccccatatgagtgtcctatatatatatatatatatatatatatatatatatagtaaatttgtttggtgctccatggtgcccgggcaccattgttgaaattgagtatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatagattgtgaaataaagttaaatttgagttgttttgttgctaggtataggtatgaatcgaatacttataactaggtatatactcacaatttaaaaattttgaaaaatttgggcaaatttgtgtatttcataccatggtgcccgggcaccatggtgccccatatgagtgtcctatatatatatatatatatatatatatatatatatatatatatatatatatatatatgcctgcactttcatacacccaggtgtatgtacacccttttattaatggatgatccattagcattcaatttagctgtgaaaaaaattaataatattaatttccaaatgactgcatgcatgtggcatagctgcacaccggattgggtgcaaatttgaacaagatcgtgggcatgcatttggtttcaaatttgataacgtaccttagatatccccaccttttctagtatgcaacagtatatactgttttttaagccgcagtatatatactctttgaagcgatgagcagtactatatactagttttttgtgtattagcggtacataataaggagtaccttacatttttgttgtagcagtgaatatttctttttttaattagcagccgtatatactgatgcggacatcactacttcggatacacacaacaatcctccaacggtcattcaaggaccgataacaagagctcgtgcgcgacaattaaatttagagctgagttcgttcctatgttcttctttgtatgaattcgagaatagaggggaacaatggaggggacaaggagacacttggagaaggacttagagccatggaggaccattggggacgtccaagtcaaggtggaggcccaaaccaagtcgacgtctggtgcaattcggagtctaggaccagtctgcactaaaacgggcgcccaggtcgtatacgtgttcgaattggggcgttctttatatggatggaaagctaagaagatatcctttccaatggttttggtcccacgtccaaattctttctgagtcaacgggaattgaccgaacaacttaacgtccagaatctgtcccggtgctgcgtcaccgtatttgggcctttggcccgtgtatcgtattggaacccattagggttgcgtcgagaggggtttgcacgaccctaaactatatatatcagtacccgccgtcatctttaggtttttgggttttgcttagattaatctgtcaagaacagtttcgccgctagattggtttgtaagaccccaactcgtgagcttaatcattcatctgcaattttggttgtttttctatcttgttcttgtttgtgttcttcgattggcaaacagggattagccttctcggcgaggtcatccgcattttgacacgggtgataaccagaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgtcttccgctgtttctcgtttgtctttttgtgtgctgggccttcgctgcccgtgtaataaattaactatttacgcttccgcttgttaaactctgaattgtatcaacttttggtgtaccttgcctcctgggacaaggattaatgcacgcacgtaaggaacgcccgttgggttatttccggtcgtgacagcaacagtatatactgttttttaagccgcagtatatatactctttgaagtgatgagcagtactatatactagttttttttattagcagtacgtaataaggagtcccttatatttttgttgtagcagtgaatacttctttttttaattagcagccgtatatacttactccagaactaacgagtatatatatactgattatgtctttttattggtacgcgcagtatatactactgcaacgagcgaatgagtatatactgttctttctcagaatgagtatatactgatttttttttggaacgagtatatatactgacttttctcggagtggtatatacttttttcttctccaatcggtatgaacagctactcggagtggtatatacttatttcttctacaatcggtatgaactgctctttggtcagtgtatatatactacattcctcattgaaggagtatatactgcttcttttttttatcagtatatacatttgttattaattgagtatatattgtatgcactacttgttctgtcagtatactgcatatactaattgtcatgtttggtcggtatactgcatcgtcctcgctaaaggaggttatactgcctttttgtttgatcggtaaatactacgtatactacttttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcatacagatctcggttaacaacgatgggatcacgccgaccgcacgccggagagaggtggacaagaatgggtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatctgcaacctagaaaaagcaaatcaagaaaatcggaagaaggaaggacttgcctgcagcatagtcgatgttccagttccggacgacgctcaacgtcatcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcggatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatatatatatatatatatatatatatatatatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcacccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaagcagaacttgatatggggaccagaacaaaaatgttctgctcttgtttctgctggggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatattagaaaaactattctacacccggggtatagaatagctattctatacctccctcccaccaacccacctcctctccccccaagggcccaaaacccacctcccacctcggtcaaaggccagtcaaaggtccctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaatgtgtaattgtcgtgcagtaatacttttacttttgtgcagacttttgtgcagtgacaagtgtataattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgcattttgaagtttaatcctccacatgcagtaacacgataacatcatggtggaaacggttttaaaaaataatacatatcttatgacatattgcttttcaaagattgacattttgaactttagccctccacatgcagtaactgaatgtgtaatttacagtaataggggtttatacatgcagtaacatggttttaccaaatgtataaaattattcaaaatactcctacatcaatcagaccttgctcaaagccacctacaaactttatctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttacaccatgatgctagaaaaaaaatgcttatcaaaagtacatccatcatgactatatttcaattatatttgagcgttgttactgcacgtaaaacacagtgttactagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatatggaatacatatatatatatatatgcatatgtataaatacatatacatgcatgtatagtacaattcatttgctcactagctagctatgacttcgacgccggcgttatgtcaaaagaagaaagaccgacgttataaattgtcgatccgtcgtagtagaattcaccctcgggattaaggacttcttcgttgatgaatctcatcagttgttcttgaatagccgtgatagaatccttgtgtgggagattgtccctcatgtgaatacactatcattcgaaaaataatgacatatgaatatatgaaattaataaacaacaaatcgatacgcaatgaaattttgaatggtttatatatacgtacatcgagctcttgtgtggtgtagatttgggttgataggaagtgggcatactcgcatacgtagtagccgcacaggttagttccctggtcatgctttgcacactacatgagaaaggacaagagatttaatatacacttatattaactgtaactagtaatcatatataattagcatatgcatgatttaaaattgttaaaaattctaattatcatatgtaaataccacatgcatgaaaattgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactctgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgtcgctatcaagccagatggtcccctcgccaggtaggcaagttgttggctaatcgtctcgttacccatgagatgttgtcgcagccacacgggcaatgtatcaatgtgatgccgtataatccatgcatcagacttaccgatgtttctggcgggaactagagccaagtgctcctcgatgtaaggagccaccaatgaagattgttgcagaaccgtgaaatgggctttacggaataaattgttgtctaccgtcattgctgcgttccttccgagagtcccctttccccatagtctcccttcatggcgtgattcaggcaccccgattgggcgaaggtcttcgataaattctacgcagaattcaatgacctcctctgttccataccccttggcgatgcttgcctatggatgagcacggttacgaacatacttcttcaaaacgcccatgtacctctcgaaaaaaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccaaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgttttccactgcgatgttt

SEQ ID NO: 74930 - DNA, 79932 bp, Oryza sativa
acaacgttagcgcctcccttcggaggtaggcccgtccggaaatcgcgagacgtttttttcagcttagttatcgaattatgaactattattgttaccacggttctcaaactacaatttctctgtcaaaattttctgcaacagcgttgcttatataacctgttctaaactacccctattattctaaactagaaatgtagctcacacattctcacggacaccttattgaaattgtcataattttttgctattggcattttgaccattatgatattgtattattttgaatatttttttgataattttaatatttgtattaaaattattttgaataatttggataatatttgaatattatatatttttaataatattgtaaacgtgcgcacagtcatctttatgaacgcacaacatgcacattgtaccctcttaataatctgttagacatttttctagacaaacgaagtctactttctttttagagatgacgaagaagatagtagataattaaaggatgctacctccattctaaaataagttaatctagaagagaataatgtgacacatactactgctatgaagaagctatgtggctgcttgaaatccttttggagaagattaatggacttttagtatatacgtgacagtttgggagtgttttgagaaagccacgtgataacataagagcgttttgaggaagtttaaagtacttttagtatataaaatagatattgacgatatttctcttagttcatatcgacttctctctaagttaataatatttgtcgttttatataaggacagtctccaagaaacaacaaatggtcactattttataatatatatatataaatatcaataatttattgaagtatttttttaagacttatctataaatatggtttccatatttctaagataaatattttagatgttataaagatcttaaaatttgacaatagtcttattcaaatcagagtattatcgaccagagggagtagctcgtgtgctttactatacaaatccatgtggcttcattcttcacataagactggttacaatatggaacctgggaagtgaaataattatcgcttcacacttcacgattcgcagttcatctcgcaagatgcaaactgcacctcccagcatacaaagtgatcgtgggcagctgtaatgtagtttaatactgatagaacgatagtaatagtacacaatttcatataatggtcatatggtatacgtatcttacacaaatgaccaagaaagggttttagtatatgtagactgcatttctggaattatatactacattttcgctactggtacacctttcggtacatttcaatctctacaagaactgagaagtcaaagaatatcttctgtgatgatcagccagagggaaggttcggagtgcgacctctcgtgcatacaatgcatcaacacacaaatatcctaccgggacagaggaaatgattgctcggctctgtagcgaattcgcatgaacaataatactcatatccaaacaatctgcacatgttccctcatccaggaaaagaattcatcataagctgagatattggcgttcctagcatcatgagaagatagaaaccagatggttcagcaatcaatcttcatgctcgtcttcaccttcagagtctgcacataaagcagaacagttttagatggtagcaaactcaaaataattttcaactcacaatggtggttggagtaatgcatgttataagcagactttgtcttgtcccaatgcagatgggactgaaaataagaccatgcaattttgcatgctcatcctgtgcaaaaacaagattctaagggggcagagcttaccagatcgaacatcatctccaacatttcttgtcttgatttgtctcacaagcatccgatatatcagaacccaccaatatatgtgaagaacaagtagtgaaaataggagagaattgaacacatagtaatatataggaccatcaaaattgtgcttcttcttgtccaaggtcaacaagacttcatagctgaagcaatcgggacttagtcagctcatgtaacttctaataaataaggaatgaaaacaccattttgttacatgctgggacaatgggacagcaagatactattgtacatagtattctagtctgctatcacacatatattttgtacaatataagtatgattatcatggcatagaaaggatcggaaataaaatccaaaattaatttcagcatgcggtggcatgatctagataagtttgttttcaagaggcataagatactgtgctatgttcaaaggtctttttcctactggatacaattactgttttctaactgaattacttgttggcttgggtttcttttctccccttaaaatgaaggcattggcaagaacagcagaattcaccatccaaagttcatatggtacaaatttcgcatagtaaataatatgcttgcttttgacaattcacaacatctatagtacttaaaatgttagaagtggtggtgtccatccccacaccacccctaccactaacatctgaaccccacaactattacaccacctttcaacaagtcatcccccatttcactattggctcccctaaatttcaaaatcacttgttcaataagaaaaatcatagtattacttagaacaaataagtgcttattgattgatttaataagctaaaaactcaatttgttttccattgcaatgcacgggttctaggctagttttcaaaaaaacttctttctcacaaaattctggctgacttttctaggcatatctcaacaaggtcagtacatcacatttaccttgtacttctgagaatccagaacggaaaatatgtgagacggagaagaacccatgaaacgacgaaaagaagaaatgcaacattggcaagcaaatcacaatggctatatttggccattttccctacttccaggaacacatcacttgcatcatgaattgccaatactactgagccaactctagcaaacctggttcatgaagaaaaatttcagaaataaattagttaagtgttaataaaaatgagtgaaataaactcagtgaagataaaatattaaggccctgtgctactaactcatagagtaatgcttgaatcaaggtaaaaaaagttcatattcaagaaacaacaaaaattaaaagttagacaaaaagagacctgaacacataagataaaactatcagcgcaacagttgcaacatgatgtgacattgacacgccaaaatctgaacgccttgtttcccaaaacataagtgcaaatatggaatatgtgtagaatccagcagcatacatatagacagccttaagtttccatctgtagataaggggaaaattgttagatatacaccagcctgagaactagtaagaacatgaagcaataaaggaccaattcgtattactttatcttttggtcaggccaaacctggtcaccaggtccaacccagaaatatttagtgtttgtgaaccaaggctcattatatgtaactgacaaagataaaatctctccagataggaaatagacacatttccaagctgattccttaaattttcttatcttctttcttgtttcctccttctcataatcaaccttttcctttccaaatataagttttcttccaatccactgaaacgaaaataaaagaaaaacaatgaaagtgtcaacattaagctttagaattacattaacaattgaaaatgttaattatttaaagtaaaaatatctatgatacaacgtggagcctgagagaatctattagaactatacaggaacaagagtaattttctggtgggttcggaatacagaattaaagtagctgttgtgctcaacctttcaccaatcatgtatttaagaagcataaattactttagaatcataataaccctcatagtgaagcaaatgatctcatctagcaaacaaaaaaaatgtctcaaacaaatacagaacaaatggtaaccagatggccatgtgccataattgcagtaccctgtgatgtctgtatattgtagtcatgcatctgtctaaataattttcttgtgaaaaaagctatatgtaatcaacttaggtatcgcactccaacctagactttgagttagtaaatgttcataaagaaggcatcattgtgtgcttgtgcttaagtccatccatattagaagtgaaagaactctccctcactagtgtcttagttctccgtcctgatgacttgtaatgatcagaattaccttttaaataacataatggtatgtaacataaagatgaatagcatgctaacatatacctcaacatacatatcaagattatctaaaaaaaatctcaagaaaacatcacgacacaaatgttttcctggttacagatagcccagtggaaaggtatactactcatacaataaatgtggcggttgcaactattcttactgcaatgagatggttgcaatttgcaaatttataaccgcgaggtatttctagtttttgagggatataaattacattaaccttgctcaagatgctcacacgagagaaatactgctctctttatgccagaaaccactcagatctactcgtggtctgttgctgcactgagctgctgacaacctcaaattcgcagcacatcgctgccttatgccactgataaacagtaaattgtatagtcgtgtgataggttatgagagatatcaactcaacttgcaatccatttctctgctcgcaaaacccttctccttgcatgaacttttaccttaataaacttgtgttcaggctggcccagtaagtccgtcattgttcgcctcgaaaaatacattatatatgtattttcttaatggaagacaaactaacccagggaatcatatatggatcttgatagctaaatcactaaattcttattgtttaagatgttgaaactgtataccattattgttatagttgatgcgcctatgcctcagagatcacactattcatcaccaaagaacaaaccttaaatcttaaaccattatactccctgactaaccactgcagcgcaacacaacaggggcccctccgtaacaaaaaatcagattcagagtaccagataatcattagacaagagaagaggacgactctccaatacagcaatgccatgatgtaccagcacatctctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgccgccggaggccgaatcgagtaggagcaagaaatcgatctctcctccgccgcgccggccgcgaagctggatgaagaaggatcgagaggggaggggaggcgaccccggttggggccggggtggattccgattggacttccctcctctgttcctcttcgccctctgactcagccgacgcctctgttttaccactacgagtctactactactccccacttgtttatttttattttatatttttcctttttttattattagtctcgcagtggttgcacggagtggtacaatagaaagcgcgtaatgaaccgtgttttataaggggtgtctagatagggctaaaactttttagcccatgttacatcggatgtttggacgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatatgttttataattaatgtatgtttaatactccaaattagtattcaaacatctggtgtgacatggacttggaataagtccgtggaaaccaaacaggcccctaatcccaggaagctgggaattgtattgcatctaccgttgaaaagaagagatgggaattgtagccaggttgacttttcaaccatttttgacattttttttttgacttggtgtactatgattaataatccgaaaatggttatgataacttgtttagcgagttttgtgggttttttatcctatgggtaggattcatcgagattcaaaaataattgtatatttcttgtgtgtttgtaaataatcaataggtgaattatttgtaacttattcatacagctgaatataaatgttatcatacaaaggaaatgcatttggagaaaaaataagatcagaaaaatattagaccacaaggcaatgtcggtgttttttttttggtgtaaccttaacatgtatcccataaataattgatcattgttaaagcaattctcacaattctatagataggatttggtcacaagatagacccacatgagataaaaaaatgctttggctctgattaatgaggtgaatgcgagaggaaaataatgatttctttttcttgtggtagaccttaagcataagcataaggtataccataaggtaatactactttccacaatgtatatgactcactttataacttcaatcgttattttaaggttatcttttcatacattgtggttgtcctaagggtttataattattgttccttaacagcactgatacatcttttgttagagatattcttaaaagattcattttaaaagtattcctacaaagttagtttaacttctaaatcatgaatattgcacatctaggaattgtgagtgtattaatctactatataacaagatttagatcatagtgcccataagcatgactatgtgtagagtattggttaatacattcacccgaagttatacttctattgtaaaaaaaattaaagtactcaagtacaaaagtcaataagtgcatcacatatgaggattacgatgtaaatagaacattgcaaaagaacaatacatgatgtgtgagaatatatagtcgttttcccccttaagtatgttattttaagtttctaaaataaagtatttaaagatataacttgtacagtaaagtttccccttatgctatagtaattttttttcttatgttttgtaggcataggaactgttcgagtgttgaactattgtctttatactcaattctaagtagtagagagtcatatcaatccaaaataataaaggtctcgactaaagacgcacaagaataaaagagttaaaccttagcacatcttgatattgtcccttttagttagaggcttagagctatatcgtcaacatgatcaccatttgtttatggtcttagcaatgttgaagatggaggagcttgagttgtatggagtggttgctccttctactatgatgtgacaaggctaccgacatcaagttagatcaaccctaataacccatggataatatagatcaacctagaaagcgatgtttatctatggattagttttggttccactaaaaagttaagtttagttttggttccactcaaaagtttaagttcagtatgaaacctaccaggcatggatgcaagtaaatcaaaccataaattcacttaatagattaatcaagtggattgaccctgtaaattacccatctatttagtccaagttgatggatcaacccatctctaaccctattataaccagaattaaatttgaaaatacattgttcgttcaattttttctcaggaatattcgggatacaaatttttttgcagaaatataccgtcggtttcgcacaaccgttgcgtgaaaatgacgtggaatgacgtcgcggacggtattgcgcaaagaaaatgtgagaccgtgcggtctcgcgtagcgacgcgacgcgagaccgcacggtctcgcggattataagtgcgacactgttcggtctcgctcaagcaaggagcgataccggtgccattatgatttaattagcgattaattatcctaattagtgattaattaattattaattaattgctaactaggataattaatcactaattattactagttgattgttaattgattaattaattactaatcaaatggagatattggacaatttcgctgtttgatttcacgagagcgtttggtctcgctctttcattccgcgagaccgcgcggtctcgcgttatctcgtactttcatcgtgcgataccgtccacgacgtcaccatgttattttcgcgtaacggttgtacgatatcgataatatatttctgcaaaaaaaattgtataacgaatatttctgaggaaaaattgaatgaacattatatttggcatggacgatttgagatattttgattgggccgatctctagcccatatatacgtgtaggccggaaatctgaaaattctgtccacgtgggcccagaaaccttatcccctcacattaaaaattgcttaaaaatttcgaacactacacctgccgtctcctcctattcactccacccacctcgccggaatgctcgccgtcgtcttctcctccggtcaccgcctcctccccctccccgtcctccccggcacattcaccacccctcctcctcctcctcctcctcctctcctatcccctcgccgtcctctgctcgcccctcgccggcgccgctgcctatgcggcggcggcggtggcggcctcctcctccttcgcgccgtcgccgcgaggcgcgcgggcatcgtgatcgacgtcgacgaggtgggcgaggtcggcgaccgcgacctccccgtggacgtgtcgttcacccggaggctgccgccggtgctcaccctcggggacggcctcgccgcgctgcggcgggccggggaggaggtgaaggcctgcccgcctgccgccgccgcgagcggcgtcatccggttcgaggtgagccgcccagcgaggctgtgtgggaggggatatgtcgtgttttacagatttgcagttggtttcgttgtgagcagccgctgcaatatttgctgcgcggcggcgaggcgacatgctcccccccctcccttacgaattttaatccagcactgtgaaattattgaataatccactcagctccttgacgcaataggcgtaaatcgagctcgcgtctagctcattgtttatgctttgcgatgcatttggatttgtttatcccttacggtctaagcaacaagtgaaacaatgatgattaattctcagttctgacaatgcaacggtgcaggtgcttgttccacccagtacgaaggcgctcaaatggctgtgcacacagtttaagagatcatcattgtttcctcagttttatttgtcgaggaagcaaaccactgattcatcaattcagcttgaaatctctggcgctggctctgcaatttgctttcatggttcctctcgagtagataatgggtttgatttgatatcaaggtgcctcctctctattgctttccgtagcgtacgtgtgatgcagggtgtttctaactaaattaggacctgtttgtccctgcagatatctttcgtttaattcacacttgattagagcctatggatcagtaggtgttaaatatgacaaggaactattgtctttagaggagagaattggttcattttacttctttattcctcaggtaacaactttcagtattctgtggtgctactctagctacctgaatatttatcaagttggtgcgagatacagactatgtgtacaagccattttgaatttagcaaggaaaatcctcgaagttctgtgatatgacattccctgtataaatttggttacatggtttaatatcatattgtcagacaacagaaacagttttacacctgaatttttcttgttagcctttttatgattgtggtggggtcctcaaagtaatccgttggtgcaaagaaagtcctattctgaacatgcatgagtggcacaagtactgcacttatatctagaaaaatgacatagaagttagcctattagaacatttttttaatgtattaaaaagatctacataaacaatttacaagaggatcacaacgctttatgacctactttgactggtaagttattgcacagaaagtaatgcaaatgcaaagggttaaaagtggaggtcaacttggttgaggatttttcttgcattcttgcatacaagtcacataggaggcagtaagaatttacagaattctttcttggttatcttctgcaggcataatgtagatatttgatcttatagcattcgtgatgatcagcaaaattgaatttacaggttgagctgagtgaatttgatggctattccatgttatcgtcaactattgtttgggatgactccgtgtctcacacatttgaggattctgtttgtttatttgaatcttgtttcagtcaggtatgtggaactaactagattaagaaaaaaatatatttaattctgtttaactttctttcatattaatatagcatttccatgttcttttaaaacaattaattttctgttttgtattttcccctgtaagatatggagtagctatgattcttcagctactatctgttatgaaaacatggtaacaagttacattggagaatcgcgtatgtcagagagcaggaatactcagttggtacatatttctatcaatcttaatcactttgttaatttcatgaatttacgcttgtgccatttgttctccactctgcaaagtccatctgtgatgaagcttcagttgtatcaggccttcacatgaacactcatattcactattccgatgttcttacttctatgccttaattagttcacagggttttgagtctgaaacattatttagttatattacggaggattataatagcagagttttgtgatgtgctctactgaagtttgcaacaattgcttctccaatctctaatggccattcttcccaccattttgtttttggttgaatgataaaaaaaatcctctttttcaacaaaaatagataaatgaaacgtctatgccttttaacatatagaacatgctggcttccaaaaaaattagctatggctaatgatatagattgggtgctcatattgtattccatacagagttttggctattcatcgttaaccagtttgtgagttatggaacatagttctagtttgcacgcaaacactctttatagctgtttatgtatttcgacagttatctgctattcctattatcatcagacatcaaagtgctcaatttgattttgttgaatccactgttccaggtatacttggatgctgaatttctcgctgtaatagatggcaaagctgtcacggaaaaggtatcctcttaaccctggtaagcttctttaagctatttcattactttgcaattgagattaatccctggttttaatataagaaatgccccttgcaaaaaggaatattatgtttctttctttgcggtttatggatattttgtctgtatcttgctggaaggcacattcacacctatcacatttataatagtaattcaagattattttttttacgtccctgctgccctgcattacctggtaactaacaagtttgcctacctgttagttagttgaattgcttttgaccaactccacaaattcatggaccaaaaagttaaagtcaagaagttcatgggtacacatagacctcgccacaattattaggacagacataattttcctattatttcctttttaaactttttgttgttcatgttctcttataagactagacacaataaacttgaatttatatccctgatcggatatggaacttattcttttgtctgtaggagaattgcccaacttctgatcagtcatttgttcggttttcgccgcagttcttgttttgtgcaaacatggtaatggtttctacctgagtttctttttttcataaataaccattaaattattttgttaaatacttcctccgtttcacaatataagtcattctagcatttcccacgtttatattgatgttaatgaatctggacatatgcctatctagattcattaacatcaatatgaatgtgggaaatgctagaatgacttacattgtgaaacggagggagtacaagctttctgtagtaagccttttcctacagcattttctactttccaatttaaaaaaaatgatgcatataattagaatatgatataattggtgggttagcttaaaaacagatagtatgtaatttgctctctgtaattgaagttgtacttatctaatttttttataggatttatgtttgcaaagcaacaaaattgaatctttcattaggagatgctctaacattaatttggcatgggcatccttcatagttgaagaatttgtcaggcttggttttacggtaagcttaactgaatacatagctctagcgtttttaccatgcctctgacctggtttgctttagtacttctgtatagctccagggtcgagatcatccccacttgcactttctgcttcagtccatcctttgacaacctgcatatcatgttatgatgagcgttcacttggatttcatgctcttggctatgggagaggttctcggaagcctgcaatagtaattacatcatcaggaactgctgtatcaaatctccttccttcagtgagttggaacatttctctttcttactttttttatttccttacttccagcctttacagaaatacccaccatttgctgaaatcacaattcaacaagtcttgttgctataacttcatctgtgtagtgtatacctttatgctctctatgtgctactacaggcaatccatgcagtaatggatatatcaactattgagaaatagtctatagtgtttaatcaagattcatatgtaggtggtggaggcaagtcaagatttcgtaccacttattttactcacagctgatcgtcctcctgagctgcaggatgtaggagccaaccaagccatcaatcaggtattgtaactgaatacaatattacaaaaactaaaagtttctggcaatagctcctattctgaaaagagcttcgaatcagcactgttaattcagaattttggctaccttttaattgccttaaattgcttataagtattgtcatgcacataaagccaatcatgttgttcccttaactatgttttagtgtttattttatttctcagcaccatcaaaattatgtcctacctgtacaatccatatatattcctcacatgacctatgtgtctcactcaagcaaagacatatacagaacactagtcaaacccatacagtgaacttgagaagcaaaggcctatattcctcacgcaataagacccatacagtgaacttggaatttgctggattaccattccagtttatgcatatagttttatgtttatttccttttaatggcatactgcctctatagcatatgcaaacttatctggtaagcctatgatgttcttctgttattcttgtgaagaactcgtcacatttttttttaactattttcaggtaaatcattttggcagttttgtaagacacttttttagtctccctccaccagatgatcatatttacgcgagaatggttcttacaacagttgattcagcagcctactatgccatgcaagcaccacaagggccagtgcatataaactgtgcttttagagaaccactagactacggatatcaagattggagtgttgactgtttgaaagggttggacaaatggtttataaatagagaaccatacactagatacctaggaatgaaaatggtttctgcattaggtaactattcttgttcagtaagggaggttctggagattgtaaagaacgcaaaccaggggcttttattagttggtgctattcacacagaagatgatatctgggctgtgactttactagctagacacctttcctggccgattgctgctgatgttctgtctggattgcgaatgaggaaagtacagaaatcaattccaggactagataagagcatttgttttatagaccacatagatcaaattctactgtctgaatctgttaaaagctggaaaactccagatgttattgtccaggttcatctcctcactgattcttctttttattccatacttttgcattacctaatcatttgaattccttttcattatgtgatatatttataatgacacctttctttttttttttgcttgacagattggaagccggatcactagcaaacgagtgggaacatatcttgagtcctgctccccgtcttcttacatcttaattgatgcacacccatgccgccatgatccttcacatgttgtcactcacagaatccaggctactataactgaatttgctgctagtctgtgccagtgtaatttccaaacaaagacaagcagatggtcagatattttaatggttctgaattcagcggtatggtccataagagggtagttatcttgaaaatatgcaacaaaatattctgatagtatggataggataaaacttgtccttatgtgtaagcaaccttcctgaaccttagtcatttgtttcaatcattttctgcagtaaactttggtattatacaccctacacccaggttatagtataggtaaaaggtcaccacaaattgatttgaaatagtattgacattgaaagttgaaaactcaattgatatttaatgtctctttctgaaatctgtaaatagcatgcatgaaggggtttatcacttaaccaactgcctctagttcatatatttgtccccatggaaacttgactacataaggaattcaattctgtaagcatgcccttgaacagattttttctggaaataactaacaaacaccttttgttgccatcatctgcttttttctaatcctgataactgttgtttattccaggtttcacaggagataatgtttcaggtgcattcagaatgttcacttacagaaccatatgttgctcatgtaattggagaagcactttatggcgatgctactatgtttattgggaatagcatggtcattcgagacttggatatgtttggcaagggctggattgaccatagtacaaatgcaaataatgctatgatgcaccattttccaggctttcttggtgcaccagtagctgggaacaggggagcaagtggtattgatggtttgcttagtacatcaattggatttgccattggatcaaacaagcatgtaagttagttatttagctcatatgggtacttcatgtgatgaaatttgttaccctagatatggaatgcataaatgcgcttgctgcagctgcacaaacttggggacaatgaaaaacactatgcttcaaagagaatattcctaattttcatcacagccacctgcagttctcaaactactctgattatcttataatatttttattgtgtatttcctagatactgacagttgccaatgcatttatgctgtacttctttttgagtaagcttttggcagaaatttgacttggctgcactattttcaggtattctgtgtgattggtgacatatcttttcttcatgataccaatggattgtcacttctgaaccaaaggtttacagtttgaatctattctatgctatccaccaccgtttgtttttctgcgagtcattggctcattgtcatttccttaatttatttttcattgacccaagcatttgtttttgcattactacttagtcaaagaaataaaaagaactacagatattctctctgtaaagctattgtataaccatctacttaaatgaatatttatttctgataaagtgataatgcatctcacattcctgaaggacgcagaggaaacccatgacagtaattgtcattaacaaccatggtggtgcaatcttcagccttctaccagttgcaaaaacagcttcactccaaattttggagaaatttttctacaccttgcatgacatatcgatttccaaactctgtgctgcacacaggtaaaagcgattgttgtattctggtgcttacatacctcggccttgcttatagaaatacaattttaacaatatgcctgcctgatgctaacgtagcatcgctgttactgattctgggatttattagatgttttctgctgagacttctgcctgttacattattggttatggagtcagctgtggatacaacaaataactttctggtggcaattttgcatccccagcattctcatgagttgtatttcaggataaaacatattctagttcagacaaaagctgaacttcatgatgccttagtgaagtcccatgaggggcatgttgattgtgttgtcgaagtggagaatcgcattgttgataatgccaactttcataggttttatattcaaactagttcttttgattattttggtctacatcgcgtttatatgctcattctcattctgcagaattataagcatgttcacagaccatagtgcaaccatgcatctggcatatcttctgggaggtccatattgtaaggatggggtaaatggcttttctgttggtagaatacatgcagcagaatacatgttttacaggtacatccttaaccaatcaatacacacctcactcctgcacaggtcacacagcctggaaattctaaacataagtgtagctaaaccatgttttggattttgcagctgtacaaaatttagagaaaaaaaacatgcagggcatgctacaatgtgcagagacacaaattgtgcaaatatatgatcaaatgtattgtgtatcaccacacacaaaagacaagaaagtcatgttttggattttgcagcttacaaaatttagaaaaaaaaaacatgcagggcatgctacaatgtgcagagacacaaattgcgcaaatatatgatcaaatgtattgtgtatcaccacacacaaaagacaagaaagttattgtttgcaaaagttctgataagtcatttattttccttttggtacagtacaacgattatatttttatacatatttttttgagtgaacatattttaacatagatttttttatgaattttcaaaagtatacaatgacaaattacaaagtgtgtaacagtagttagaactgggaactctcttattttaggatttaccttctatgcaggatccaacttgctgcaccacgtacatctgggatatcagaaagcagcttctttcatgaaggtttcatactaaagttatgtgtgggtgacagcattgtgggattcggcgaggtttgattttattactactgtaatctgtctgttttttctaactcattgtgggccttaattactgttcttgaattatgctatactaaaatgttatcttagttgtctactcacagttttcaagtaggaaatggactggtctggagcatttctcctttacaatttttttagcttgatccaaatactcatggaagcatggaagtgggtccagatctaaactctgactttaatactagaaaaaaaccctcagaaccacagagtgggtgaacatttacataaaacactaattaaaaaaatactccagttaacataatcatttgaccttgtatattagctgaatatatgttatagcagtttaaggttacttttcatgttgtgcttcaaccagaatatctggcaaacttgtagtaggcaggatatttttcctcgtgcaaattaatttggtctaaaaattaccttacctcacagttttatacttgaagaagatgttatccttcaaatggataatacagaaaaatgtttcttatgcatgcccatgtttcactgaaggaatatacagcatattactggaggtttggtgttggttttacagtagttttattttatgtttattggcttctagtttttgtaaacttagttgaggctggtctgttatttcttcattcctcttaattgattggcagaactcctaactttgtttcgtctaaaaatatattacatgttgcaccgtgcatttatttagcttttattaagtattattttttacccttgtaaaataacaggttgcaccaattgaaattcatgaggaggatctgttggatgttgaagaacagcttaggtttctctttcacagaatgaaagatgctgagctagatgttgttcctttgttgagaggatccttctccaattggatatggacaacccttgggattcctgtaagttgacttaagaaaattttctgtgaaaaacatacgagagactgatatttttccgcgtgttcttcttcacagccttcttcagtattccctagtgttaagtgtggtctagagatggctattcttaatttgctggagtcacaacgaatagatagatcctatggtatttttactggctccaatgtggtcgaatataatcagagcagcactgcaaacatacagatatgtgcactcgtagactcctgtggcactccaatggatgtaacacttgctgttgtcaaacttgttgctgaaggtttcaccaccgttaaactgaaggtaaatcttctaccagttcagtaattataggaagttgaatttattagcttctaaaagaatctgtacattgcttctttttaaaatctcccaaaggttgggcgtcgcgaaaatcccgctgaagatgcagctgttattcaaaaagtaagggaaattgtaggatacaagatcaatatccgtgctgacgcaaataggaaatggacatatgaacaggcaattgattttggatccagggtaaaaggcttatgtttgcaatacatcgaggtaatctgccttttattcatctgatatgcatcgaaaatctaaaatagacaaagcattaaatttgtacccagcatatcataatactggttggggaagagactgtttttcatgcagttcttccttgagagtcttcatttgttttaaccacaggaaccagtggactctgtaaatgacatcatcaagttctgtgaaaatagtggcttgcctgttgcactagacgagactatcgacaaccttacaggggatgtaatccctaagctacatcaattttcacatccaggaatagttgctcttgtgagttcaaactttacgggctagttttcaagctgatgcttcattttctagatttgacctcattttcatgttgatattcaggttataaaacccagtgttgttggtggctttgagactgcagcttatatagcaaaatgggctcacatgcatgataagatggctgtcatcagtagcacctatgagagttctgtaggtttggcaacctatatacagtttgcacattatgttgacagacaaaatgacataacatccagaataaagaacagaggttcttgtggaaatgtggcacatggacttggaacataccaatggttaagggaagatgtttcagatcaaaagttaaaaatccatgcgccaccacttggtgatggaatcagagcttcggcagaagatgcccatggctatctccagcatttagttataaacgacaagaagatagaaagaacttatagtgaagaaaaattgaggtcatatttcatccaagttgatggggataatttttcttatcaagtcaagcttcaagagggtggtgattgcacacatgtaagatttcttcaattttcttttgaaaaccaacagtttattaccagcttgttatataagagggtttagattagtgctcagtgtctgacacgagatccatggctagatatttgcagtatgagagcaaattagatgattaagttgcaaacagcaggagctattgctagtagcatattaactggaatatattgctaagcatatcatagtttcaaaagatggaattcttttaatcgacatgtatcctactttactcgggatttaaggaggtatgctgtagaccgcggaactatcacaaaggtctgcagaatattgttcacgtattgatttaaaactactgttcttagtactaacagttaaaattcaagtgaaaacattattatctccatatgaatgattcaataatatatttgataggtccttggttcatttcttgaaggaagcacattcataattacatgttttctcttgagtttgtctttcttgctaattatgatgttatctgttttctattcacatcattcaatcaatggacaagtttcatacattctgggagtgctttgacgctctcttttcatttgtgtgccttgttcctaatctcagtaatagttaaatttctgcttatgtttttactcctttgattttggttgtccagttatccacttaaaaaccagatgcaagcatatgttcaattatctaagttttacttgcactgtatacttgagatactggtagtttctccgtatgtagtaagatggtgctgtcacagtaactattgtcatgatttaaccaatgtaggaaaaggttattctctttcttcatggatttcttggtacgagtgaagactgggttccaatgatgaaagctctctctcctagtgcacgggttatagctgtcgatcttcctggccatggcgagtccgaaattctacagcatgatgttgaaaactccaaccaaatctccttttcagttcaatcagttgcagatttgttactgaagttgataagaaatataactgatggagcggtggttgttgttggctactcaatgggtgcaaggattgcactacacatggcattaaatcaaaaccacaaggtaaatttctcgacattgtaccttttgtgtttatttctttatttttatgattctaacgcagtcccgttaagacagataagtggagctgttataatttcgggtagtcctggattgagagacgaggcaagtaaaagacgtcgtagtgctattgatagatcaagagcccacttcttgtcttcttgtggactggaaaattttctcgagacgtggtactctgcgaaaatgtgggccaggtaatattgttatgcagtgacaatatacttttgttttgccaaaaatgtattgacatgccttttttcttttccttttctgggatattttctgttgatggatgaccaaatttacagtttacgagaacatcctaaatttgattctctagtgaggacacgaatgaaacacaataatatcaaagctctatctaaggttctcgctgactcaagcatagggacgcaaaagtaaggcttgccttcccatactccgtattatatttttcattgatgatatccataaagtcatgttccatcgagtccgttagtaattttgacgttaatagtggtaaaaaatatagtgtgccgatgatacatatagagcctgtgaacactttgatggtcatattacattagtgattgtgtaataagaaaatcatgtgtgattcgatctcatgttagtttcaatgttctaggtccctgtgggaagatttgaagcacttgaagagccctctcctcatcgtcgcaggtgaaaaggacccaaaattcaaagagatatcgcagcaaatgtgcagggagataagaaagcacaaggatcgcgaatccgatggtctatgtgagatgatcattattccagacagcggccacgccgtgcacgttgagaaccctcttcctttagttagagcaatcaggaagttcttggtaagggatataccagacgtgatatccaagtagattacgaaatggaattatctatgtagaggagttcaagttacagcgatagccagagacagcagagcagaccaactctttggtgcggatgggtgcggcagttctggatgctattctgccgccggtagtctcacctacaccagcccgggaactattctcattgtggactggtgggggaggattaaagattagatccagagagaagggatgtgactccattatcatgcaaagttcctaaccatgtgacagacttggtaaggaaagaacgcaatgcgagggtcttcagagatgaagattcttccctccaacgagtagcaggaaaaatcatcattgatgagcttcacgtatagcggtataggagtacttgtgaggacgaattctaggagtacttgtgtgctgcagcattgtcccgagctgtacagtgctcttttcatattttgctgctctgtatatgctgttgcctgttggttagttgccactctctctcgccgtgacccttttttattaatacaaaatgatatgcaagtcctatgcatatccgtgaaaaaaacatgttggccagcttcacatccgagctgagctcctgacacagtgacactactggggaaccctttgcaaaccgagatatctaatccgggactaagatatctcgaatggtgttgtcaatcgggactaaaggtatttttttccttttttttcattgtttattactacttgcatattacccaaatccgattgaacgtacatactcaacaacaatttgataccacagattgaatgaacatattcaacaacaaaatcatacataactcattgctatgcacaactcctaggctgtgtttgtataacgatgcgttttttacaaaaagtttctatacgaaagttgctttaaaaaatcaaattaattcatttttgaaaaaaatagctaatacttaattaataacgcgctaataaaccgctccgttttccgtgtgagagggattagttcccatcactggaatccgaacacatccctagtctcacttgcaaaaaggggactaatttgcagctacacttcttcaaacagaagattaattatatacatgaacattaattctgaactacagtccttcagaaaataagaaaaagagaagagaagaacaaagaaagaaggagagctcctggccgcgctcgccgcgatgctgttcgttcgcgccatcgccggcccgggcccggcgctcctccctcctgtcaaggacgaggatgccgacggcgatggcaacccggaggccagcggggaaggaggcggagtgcctccggtgacgataaggtgggcccgcatcacctgtgccgcctcccacccgccgacgcctgccaccgcccgctgctgacgccgccgacagaggggaaggggaggaggggagagcggtgtcgccgcttgccgcccgctgctgacggagaggggagggcgctgtcgccgctcgccgcccactgccgacactgcgacggcagagacgggaaggggaggagaggggcgggggaggcctaacatgttgattgctaccggttaaaccgcagtagtcctgccgtagactgctcgccaattgtcggtctgaccatcgggatccaaaaatcacatatcgacgagacgaaactcttgaaagtagatcaactttattgcatcaatatgtgtttacaaagtgtatctaaagcactcctctgtcaactagtattgaagcctcgaagcaaaactataacttttctctcctaaaaaattgatatacttctagcatcaacccctcatctatttatatcctcaacgtggctacccctagccacaaatcctacaagaactagaattcccaatcacataggaaacctactcaacaaggtaaacaacattctcatacaactccgcgctctaatctttctaaacttggacctcttcccatacgtacacaacactatgtatatactttatggaaaccttcactccacatgcatggtttctagcctaagcatcctgtgtgatatgaccatttggacctcaatttcttccaagcctagtcctgatccattaccgactatactcacataacctcaagcaacacctgcacataaacaacaaagagactctctgtattcgagtataagttcgcaccaacttgactcatatcagcataaaatagtatcacatacaaaaagaaacatctaaaagtcataaacatgaagcaatttagaaatcccacgaaaacaacccgaaaccaactacaacccagagtctgctggtctaaccgccgggctatccaacacctccggtctgaccgaccacccattgctgactgcactattcaccgaccgaaaacattattcactgtattttcaataaacacttacttttgacaattgtttatcacatagattaaatcaacacattaatttcacagtaccaatcgcctacaactacaataacactgctgatcacctaggtataaagcaacacatcattatggactttaaatgggatatggtgttacaatctcatctgctcaaagctgatcgaacaaatgaagtttgcagttgtaaagctagaaatgaatctgcttgatttgtgcaataaaactatgctcgaaaccacttgctccatgtgttttccgccttccgtttgcaatggtactgttgctaccaagttgccgcggtcggttacttttgtgggttaaaaccgtgtcggaattcgtaataaccagccgactgcacgcagagagaggcatctcacacctccgccttctgtgacttctgtcccgattcctgaatgttggtttttcaaaacttcctaggggtgcgagtcttgatccatcccgggtgccccttgccttggatcctggtcttttaacactagtgtcagtgccgtagaatcgctctacaacttccctctttttataaacgagaaaacctgccgccgcgcaggcgcaaccatgtgagaagtgttgcccagtcacacgctcacacacgccctgatcccaacacaaaatttttcatcctgtcatatcgaacatttaaacacatgtatgaagtattaaatatatgttaagtaactaattacacagattacaactaatttacgagacgaaccttttaagcctaattgctctataatttgagaatgtgatgttacagtaaacatatgctagtgacggattagttaggcttaatatatttgtctcgcggtttattgatgattttataattattttttattaatgtcaaaacactctatactacacgccaaaactttacaccacccatgtattagaaaccagtctcatggcgaattggcgagatgtgtgtgtggtgttgtggccgattggccgcgggattccaacagggagctcaactcccgaagcccagccactgctagctcgatctcggcagaaggcacggcaccggcacgcattgttgcagagcccacacgtggtgcatcagtgcgtggcatatggtgcaagtgcaactaggaccgagctgtaaaaaagaacaacgcctaggcctagggcttgttaaacaagggtagaaacaggagtacgtacggcatataataacagtgtgtgtaagaaatctgagatgagttttgagcaaagcctttgaccacgccttcctctcagctgactgacaaattaagcggctaagcatttgccttcctataaagatcttactactcgatctaagcccccctctcctctgtacactgttaattttctcactcactgactgaccaagctagctaagctagagcagaagagcgtagtgcatccagagaaaagaagcacgtacgccaagattggagttcagttcatgttcatcatgagttgccgaaggacttcgagtcttcttgtgatcgccttggtcatctccttgctcttacttgaccgtcccattgctcacgcacgccattgtaagttcatattcatctttgcagcaattaattgttaccatagtttttctctgagaaaagcaccatgaaatttgtggcaggagcatttccctttttctttcttcgtatgttcaactattgttgattttaaccagtattactatcttttttgcagtgaagaacacgtccatgtcgagccgtggttcatcaacagaaagaggattagaagattcaaagaagaagctcgatgaggagaagaccaagaaggttgaagccgtgcaagttggatcaaactctgtccatggagggagcccggatgttcatcagtttgcgaagatagtagtggttgaacgccggggaccaacgcctcaccctaagaagcacaacttatgagtatagatagccaagatagatggatatatagctgccaagttcatcccgctgtatctattttgatttagactagcttttctttttctcagttttatctttctctccctaggctaagataggagaggagtgaccaaactccatagatcatagctagtagtgtactactttccagcagcacgtcgttgagaaattaacctcaataaagatgtcacatatagcatcttttcaattttgtagcctgtatttgactactgatttttcaatttatttagaattttttttgaaggattcaggggtatccgatccatggcgttctcttgagtccagagagtatttgactacggaattctcaatttatttagaaaatttttgaatatggaagggaggaaaaaactagaattttttttttgaagaattgatggatacccaaatatccaatgcgtcctcaagtccatgttgagagggagattgacaactgatttctctaagatttttctaaataaattagagcctcttaagagggggataaaaaaaagttgagagttggtaaagagggggtcaaagtgcgcgagccctttttgccccccacaagagagaaataagttcactttgggtccctctattttttgtccgggtatgatccgtcccccaacttacgaaaaccgggcaaacgtgatccctcagcggttttggctggcgtgacgcatacgtgacttgtttgaataggtctttcgtcccacgtggcattgacgtggcgcttacgtggcaattatatctaaaaaaaataataaaaaacgtggccccacatgtcagctgcacaaaaaaataattttaaaattgtgggggccatgtgggccccacgtgtcagtctcactcctctcttcttccctctcccttctctctcttcttccctttcccctctctctttctctttctcaggcagaggacggcgcgggtgggcggcggagcaggcgagctccggcggcggcggtggccgtggtcggcgccgccgctccgcgtgaaggcgagcagcgcggcggcgccctagacgccatcgacgctgccatccatgtcgccgccgccgaccacccggacgccctccgcgcgcgccgggacggcattgccaagcgcctctacaccgcgctcgtcatgctcccgccgctgcttgccgccgctccacaagccgtctacgccgcgctctcccctcccgacgccgtgctccgtctcctcgcctccctcccctgcgcccccaattccttcatgctcaacaccacgctccgtgccctcgccttctcccccaacccggcctccgccctcggcttcttctccctgtccgccgcgacagcggcaacagcagcggcagcggcggctcgtactcccctcactccctcccgggcacgcgcgtatgggaaaggggaagaggaacgaaggagctagagccgtgccgagctccctcctctcccgccggcgagctagaagggcggcggacggctaggcgagctccctggcctaccggcgagcgcgcgggcgtcgctccctcctctcccgccggcgccacacctgtgcgtcagccatccgtgtgcggtccgtgcgaggcgccgctccaggcgtgcaggcttccacgcgcctccttcctcgctcgccgtcgccctcccttccactggtaagtgattcgctctgctccatgtgcgtgagtggcttcgagttcgagatggcaaatttgagtaaattccggagctcttgaacttttgaaattggttccgattctacgtgccttgttcttaatcgagtgtggtttcaatgtacgcgtgtgtttctggaagttcggtggattggaggaagggaattggtttgaactttgaactaacttggagtccctcggttggatttgagcatctgtgatgaagcagtggagaatcgcctcataaattgcttgtctatgtttgcattgcggtgatttgaaccttgctgctgtgatttcagtttggttattaggcgatcgcaacataacccagtgaagcaattctggtgctgctgtttgaatcctctagctctggattgtggttaactcttccattctgtcgcatttggccaactgaattgcctgttctgtttgcgtttctgcattgcagtatgtgaatctcgttgctgtgaactcaatttggtttgaagtgatcgatcgtggtcacaacttaatccatctgttgcgcaagagagagatggccgcctctgccccacgcgcctcgcgtgccgccgcgcacgccatcgcccgccgccagccatgcgctgtacatcgccggcgccgcctaccgccgccgcgccgcccgtcgtgctggacgccgcccggcgagaggagggagcagagagatggggagagctggagagaggaggaagaagaggattggatttgatcatttgggaatgacatgtcatttgggcccctccatatttatttttaaattattttttctatggttgaattgtgggaccacgatttttattacttttccaatatacaattgccacatcagcgccacgtggaacggagaactagtctaacaatccacgtcaaccaaaaccaccgagagaacttgtttgcacggttatggaaagttgggggacggggcgtagcccggattgggcgacaaataaagaactaaagtgaacttattcccacaagagaaggctcctcgtctccttactacgtggaagcccgcacctgtggctaaagcgcaacccaaagtacactcgtaaagcggtgcgagaacacatatacacagccgcctcccgcctcccccccatttatatccacacttgcaaacgggctcgcgaattatcacgatgaactccgctaagtggtaagctcagcatgtgagagttatttctgtccacagacccgcgacaagcacgcgaaatatcacgatgactgctttaaagttagtgggctgtgcgggggtaaaaagtttattttctctggggcctttatttttttgacatgggctctaccgacactgaccccgggagcaatgcctgcctcgggtaaacttagacccaggacgagagactagcgcccccacggatatccgactcgttaccaactctgccctccaaagaagctggagtttaaggcccgcgctaccaggcccggcgatggagactccggggcgcactcctttatcctgggggacgcgctccacggcgagcggtatggtactaaaaaataatagggtcggcggtgaaaaaaggagacgtgccaccggaacggtgagagaagcgcttcccctctcccctcccagtcccagtcccatcgcgacatcgcgtgatgaactgatgatcgccccagtttcagattccagcactttggtcgcagtttcagaaaaccagatgtcagttcagacttcagaattcagaccggaagacgaatattggtatgatgaagagaaaaggaatacgttctagctcctcaaaggctcaaaccagcaaagatcaacacaaactaatttttttttacagatagcaatgcaatccaatgatccatcaccccctaggctacacgctatttatacacctcttcactcctcttctcgctcacggtacagagttacaagccactgacaaaaccgacaagccatcttacctgctacaggaccaacaaaaaagaagaagcagggtatacatatatggcgtgcaaatcagacacttcggtggagttacagatagatttcgaccgacttcagcagcgcatcagaatttcagagattcttcaggaggtataagaaaaggggatgctcagaatttccagcagaggaagcccttattccagccacggcgccgcttgtttcgcctccgctccgctctcgccatcctcaccgggctgctgttccaatcccactgtaacctgttcatccaccaaagcagcacatacctcccaactttcagttttgagacaaaagttgttcatgaacacaaaagaaggtttaagtttatagttgtaacatgacagagtggatgaggatggatgcttacactggaaatgcgaaggaccgggtgcttgtcgtgctactatctgaccggatggagatgttgccaatgtgaccagaggtcgacactgggttgcacatgatgctaggcccaagagagcatggctcaaggggatacccattgccaatcagagattttccctttgcattattatcaggcacatctagttcatccacatgagtggaatccttttgcgcatcggtagaactcgtgctaattctgccatcgtttgttgcgtctgcgcagctctctgaatctgtctggttgaaatcatgcacatcagtagcaccatcgttgtcagagttcttgttgttcatctgcctatttgcatcactggactctacaacatgaggtgatgaggatgtggccactgcattttcatcctgtggatccgctatcggctcgctggtgaagctttcggggtggtcgttgctcttttcggatggttggacttctgaagaactacttgatgtcagagcatcaggcatggcttctgctgttccaacttcgttaaattgtttggagccaattaaaccgtcagtagtctcagcagtggacatgggtttatctaatgctgcggttgcatcatgtctgtcagatattgttgctgatgaaccgttggtgttattgatacttgatacgttgctagtaataagttcatcagtttttgatgcagttgcaacatcattgcagtcatttgtggaaacctgcaatgtggtgtcaaacctgtttgtcagtctaaaaaaccaatctaaggatgattgaacttctcataactatataattcaagttatcacccaaaagagtagggtcaggtaataaaaaaataataatgacaaacctggtgatagtggtaatgagaaaacaaatttgattacagattaagccagtaacttatgtggttacctgtgcaatagcctcttcatgaacagggggcatgtttttttcatttattgcagaagttgtgctttgatgctgggtctgggattcttctgcactttcaagtttaagtctttccttggattcttctgcactttcaagcttaagtaactcatgcaaacttattttcttctcactgatatcactagcagtatccctgctttcaagatcacattgtttctccgtgttatcgtcagcagcgaatccaacaggtaggagaacagtttttggtttctgtccatgtgcatattttttagcatcacctttccccccatatgttagatcactattcgtgtctatcattaggaaatcaaaatttggtggtgacttctcatctaactttttttctgctgaaattttccgatgcggaagtactccttcatcgatgcagacatccttgacaaaattgccaccataatcagaagtaacaacagtatctggcaattttatctccaaaacatccttgtcgtaagaaacatcatcatgtactacatgtccagttatatctatcatatcttgtgttggatttgaggcttctaccattttccctatcaaaacccagccaatcacttttctcgtatacttctgtgtccagtttcagtctttcagaccaaatgtagctatcaagctacctccatcagaaatttcaccgttgtcaaaattttcatcatctgtcaagccaatacaaaaatatcaaaactttcacaaggcaaaaaaatatatttttaaataaatgtcatgctagcataccaagttatcttttttgacatataacccaagactgactactaatacacgatgaaacatcatttgggcaaatcctacagaatggaatgtaaattcaacctaattaagatctctagcattgtcctcttccattttggttgctaaatcacttttaatcagttataagcattaaattttcctgtagtgacttgtgactgcaaactgccatcttcctaaaatatagtatatgaagaccatgatagggacaattctccccccagtctgaaactctgaacaaagaagctggtggactggtggtagtcttggtggaaccaacgtatatataagcataagaccacgtcaagacattgatttttcattatgagtatcatgccttcccacttaacaaatcaatttttgacaggtagagctgcaaggcctgcaaccgagatcgatcgagaccccgaatacacacaattggatccttttctcactcttaagaaaaggccatatcccctttcagtgtccacaagttgctgaaaaaaaaatgtagactttcattttgattgggatcaagttgaatttctgcattattattactaaaagtggttttcagtttttgtaaacaggctacagctatggagtcaacagagtaggttttaggtagtgaataatcagtgttcgcaactaacgatgaatcacttgctggatatcctaatttttaagtagcagttgactaccctagctactctcaacacagcagttgactgcacaatttcttacagcttacaagaacaaagaatattggcacccttactaaccaagcaaagttaacttgaaagtaaaaaaataatcctaaattttatcccagccacagtgatgtattgaccgtactagaaaacagttggtgttcttacctactgtgagtagacaagggtgcaactgaaaaggtcacctagtttcacgatatagatgcagatcttatggagaaaagaattgcttatgtcctgcatgcgaaagaggtataataagatgggaacaacggttaagcagcagcaatatgagttctaataattacattgaatggataaactcgaacaacttaatataatcagaaaagttactgcaagtattatttttttctgtggatattgacaatattactagcaacaaggaatgctgattattattattattttttgtaaactccatgctctcgcattatgttaacaaatccggtcaaaataaaatgaagaaaattaacacgaaatcttgaaagctgtcctgacgacaaactgaagcatctcacgtcctttgcatgagctagtagtagcctagtacaaaccgcaacatcaacagaaaaaaacatacacaacaagcatactcatctccaacacaaaatgaagaaacgtacggtttaagcatgctaggcatattagatttttcccaacagatggcctcgaaaatactacctcgatcgaaaatcgaaatagttgtttgtgattgtaacgaattctcctttctctctctggaaattaacatacagcctctaccatctgtttcagacttcagatgagggaaaacaaacgacactgcaatctattaacccaaaatttttcaagatttaaacttcctgtccaattatttaaacatatttttttctaacataaaactgccggtttatttgcatgatacggagtacggagatgcgccatcaattggtgcttctcctcgtcctagacatacagtacaatacagacactgtctcctactactcgtcaagaacagtttagaacacattacgcaacaacaaaatacgcagaaataaatcaaaacaagaatacatcgatcgggtctacggccacagattcaagaagctggcaggaaacgagaggaaaaattaatggacattaactacatggagcaggcgttgtctgcagctaggtggcgccctctccccacacacaccgcagttactacggcacaggccggcaggcaggaaagggagagcttaaccagcaagcatgaggagacgcaggaaaaaaaagaagaagaaaagattgctgctttgatcttgatgaaattcatatgagatgctcatgaacaaaagtttttttgaaactatgttgctttttactctgtccaagcccacatcagtttttcttttaaaaaaaatcagagtggagtaagtgagtttgacaagagagaaatttacagtagatgatgaggaaagaagaatcaaaagcaccaagaactcatcaacagaagattagaacgaaagatatgagcatagcgatcaaaagaaacgacgataagagagagagagagagagagagagagagagagaggaaagatcgagagcaagaactcacctcaagttcagataaactcggcaactaattctcttctcctacctcctcttccaaaatcgaaagaaacgtcaaggagagagtttgcaagcagcagagggagaaggaaggtatgagtgagcctacgggggatcgcaggaagcctaatgaacaaggaattcggaagtgaaggagaaaaaaaaaatctgaacggaagcatggacacttaaataaaaggcatgagggcgcagagctgtgcaataaattcgatcgatgctctctctctctctctcctccctcttccctccctctctggatgatggatgtgttgtgtatatttacaggccagtccttggattgcttacaacacaagttgctgggacaatttgttacaagtgttccaacttttgtggtttggccctagtgtgtagggagtattttctcatgagtttttcagaccaggtccgattcagttgggtacttgtatgttcatgttcactaggaagaatagcattttcaggtgtcaaaaccttgtgacctgaaatgtctttgaagcacactcaaaaaatgactttaaagagtatactgtaaagaaaaaaaagttcattttactccctcaaattattccaccagatcacttaaccccctaaattatttttggctcattcgactccccgaactattgaaaatggttcagcttgctcccctaacactatttctcttttttttttctctctatacaaatcatatttcgtaatcaaaatttggtagaatatagatgcatttagaacttacatatgaactttttttttgaatttttctaactatttatatagttcgaaagcacttaagactgatttaaacatcaaaattttaaagctgaaacaagcatccacgaaaaaattcgaaaacattttcaaactttaataatggtattagttatggcctaaaaaatttcaacttaaaatacaacttgtattaagagtaaaaaaatagaaatgttattaatcagtaaagtgatccatttttaattgtttagaaggtaaactgaggaaaaaaaaacctaaggaggttgagtgatccattgaattagttaagaggagtaaaatagaccttttttactgttaaaaataatgtcttggttgcgttggagagtatcgaaaagtaacaaaattcatatttagcgaaataaggtttatgtggctatatagatggttctttttaagctcggtgagaaatagagatgcttttttatttaactttaaataattattcttctatgcagtataattatttttaccatacaaaattttgtgtaggttatggatactccacggtgcatgttaaaatatgagcaagtaacttttgaacttattttctaatttctaaatgggaaaaatatttttcgcactaggccatctgaaaaaaaaactctaaatttgacaatgttgatagtttaagctgaattcaaagcacttaaatgtgggagagttgtctcttaggaatatgtgacgagatgctagattactactcggtccagaaaaaaaaaaagcaaattctagctacgaatctgtatacgcatatgtccaggttcggattggatttttttaatgggacgaagaggaacataattgatgttttcctagcatgttcttgagtagcatataatccatttagtatttcattatccatttccactcagtggattttcatcttacagtagatagaaaataagatgatgttgcatttttacttcgactaatatacataatgaatgtatacaggtaagaatgttcctagcaaaaacaaaacaaaacaaaaggaatgttcatagcataattctgttgggattttcaaatatattacaatatataggaaccaacttatggatctgaaattcagaattttgagactcactgcttccgataacatttatttttgaatcagagggagtatatatatcatagagcatatcgcgtatatagaataaatattccattttaagtaaatgaaactatatctagtgaatgtctggtaataacatattatgagcagggcattattgagaaatggtagataagtcaaaggagagaagcattaaatagaggaggaaatggcgaaatcaaaccagcagtagaggacagctctcccacatttaagtgctccaaattccaaaccacctctacggacccaaaatttattagacatactggtaccaacgaagcatttctagacagggaaaaacttttaaaattaaataaaaaagtaccaatttgatttttttgcttcaatttcatagtaaacgatgtaaccttttcacgtaaatagaatcctaattcttgctatttggaatggatccaattatattgagtctagctttcttcttcgagctaaactaatgacctttttgctatgaaaatattttttttccttcgaacaaaactaatgtgaagtccttttcatcatagtttaagactggcaaaacaaatattggggcagatgtactgactgtgaggtttgtgtcacttgataagatgttagcgtgcgaaataatatactctacacataacaacatgtcacgctactactcttacatgttttgcatcatggtactgtgtagtaaatgtggtactagaaaggtacatttattagtttctccaacagtctgtttttggacaaagttttgtttttcagtctaaaaatgtgttgctttctgtagctgtttgtcactaaaacatatcaaaattgtcatctgaaaaagacaaaaaaattgcaacactttgttttgtaaaaaaaaatttaacaagaatgtagtcttctttataataaagaatacaccttagtatattttgaccgaagttttggaaattttgaccgaagtttggaaattttaaccacataacgacttgctgcagtagctggaagtaatttgtggattatctgaaattttattggaagcaatatttgtttatttaaggtgggaaagtataaattaaacttgacaagttcatttccagtaattgatttagtatgtatcttggcgtattattctttccaaggaaattttacagcccaattagtgtgtatcatctaatgaaaacctataatcttcagagagaaattttggtcttagattgattggcaatatttcatcatatgaaattttgattgatgaaagccgtagaaagaatctctgaaaaaaaaaagttttgctatatggatctcattatattactacaagatagagacaagatgtcaccaaagccaagcaagtactctattggcagctcgtctgctaaattacaagcccaaccatgatttgaattttgaaatatttgataaaaaaaataaattttgaaatataattttaaatatatctagttagttttcatcacttttctattattcagtcttgtttctacaacgctaagagtagaagtgtaaaatttctgccttaaaatcgtttttggctgctactatattgacatactagaaatgctagactctcgaaatcaagaattaaaacattaatgaaatgcatatacacaacaccatcaagctaagccatctaaaccacatcctgccttccgttaggtttcgtccgatgctgaccaacacttgatggctcataagtttcaggaatagaccgcccaactaatcgaaacattgaaccgaaatatttcagcttagcttgcacactgacgacctgacagggatgcagtcaattcggcaaaaatatgtttaattcaattagccaggtcatatgatctgacttgtgttttcttatatatacaacatgaatatgtagtacacgaatgttataatattgtcaagggacaaacgctagaaacctggcctgagctcactagatttgattcatgagatagttttcagtgacagtgctaccatattactatattgctaactatgttctgtttcatccgatagatcttcctttttgaattcccatatctgaattccgcaacactgcctactcttcgttttgaaagcaaacaaaagaggagataatcttagaaggatctttccatgtgcgagagccatttggccaaacttaattaagcagagtgcatgttctcatgaacatgggatgcgcttcctgttagctaaagtaagatacatataagtgcaagtaattaataaattgtattgattcaagtgactactcttgtatgatatctgatcttgggctttgtccattcagaagggcaatgtgtatatttgcattgaatggaaagagactcagtattcagtatttgcaaaccacaggtaaaagcaatgtctcatggcatgggccgagcagatctaaatgtagagatgccattgttgcattctaaatgaatgcttaatgcgtcttaagtagtttggagaaagaatgacattacacagccgtgtctgcagaacgaaaacctgtacaacaccttgagtatcaagatctccattaattcatctaccctaggactagcagctggggaaaaaagatatcctttttgataccaaagtgacaaaaactggaaaggaagcaaatcaacctaacattacgatgaccgaaaagaaagacggcaatcaacctaacattctgaaaatatcctaggaaaatgttcagcatctgtgctgacagttcttctcctgaaactccccggtcaatggagcagagatgatccaccttctggcttctgctcgttgcagcaacgtgacattatgtttagatcctacaggatgttgggcacttgacttgagaatttctcctgcaattcccttatcttggaagagagctccaccttctgctccttgtagctctgaagcaggaagtccttcccttcgataacttcctttagctcaccgacctccctcttgagcatctccaccctttctgcctctcctttccttttgtcgaggccaataaaatgcagctcagggtcatcaacactgctgctatcagcatagccattggcatgcccattggtggcacctgactgccaatgcccagccagcaaaggtttatcatgagagagtgcttctgcaacacaatgatctgcaatgatcttcctcaggtgctgaatctctcgctcagattcgaagagatcacggttagcggaatccagctgagactgcaaattggtggaatgtgtctcctggatgttaagagagtttttaagatcagcaatctgagcttgcatctccatgatcatctcatcacgtttcttgagatgctgcctcagcttctgtataacctctttcttgctatagatgtcagatcctgattctgaaacacaaggagagccagaactgtttgagtactgaaatggtttacgaggatcctcaagtcgatcaggtgatgatatccacatgacgccattattctctttgcttgattctggtcctggtatcttcacaagtggaagggagggttccatctgttttgatgcaggacttgcaggtgcctgctttactcctactccattgcctgaaaaccctgcaaaaaatagcaaagaataaatacttcccatatgttgacaaagtgccatggcaacaaaaaattaacaaaaagtttttaaacacaatttacaatgtggaaactacaacacaatacaatgtaacttagttatattaattccaggaacataaatgtaagaacagataggaaacatgaaaattgcttaattgtctgtaaatgcttcacagccagaaagacaggaataaagtaaagctacaccagcactttctgtgtatcaaagtgctcgataaggaagtaagaaaatgtgataatgacaatagtactccactcatataaaacattatcttcttttctaattttctttctctgtgcataaacattcttctgtacagcagcataattatggtcttaactcttgactaatgactacagctggtaacagacagtgcaagattaggtcttagagttataacaaacttacatatcaacagataatttctgtatgaaccagaaaaattgagcaagttgcaatttctcaacactgttatttagttctcatttctggggatgttgttattctaccattcaaatcgagcaagttgcaattttctcagcagtgctatgttatcatttctgggttgttgttactccagcattttgcacgaaagcatcttcgtcaagagaatcctagtagacttagttactctgtctgtgataagttctcaaaagaacaacgatcaagtgcgctttcatttcatggaactaatcacactatgagctaaaatgagaggcaaacctgatggtagtctgggcctctatagtacagattatagaaggtagcgtggttatttcacggacgactaataactttttcatcccactagtagtgattttgataaaaacgtgcctggtttttggaaatgtcgaagaatgatgcttaaatattttttcccaacagtttggtgtacaactcataattttttttatgagttgagatcgagccttgaaagtgagggaagaagggtattcagcaagtttgaagtgctgaaacaaaatgttatgaatgctgcagaaagtattacgcctaatgtttttccattgaagctatacaaagataatactgcaaattatttttgaaatgcaaatagcatatatgcatatcttatgatactgtaactaagatagttttgcattttaactctataaattgaaggaagagtgataacaatcaaaaccacataggctggcaggtacagcacacagtgataaaaaggcaatagatcgtattaagttacagaagaagcacctgaattacaatggtagcagctcaggtgatcactaaaccggtagagatttgagtgtaactcacatgttcctggccttctttgggctgcaattttgcaaagtcagcagtcaacatttaaaacaatacagacaaggaatcaaggttacaacagcaaatggaggcattagacctttggaagtattactatttcgttgcttcgcatcaaatagttgtttcaatttgcacccaagtttaactgagagtgtgctcagcaaaactcctcccgcaacaagaacccagtttggtcctccttggacattatctgtttttctcgccttctgtatgctcctgttagtctttgacttcatcccagcttgtacgaactaccgatcttcagcgaactgtacaaatgcagtagcttgacctagaagacatgtataaaaacgcaataagcacaacagctcccatatcagtacagaattttcagttataaagacattcatagtaagagttctagaaaatgtatgttccataaaaaagtacagttaaaattgaaactgaaccatatgacttcattgtccttgcaagttgcaaaagaaaaaagatcaaaatgaatcggtaaataacataaaaaatctggctttcgaagataacagcgacaccttcatattcaagtatacagaggaattatctttagaaacagtataccaaggaaaatgacagtaacaatacgctactacccctaaaatggctttgcattgtgcctggctatttagggttcagtttaggttgccttctaaacatctacaccatgatgatatatatattcatagactaacaaacactgaactcacaaaggaatcagctagagttttttttaaagaaaaaaaaaagagaaaaacaactagagtttatacaatcacgttgacaattttttttcttcttctgaaaagtgaaaattacaggttctccctttccccaggagacatgagaacatagcgaattacagattcggtagatgtaaaccatttttcatggtaggacaattcacagaagtccatgaaccacaggtctgcgaatctacccgagttttccctcccctcccctccctccacgcaccgagccgattggattcaaccggcctccgccgtcccccgtcgccggggagccaccttccactttccccggcgacgagccagcttcaccgattaccccgacacaacaaggacgagcacacagaggccaaatcgaggaacacccccccccccataccataccagtgaggaggtcggaccagagtcgtcgtcgacggcggcggcgcggctccccgcccgctgaaattcaccgccggggatcggtgacccgggggggcattgccatcccctgctgctacgcttccgacggcggcgggcacagctccggcgccgccgcggcggaggagtggagagggagaggagatgcgaaggaagtgggcaacggagagagtgggaaggaggagattgtgtgtttgggagactcggaaaaaaaggtaaatccgtttttatccaccctcttcttcttcactcctctgcttcttcttttttttttcccctttggttatttttcgcttttaccttttcctttttggagattgctctgctctctgctttgtttatattcgccaaattcattttgtttgtttctttctctctttttttttgcgagaagaaatttgttttctttttttcatatttaggaatgcattggataattccagtgtcagtattgttgttgcaaatactttggtcaagcggtggaaaacgacatcgatatagaatacggaaaggacatgatacaaatgatagctttttcttaaccccgtaatgttgttgtgttctataagtactttacataatttatgctttgaagtacatctcaatgtcgaaaacattgtagtgttttaaaaatgcatgcatgtttgagcagggacggatctacgttactcaggccggtgtcaggcgacaccgacgactttcggcaaaacctataacaaaattgcttatctatatgttataacattatgatctaaatattattagtatactatggcaccgatagacacgttatgacactaacaaatcggttttctagatccgccactgtgtttgggcttagggtttttcttataaaccgatgacacatggcaagagtaatttcaagctaagactttaaagcatccacagtgaaaaccatcctaagagtatccttagagagagagcgtgtgctatgtaggatgatgccacaagtcgaaatactactcttcttacgatgcatagtatattctctctcgagtacgcgacacaaccatcacctccaccctcggatgtgtcatccttgccgcaagtccctcctcctctatggccgtcgtagccctctcctttcgcatccctagtgaactcgagcgcaacggcaaaagggttcgacgctggaaggcggggatgccaccactgctgttgctcctacgcaggtgtgatgatgatgagaaggccacgaagaaagaggcaatggagagggagtaggtggtcttaatctcgagggcagtatgctagtggtggcgcacaaccaacaatggtagttgcaggtgtaggtcatcatgggaataggaggagttttcgagtgcctcgctgtcgccggatgccttagagcaccaacatcctaaaatcgatatgtgtcgttgtttcctgcttttctagcgggtccaccacatttcgatccaactccatctctaaatgtgtatcacatattgacatgtttagacatggacgggtatcatttggtatcagacctaatattatcctatccagacgggatattgcagtatatcagttagatattataatcttgtaaaaatactcactacgcactagtactacttttgctcaaatgcaacatttatctatatatctatattcttgacttgctaaaaatattgatgtcttactgtcccttagccctatagaaaaccttttaaaacacgaaccaatccagtgttctaggagtagtatttaccaaagcaatatccatcaatgtgctctgctatatggtttaaactcatattatctaaaataaataaataaaaactaggggtaaaaccttccacgcttgtaattgaatataccgtatacagacagccaacaaataatccagagccataatcacccatttcaccaacacagccatactacaagatttgagcagtcaattaagttggaggtccacattaaccctctggtaggccagtacaatagggggaccaaaagcatttactcgtgtactgtggaacagtacctcacactcgcacagcctactgcctccggattgggagctcgtaccgtacgtaccgacgtcgagcgattttactcttccgaccccgtgggcccgccctgacagtgaccgttgtttgttctccttgggagcttgggggcgacgacgaccgtgcctttggctgcctccgccccggctgagctggcgacctgacgtggacagcagcagtggctttagcccacacgcgtggccggcggtgagacgctgacacgtcggcagatagctttctgggcccaactgtcaattaatataaaagccaacctaataatccatttatacaattagttattggttgtagataaatattgcatcattaatatctaatctacctatctctcacatagattattaagcacatgctgcagctagttataaatctatagcccgtttttcttgcccccccccaccaataagtacgaatataacgtggcaacttgtacaacctatttgcatcatcttgttatacctgctcgtcaccttattgtaccggctctcacagacgtgtctccaacaaactaggattctcctgcttcacagtcacatgacccacaggccacagtcaccatgattataagattagagtaacctggtccgtatcaggagtactccatgataagagcatattgattgacacctacacttccccatgcctttttatcacaaagctttttcttcaaagttttattaaagtgtggctatgagtttgctagccacaaaatttaacaaataaatactccgtgctcagtgacagttctgagggtgatccaggtgatcccttgatcaccatcaattttggtcccgaaggactccctccttcaaatccagccaatttcactttatatgaaacggcggattcaaaaattttcatgagtctggacaagtctaacaacaaataaggtatacacaaacctataatagataactttagtatgaacatttgctttaaaagtttgtgttgagcgtgtttgctgctttactagttgcattgtactgccataccggtgagtaagaaagattattgctaaggtaattaggcactaatttactggtgaattgctgcatgtagctggtagagcccgggccattgcccgtgcaagccgggccttggctccgccactgtttatatgcatggcttaatgactatatatgttgtaatttttacaaagctcaaatgctaattttagtggatttgtaatattatgaggtactatatgctatatttgtatcatacttctaagtaaatacgttagagaattttgagcatggagtagaatcacccaacgagaaattcctaaagctgccactacgtccgtgatttatccccagaagttggatttctcaggaacggagagagtatgtctaagatcggtggagcagaagtgtgatcaaccacggttatgacaataaatcaaacacccaccaaacaaagtgtaacatgcttatattccctcaatttcatattataagtcattttgatttttttccacttttttaagtttgagaaaaatataataatatttccaacacaaaacaaatatattattaaaatatattcaatgttaaacttaatgaaactaattaggtgttgtagatatgttgctaagtttttctataaatttgatcaaacctaaagaagtttgactttaaaaaatcaaaacaacttataatatatgaaacaaagtaagtattccctccgtcccataatataaaggattttgagtttttatttgcaacgtttgactactcgttttattcaaattttttttgcaaatataaaaaatgaaaagttatacttaaagtaccatggatgataaagtaagtcataaataaaataaataataatttcaaattttttttaaataagacgaatggttaaacgttgcaaacaaaaacttaaaatattatattatgagacggatggagtaacatttagtgtgacaaaatgtggcacctccatgtgctcagctatggctgcagcgtggctttggtttataacgctgtctttcctatctggctgggccatacattcagcctgaaagcccgattgtgagcccacgtccgtgacagcctgtcagacgccgatcgaggctttgtgcatttcgctgttttgagtgggccagggaatcttggccgtccgttaatagattcctttctttcccagattgtgacctggcaccatccagatggattattcatcagtacataaatgtactaagatggaatgcacaagtgagcatatatgacagaataacacataccgataccatatagtaactatacaagtagtgccatatgcatcctatgtgtcggtcttgaacataagaaatgagacttctgtagattgtcactatgctctagtcagctactccctccgtcccaaaaaaaaaaaagacaaaccctggtttccgtgcccaatgtttgaccatccgtcttatttgaaaaaattataaaaaaaattaaaaagacaagtcatgcacaaagtattaatcatgttttatcatccaacaacaataaaaatacgaattataaaaaaatttcatataagacagacagtcaaagttggacacgtaaatccagggtttgtcttttttttttggaacggagggagtatcccgttgcttccagacatcaaatcaagcgatataacagtactgatatcgtagcatcaactcatgatttccttttacagcgccaacgtaatgcaaatattattcgagttgcgcgtacacaccttcaagattgctgcttatttcaatattactggcagtgcaaacaagttagtagccgaccagattagttccttctcttggaacattttgtcagtcaattacagataaatctacctatattgcacatggaattagaactgaagattcattatgcaaaagttgaaagaggcttaccagtaattcctatgttgatgatttattgaaactgatcgctgagtgcatttccaaatctttcggcccttccatatattttactggcaacaatacttgccacccaaaaaaatcagatcactcatcggttcaacaaccagcatcagaaattgtgccacacagtaactcagaagatccgtgacaaaatcgtcgaatcaaacttggcaacctctcttcagatcaataaaataataaagtagcgaagcctgccatagcggtatgggacttttggctcctacaaatctgtaaacactatctgtcgacctgatatagtacaggcacacacacaatctggattcaaatgctttgcgctcatatcagtcttcaaaaatctgataatcactgctctacaaagaaaaggaacacggtattattagctttatgatcttttggtgatatcctttttctattaagcttcaaactcaagttatctttcgagtacagcgctacagctttatcaaaagggatgtttctgctcagaaaatctgtacactacgcatggaaaaggaaatccaaggaatggtctagagaactcaaggaacatataacaaaacaaagccatttttttcaagaaatcacggaattcatcatttttcctgacggcctatcaatttagtgatacatttatgaatgctttctctgaacacctcagatatatgtcaatgtttgtttcccttgataacccaagcaattaactaaccttgccaagtacagcaagttgttttgtatagctcaaaaatcttcctttgccaagaaaaatagttcacatgggtaaatgtcaaagttatactctatggaccttatttgtggatatccagacacaatgttccaaaaaaaaaaacaaagaattgtcaacatatagcatcaagtcgttatatgtgcttccaccattatctagagttcttttattttcttagttcaggagctacggattctcatgtggtgccatacattattcagtgaacacactgaaggctagagaatttagtatcaattcagtaagtaaagttaaggttagtattgatcaggtggaatgcggaattttatatttgtacacttcggtcaaaagctttatgggaagcaacacatatagtcatgtactgagagtaacaaataaatagcaaagtcataataccaagaaccagttttgtaccttccagagagcaaatagagcgtgaactcattttgtgtgtgagagagtatgttggatgatccatttcacatcacttggtgcaccttgtgcttgaacagcacctaatgagatgccagtttgcacagctgatggggatttcgcttcgagtgatgaatgagacttgtgtggcatattattccctgtcaggtaattcctcagtcagcattgcataggtttgatgacttggtctgcagttcatacgctctaacatgataatcatttcacgggatatatctgagtgacctttttttatcaggccatcaataatcactttccacacaatctcatcgggactatagtctttccatctagaattcatgaatatttctttagccttatctgtttgtccttcacaaataagcccagaaagcagatgttggtaggacatcaactgtggtataaaaccatgttgaatcatagagcaaaccaacacccatgcatccaaataccttttggatttgcaaaaacaagtaacgagagcagtatagatgtcttcattcagagatatactatcttctttcataagagaaactaacgatgtcgcctcttccgttcttccatcttcagaaaacccctctagaatggaagaataagttcctgaattaggaagaaattcgttcttcttcattacatcaaacaacccaaagacatcagtaagctctatggctttccacacaccagctggggtcaaaggcaacacatcctccactaatctcatgcgtacaagatgtctaagcaagataaaataagtaaactggtttggcacagaagcaacacttgtcatttgtttcaagattgagactgcatgatctgtctgtccaatacttgcatgtccatccatcagagtattgtatgccattgtatctacagtgaccccatttttgctcatctccatcaaaacattttctgcttcatttagtcttccttcaatgcagtaagcacgcatagacgttgtataagtgactacatcaggattgcaacctgatgaaaccatttcgccccaggttctcgcaaccaatccatagtttctctcctttaaaagcttatgaatcacaattgtataattgactgttgagggcttcacatccttttgtagcatctcccctataaaggacagaccttcttgtgaccccttcatcttgcataggtgttcaataaatgaactgtatgtgtaagtatcgggtgtgcaacctgcagaaaccatcttttccaaaaatttccatgcaatatcagctttaccagacttgcataacccatttatcaaggaattgaatgtcacggcattaggttttatgcctctagtttctagactatcaaaaagggagcaagcttgatcagttcttccatccttgcagagagcattgatcaacgcattatatgtgtactgatcagcaattaaaccatctccttccatcaaacgtagcaatcggaaagcactctctatatgtccatcaatgcattggccccgaatcaacaaattatatgtcacagcatctgggttgactccacatgctctcatcttgttcaacaaagtcatcgccttgtgcacctttccttcattacagaacccttggaccaatgcattatatgtccacacatttggcttgcaccccctcaacttcatcaactccaacaccctcaatgcatcgctcatccttccctccttacaatatgcatttatcaccgcagtgcatgtcacaacacacggtgccaatcccttttcaaacatctcctgaagcatttcctcagcctccttggccttacgctccctacaccggaaatcaaccacagctgcataagcacgggtgcttggccgccaccccaattccttcatcctacgcagcatgagaagcccctcctccccccgctccgcattacacaaccccttcactaaggctgcatacatgtgcatgtctggctggtccatctccccgaacaactccactgcctcgtcaatcctccccgcctcacaaagcccctcaatcagcgtggcgtaagagaccacgtcctgggcgaaccctctcaggggcattttgtcgaacaggtcgcgggcaacgtcgacctggttggtgcggcaatacccgacgatgagggagttgaacgtgtaggcgtcggggcgccagccggagcggaccatgaggctgaggtaccgcagggcgcgggcgaggtcggcgcggcggcagagggagcggatgacggcgttgtaggtgggggctgtcggcgccggcggggcgtggcggtgcatgtgggcgaagaggcggagggcgagcggcgcgagggcgaagcgggagaggtgggcgaggagggaggcgaaggggcggtcgaagagcgggcggagcggcgggggcgagagggagtggaggcggaggacgaccgggagcgcgacggcgaggaggtggcgggacggcgcggccaccctggccgccgcggcggcgaggcggacggggagcgggacggggagcgactccggcagggacggcgtgagcagggcagggaggcggggcagggaagggttgaggaaccagtcgggcgaggtgaggacggcggcgaggtgggcgaggagcgccgccgggttggtggagcgcggcaaggctggagacgagcccatgggagacgttcctgggtacgcgcgagccgggggacgcggcggcggcggtggcgtcgcccgcatgttggcaatcggcggcgagctcactgcgccgccgccattgctgggggatctcggctctgctcctttgccaggagccgggttgacggcttgacgctgcccctgcttcgagatttgcgcaaggaacaccaccaacggaagcgattttcagattccaatttcgggagcaactattttctgccgagattcatataaaaatgtgtcacattcctttgtagatttatttttaaaaaatggatagagttttgattttaaacctggtataaattaatgtattacatgaagcaacgatgtaaagtactgtatgaattacgaatggaggttctataaaaaaaaaatatgtagcgcaaacttcatatgtattacaaatatagaaactatcgtaggacaaagaaatgagcacttgacatttgcccaatccatttctatatcctacgtatttcaagtttacgctacattttatgtgaagtgagcataactcaatcggttatttttcttgtggtgaaaccaacccacatggtacttgcatttatagctaattattctttcagtagtatgcgatgtacctatctgtgtgtatacgctcatagaggtgagtgcacgcgcgttacggaaaatactttgggatctagaaatggacacctaagatttagctacgtcaccaataattgtttcctcggttgtgtttgagacgagaggaaaaaaagaatatggagaatatatgtaaaacgacgtgagttattaacacatgattaattgagtattacttcctccttttcacaatataagtcattctagcatttctcacattcatattgatgttaatgaatctagatagaatgtgggaaatgctagaatgacttccattctgaaacggagggagtaactcatttaaatttttttaaaaagtaatatgatcatttaaagcaacttttctatataattttttttaaagaacaccctgtttaataggtaagaaagcgtgggcacggataacgatataattcttctctcaatccgtactctctcctcttattacggcagacgatccggatccctctttcttgcttgtttctgacaagtggaccaataaaattatttattcgtcagaaccggttgcttcttctgaaatgtctttttcttagagcctcgtgttagtttctctactactatctccgtaccaaaataagtgcagctattagtttccacgctcaactttgatcgtccgtcttatttaaaatttttttataattagcatttttgttgttatgagataataaaatataaatagtattttactcgtgacttatgtttttaatttttttttaaaaaattttaaataaaacgaatgatcaaagtacaatatttaggacggagggagtacaatatttgagactggttttatgttcattctctctctagtaccaatccaaagcatacaaatgcagaaaaaaaaaaggcgctcttccagtttgcatggatgttctgtgatagacagaatgaatattgtgatatcaatggttaaatctagtttcagttaataagtacattcgagattctagtcccagtattttcccttgatcaaatattcctcaaacactaacagcccatagtaacgatctaatcgtccatattcatgatgctctggcacatttcaggaaccaataggacatcagaatcgatctcttacgaaggcacacatgaaataccttttcctcttgcattctactagtagttacctttaaatgtccaaatgtaatgataacagtgatatctgcaccgaatcatcaaccaaacaagtgatgacaaacttctgtagtactaattccagtcattacacgctcaagtcaaacaaccaacccttgggaaaattaggattgccagaagaccagattgaccagtccagcggtttcttctataattttataggagctttgctctagagtggcagcaaggaatgagaagcagttgatcaagatggaagtaaacagaagcaaacagagcgtcatattacacaccctttgacagaataaatccagcattccggtacaccgtactagtccaacatgtaaggcctacaaaactaaattcagagggtgctggcatgccagaattctgtcactggtacagttcgcgccatggttcctgaaagacgggtgatttttcgatccccctctgaagaacggtttctttgctgaattccaagttgatgtgcttagccaagtgatcacctacacactgcagcacctgaagcacaacaggtaggggtcggggtgagccaacaaatgcaagtataaaaactgcagatatattttgaagatagtggcaacaggtacagagaagttgaagttcctgggtgggagtgtggggcagacaaaattacgcaagaatccttatataattaccaaaagactagctccttgcctccttcacagaatcacagttgctcgaaactaaaaaactatttccttttcctacataatttttactgtcatgtatattgcttaatattgcagacttacatcatgaaatggaagtgctgaaagttcagatctctaaccattataatattatttccgacatcatgatgatatacatacaattatttggaaacatcatggtttctggatttctatttggaaagaagaggacatagagcacattttcctattactggacacatattttatagttcaacttcaatcttggttctaacataatattttcaagataccaagtctacaggttaaccttttctcatttactatattaccataaaattgacttcaagcttagccattaaaactgtagtagtttcctattctgcacttatcttcatttagaacaagagaaagaagaaataaactgcaaagcaaaattcaattggaactcagcagtcagtgagtatgtacctcaaggtccacatctgtagagctttttccttggtgctgcccaccggatgcaaaaagaataactgtcggtatattcaacacacgtaccatttccagcaaacagagtattggctcacttcgcacttgtaaagattgaggaagtttagtagttccgtcaactaacatctgagtaaactcagttgttgctcctatttcagcaccatggagtgtagctaactgtcctgtttttgctccatgataatagtttggcgatcttgtcataaatgggacaatgagggttggctgagtggatggagcttccgaagaaaccaatgctaaaatctcattcatagcacatgctgcaacaggaggcttatagtctggtaggacaaaaaaggacacctggcaaaagttaacagaaattaaatatatcagaaagaaatgaacactcccaagtaataataaaaagaaataggtaaaaaactatatatagttggtcagccagtcattcagtatctattggtcatcaaagaactgcagaactgtataaagtgacattgaaagagagagtgcatgacaacagttctacgaccttacaattgcataatgtgaaaactgcaaaagctatcaggtgccagctgactagcagttaaccataagacatgaaaattaacctttcctaacagggcaaagcaacatgaaatcaatagatctagggcacaaggtaaacctgcccatctgaaaaaattatgacaaccagtaaatcacaaaaaagtagccttttgcactggattgcctcaggttgttccaccataatatgaggtaccatttaatcaactgtaaaatatgtaatttttgcgctgaccaaatgcaacaagataatttagagcgctacatccataaccatgaaaacagaagtgtctattctatgtttgctagacaggaagtacaaagatcttcaccgacagaaataagcccagtatacatgaacgcatgcttatataagtcagttcaaaatgaagggtaataggctcgcagcaatcaaaagagtgacaactgacaaatacaactcaggcttcatatatcaagtgctcaaactgaatcatgatgaattgatgataatcagttccaaaaactcagatacaacacatatgttcatactgaaaccatcagttctctcttcctcggcaacaaagttttctgtgcctccaaaacacactcgccagtaagttgattggtgcataccacatcaaaccccaagacgcaagatttactaagtgactaaaccatatcgtaagagtaagttatagtattcacgcatttcagtaaaattgcgacatataggccgttttggtttgaagcctaccaaagttgttgtagggcaagaattggcatcaaacaaaacaacccatagattagcattatagatcggcaaattttggttccaatccaaatggccacatagtaccaattgaagctaccatttataactggtagggcaagaatcggcatcaaacaaaacaaccctatatctttcggttcactgacattgctccaaaacttctaactataataatcataaaaccaaacgaaaatatcctagtatgcagccaaacagaggctaatctgccagctcaacacagtacatttgtgcacgataactaatttccccctacaattgcttattccaggaaccgtgtggttcattcccccaaaagaaaatgctttccatttagctcaagcagctaattgttgatccaaaaccttcacaccacgcgaattggatctatcagacggggccaaaagccaaaaagggacgcttacctgcggatcgccactagaatcggagaagttcacgagctcgccggaggccttctccccgtcgaggccgtacttggcgagggggagctccaggggcgtggattccctgcaaaagcatccagcgacgacgggtcagctaccgtaaggcgctggattttggtccttttgtggagagagagagagagagagagagagagagagagagaggctagggttttagaggggggacctcgtgagccccggcgttgggcggagcgcgtcggcgagggcggcgccgtagccggcggcgtcgcggacgaggacgaggaccttgggtgccacccgcatggccgccggtcgccggtcgccgccgccgccgccgcgaatgatcggagggagagaggagaggggagggaattagcggttgagcacgcgaagagccagagatagagggtagaacggtaataacgagggaattcgttagaagtttagaagtccatccaattatttgtagtctcttcaaatttgaattcgtagtagtatttggtatccgtgtctgaaaaaaattcagattcttgattgttttttattcatcttatattttacagcatataaaagtttcttggatttgttcacgtcaccgtgaacaaaattggttatgaaacgtatgaatttagggccctttgaatcgcaggattgagaaaacgtatgaataggaaaaacgtaggattttgatagaaatgtaagtgtaaaatagaggattgcaaaacgcaggaaaaacacaggaatgaccgtttgattaaaccacatgaaaaatacaggaattggatgagagatagactcaaaggaaagttagcaagaggttgaagctcttgctaaattttctccaaaatctctataggattgtccattccataggaatttcaaagtattggataggattcaattctttgtttcaaagggcttcataagaaattttcctaaaatcctataggaaatttctatatttttcctccaaaacaaagaggcccttaggtttttatgattggagtataaaagttactcccatgaaagatacgcttatggcagtatatataataagttgtgttactgtgatgagcacagcaatatgcaaatagttcaatttgaaaatgaaaatgtaacaacagaggaagagatcatgctcatcaaacattaagatcaaacggttgtattattggctttgaatgtaatcacgaccatcctcaaaatttgcttctcttaacacctaactagcatggtggcccgcgcagattgcgcggctagcatcattatatttttctcatataatagcatatatgttttctcattatattattcaaatatattaaaataacatcataattttaaatttttcaataactttacgaaactacaaatgtgtaatattcatattgtattttacatatgtgttagttattaattatttttaatatcaaattttagttatttgtaaattatatatattcctatatggactctagactcatcttttaatatatttttttaattccgaattttctgtaaattgtatttctatatagactctaggctcttcttccaatattatttatttttatttctgaatttttattatttctaattgtatttctatgtggactctaaactcatctttcaatattctttaatttttaatttcgaatttcagttacttctaattatattcctatattgactttaaactcttcttcccatgtttttcttaatttcgaattttagttatttgtaaattgtatttttatacggactaaaactctacttttaattttattatgtttattccgaattttacttagttttaaattcctatatggactctatactctatttctaatattcattattttttaattccgaatttctatatttttcttaattgtatttatatatggactctatactctacttctaatattccttatttttaattccgaatttcagttatttcctaattgtatttctatatggagtctagtctcctcttctaatattccttattttttaattccgaatttcaactatttctaaattgtatttctatatggactctagtctcctcttctaatattccttatttttcaattccgaatttcagctatttctaaattgtatttctatatggactctgctttttctttttctccgattaatgtgacaatttctaggccatgagagcgaacgtggaggctcatttttctattcctttaataatataatagattgaaacatagggtttatattggcttcctaattagtgaggataagttactattggttgaatttagcgaatagtcgggggcgtggagtcatgggcgaatgacttcattcgtcggagtttaaattctggtacccacaaatattacgtttatgcagataggtttctaacgagattgtagtgagattatggatgtactactgagtatcatcttacgtgtgcagtgatgtgtctgcgtgtgtgtatgtcgtgtaattgtaaaagaagcccatacccaggcatagtcttttgatgctcttcttgaggtggaaaaactggttttggcattcactggttggagacagtgaaagcatcaaacattggattggatgtccaaaaacattggatatattggatgtcctagtcttgaagatgtgtacaggagaatggtacatatacactaaggtgaaaattttgtactgattggattttgatgacgattgtacaagttgtaccctttctttgaaagcgttattgtaggaatgaagcttgaaatatctcctcgctaaaaaaactattgcaattttgtggttggtcggcctatggtttcaatgacaggttcagattttttttttccatttcagaccagtcttagcattgataagtttttatcatgttgttctttcttcttagtcgttttaggtctcaattaacatttagctaatgtagtggtaatgtgcatccttaagttgacgtcggatgcagataccagggatttatacctttcttatttaaaaatgaaaactctcatattttctagagaaaggacaaactactgttctgttttttttacttgaataattcttcattgaaaatacttacgaacaagttcaacagttgcaagtattccaacaatcatgttggttgtccaagtttgttctagagggaatatatcaaggagattcgagtatgtcgtctccccctaatctactgttgtcatttcgtgacatgagcatgcatgatcggtacagctagctatcctatttgtcaacaaaataaacccaatttcccggtggtccatctcaccatgttgaaaaatgaacgtgtgaaaccgtcctaataacctaagcgtttaattgactcttggagcaaacatacaacaatccttgacttgacttcattcacggaacggcagttgtcccttggccactgatcgctgagcctaaataaggatttaaaagttatctcgttttataaaccaaaatggtagtgtataagttgagaaaagtccattagccagtacaccggaatgcggcttggtttatgataaaagtaaatcgaagaaacgtaaagagcctttcccacccaaaagctattcaacgaggtgagggaccaatcaaggataacctatatattataatctaattaagcaataggatactattttctatctcactctcaagtactagtactacttcaccgcatcatctgtactactctatcttatcctcttcgttcatagccattcaccgcatcatctgtactactctatctcatcttttcccccaatcttctagaggcatcgagagcagcaaaccgatggtgagcttggtggatggcgtagcgagctcgcgtgcgtggccgagctaggtaccggccgaagcaagcaaggcgacagtcggccgacgagctcgcgtgcgcggccgagctgggtaccgggcgaagcaagcgaggcggagcaattgaagcgggcgcacggtaggagcgagctgccaccatggtcagcacaagctcgagctgcgtggtttgcgactttgccccaccacgccgccgtcgactccgccacatagcgccgcccatgagctccctccggcttgagctcgaggggaacaggagagaggggggagaggggtggaaggggaatatggaggtggagcacccgtcgccgcaacgcgtgcctcgagcccgtcccctggccgaaaaggaggaggagccgcgtcgcccaggcaggagtcgcgtggcgtcgctgggggacggtgcgaacgaaaaaagcaaatggagatggacggaaggagctagggacacgcccctgaggctacccgttgctgatggaaaattcatgtgttgaatatattcgtgtattttgaatgcttcatgtcttcaaattccttagtttgaagagaggggtagaagaggaaaacaacacttgtggctttataggttgggattttgaggagcccatccaggggtgttctccattgcgagctgagttcccctacgagtgtcctcagttagtgaggacactctaggaatggcttacattgtggatgcccttatatattaggtctactttcacacattggtgtacctcaaccctttactgcccctttcccaccccaaaagctgaccaatgaggtaacgtgagatccacggtccatcaggccttcacacgtacctcagccctttaccaccccttcaccagatgttgaactaaccaggctctgatacaaattgtatgatcgtgaagggtattttccaccccaaaagctagccaatgaggtgagggggtcccccacttatatattaggccacttgcctttccacaaccaacgtgagattattcaacagatatgtactccatctgtttcaggttataaaaaattttgactttaatcaaagtcaaacggttttaagtttgactaagtttatagacaaatatagtaatatttataatactaaattagtttcatcaaatctacaattgaatatatttttataataaatttatcttggattaaaaatattattacttttttctataaacatggacaaacttaaatcagtttgactttgaccaaagtcaaaacgtcttataatctgaaacagagggagaataatttagtaaataaacttgtaaaattttcatttcaatttataaatttgcgtagtgcgtgtaaataatctgctaaatttgagatgaagcttacaatcacccaatagtttaactagggtggtttttgttttgtgctaccttactactgacaattaacatttgacaaatctccatttggaaatcagaaacggagcctagaaagctgatcgggactcaactcaaactaaaaagtgaaagtgctgaaagaatttgaagtccagccaagaagcaatgccggttaactatcccttttgcgtctggcatcagctcaaggaattaaaatagttcagaaacgggggcgcgacgatgacgatcggttgctatgtttaatcgatgtcgagtgagtgctgattggattctcgggatgcttcaatatctatcttctctgactctctgtactgatggtgacttgctacaggaattttttttttgtttaatcttctgaagctgcaatttggtttccatcaactaatccaaacaattaacggtgtgcgtatctagcaagttagcttctacttctacagttctctattccttgatctttatcagttattcaatttactgtcttttgcagttccctgttcctttgatcgtttactactcttctgtagtctctaaccgagatgaattgtaaatctgggagtagttttgcatcacaatctttaatagtacaagacaaagctaccactcttctgtaataggagaggtgttgttcttgcaagaacttcagataatctctgaagaaatccaagcagtaacagagttttacaggtacagtttttacgatatacagttttattattatacatggttaattcactaggttgtgcagcaaaagctgccaaattaattaaccgcaaaagaaagcagcaaaaggttaacgaccttcaaaaatggaaaagaacaaggcaagaaagcaacaagcaaaatcacacatatgtacatgcatgcacatatataggtaattttatggatcgagattaatttggtgctagagaatgcagcaggcgttgctgtcgctctcgtggtggcggcgggagcgggacaccgccttgaaggtcttgccgccggcggctgcggcggcggcgcggccggtgccggcgccggtggtggtggtggtggtggtggtcttcttcttggtggtggtggagtggttcatggggtggtagtcgtgcttctccaccagcggcgagtagatggccgggtggctgagcgccaccgcgcgggagtagctgctgccgccgtagccgtagccgccgccgccggcggccatcgccatcggcgacgggtggtactggtacgggtacgcgtacgggctgggcgccatggcgtacggcggctgccactgctgctgctggtggtacgggccgtacggcgacggctggtagtggtacggcgacgcccgcgtcgtcgccatcgccctggcggcggcggcgtccttgctccccggcgccggcggcggcatgatcatcccgcccgggaacatcgccgccgccgcctcgaacgtgtcgacggtcctcagctcgacgatctcaccggagcccaccttcctcttgagcttcttggtcagcttgttcgtgtccacgccctcgccgatcaccagcagcaggttccggtcgccgccggccagcgtcaccgactgcacccctgcagctcgaccggaatcaaatcaaccatgaaatcaacaagaacacaaccacgatttcgcattcaaaacaagatcaaaacaaagatgattaccgctgacagtagcagcctctttcatggccttcttctggcatttgtcggttttcacggaaatcctgataatgatctccttctgaaattttcaacgcatggatttcacagataagttcttcagacatggattaactaaaatctcgcctgtgtctcggacaaaaagtttcaagcagaccaaagcaaaatatgtacgtagaagaaactttcagaggaaacaccaattaaactctgcaaataaacctccataaaacacgcaccaattcgtggtgcaactcgtagaaattaaaacacaccaaattcgaactcaaacttgcagaaacacgggaatcatgagagaaaaggaaccatgttaattaccttcatggttttcgcttcgctaactgaatttgctcagtaaaaaaaaaaagtttgctagctatagctccaatggaggagagggctaaggagattagcaaccgtgtgttgcgtgcttcactctcttaagtactgacaggataatggcctgtgagctactgtggttagctcagtggtttgtacctgccatgtgtgacaataccataatatcttgtttatttgacaataccataatatcttgtttatttggtactagtacttggtagccaagcgaaagaaacacactgattagatagaccttgagagaaatgcatatttaactgttgactttgacctagagactttggctcggctttgtgtgtagttatctcgaaggggaggattattatacagggcatgtctcactgttgggcccccaaaacaatccatatggattttgtttatgcataaacaaaaggcccatccactcacaaatatcatacgagatatatcagccaaacatgccaggatctccttgctgacgggagcagacgtccaccaccacgtgcctttacttgaatttcgtcgtcgtcgtagtagtattgttttggtcacgtgtaattattttagtaaaaaataattcatgttggtcgataacttttccatgtaccataaaaatataccctattcgttttttttaaaaaaaaacctaaatgaagatttaacaccatctaaaacaataaatctggattcagattcgttgtccttcccacctaagttaatctttttcgagatgaagggagtagtagacaagtaactttaacagttgttgcatccaaatgcaactcaaaatctttaacacccacggttcaaaagctgttttcagtagacgatatcattgattatttttagcataacatttgaccatctgtcctatttaaaaattatataaaaattatatatttattatgacttgttctattattaaacacacttttaaatatgacttatattttagtatatttacacgaaatttttaaataagacaagcgatcaaacgctattttaaaagccaacagctttatttattaaaaaaaatgaaggtagtataagtttaaaatggatgaacatatacacacacactagaaagtggattgactaaatgtggttcttttccgcgcacgtttccactagctagcttctgcatgcacggcggagttaaaaagcatttgtagtagacctatagtcaagcagttgcaataaacaaaaaaaagaagaagaagatcatctacccgagatcgatctgatctgtctaagaaaattgatggcatggttatcttgcttgcgctctgtgtatcaaaacaaaatatttcacgtgcccgacgtgccaatatatagcctagcttactgtcgcaagttagttgtggagcaattccgagtgttgcacgcacggaggacatacccgatcgagatcggtctggggtatggcaaattaaacgaactgacaaaaaggagattagataatttgataccgacacatatagtttcagcaaatacatgtatcgaattaaagccgatggatatatatctacatgcatgatcatttaatttgcatggttcgtcggcgtcacatcatctatcgtcgattgttatccctcgctacacttgtagagatcggtgatagttatatttcatcttggcacaatgactaagaataagtaattttacttatcatttatttaaatatgctactagttatttctcataaataagtgattcattaatatttacatttctcgatgtccatataactaatcttgtgtagaagaatagagagtcatgcattaaatccgagaaagtcattaagataataggtggttggattgaaatatgcttatcaaaagtaaatttttcagatttgaaaatatgtctataaaaaaagatagagagagtactgaacagtacatacacatgtacgtacatggtccggcctaagagcatctccaacagcctccttattcaactctccaagttaaattttagcaattttaaagcaaatcatgctccaacagactagctaaccggatggctaagccatccggctagccaaactactcctcccgctggccaaatttggccagccaaaataacctagccaaattgtgggtcccatctcttttcccccttctctctctcgtcagatgagcgtcggcgccgcgccttcgccgcttcgcgccgctgcccgtccgccggctccgccccaccgcccctccgctggcggcgcccctccgcgccacccttccacgcgccgcccctacgccgccgtcgcccctccgcgccactgtccctccgcgccgcccctccacagcgccgcccctccacggcgctgccctctgctttgccgacgccgtccctctgccatcgtcgtcctttgccggcgccgcgccctccgtgcgacgatgagaaggaaggaaagagaaaaagaaaaagaaggaaggaagagagagagagaggggggggggaagaagaggagtagagactgacatgtgggtcctttgttattttggagaggatcagtagagagtctgttggagtgatcatctaatttaactagccaaattagatagagagttggctatatgagtttttggagaggttaatttgaagaggctattggagatgctctaagctagctcgctcgctctctatcggcgccaccgcccactgcttccaggagcaaatcgcgatgtaccaaacaactaatactaccagagtagggatcgatcggctcattaaccagctgtggccaagaactattgcatgaaaccggccaaattaaacgtcgtcgacggatcagcgagaaagatatgataaaatcaatcatatatggcgagaaactgaagcaccgagctcaagttcctggcaattcgtgccacgcgcaacgcaacgtgcgtactgtaccttctcgatcgtacgtatacgtgtcgtagctgctgctgctgctgctaggactagattgcttggacagggattcgaccacgtacaggatcgtaggcgcgagtcgcgcgcgcgcgcgacactagctactttgggtacgcatcgtatgccacatgggctagctaggaaaactgccgctgagatcgcgaaacgtacgtacgtgctaaactcggtggccgatcgtgatatatacgtgggcgcgcgcgcggtagctgatccacatgtacaccggtggcgacgggcgaaaattaaaacccgcggactcatgtccaagtcgtcgtactcgtttttatacgtcgtcgatcgggggcggtcggcgaggcgcagtggcgcgcgcgtcacggaaaacacgtcctccgatcccgtctccgatgacgcaacatgttaattagcagctagggggcggagaaaaggatcgcgcgcgtgcgaccaaactaattaactgcacgggtatgtccatgtgcaacttgcgcaagtatgttggttaacttaaccgtgctcgcgacgttgcttaatctggccgggtggggttgccatcgagtcatcgacgacgcatcgttgtacagacgggaaattaccgtttcgatccttggaatgctttcccgaccaaaagctagctatactccatcgaacattagacacggaaacttatggttgtacttaaaatgggatgagggagtaggatatatctcagtatcacgaatctgaataaataaatgttcagattcatgatattagcatatgtcacatcgatttatagtactgaaatatatcacatcacgtactatattaactgcctaacaatgaaatttgattgtaaatatctcttacacaattttgctcaaagttatagaaccatactcatggtctagtatttttgaacatgaatacaataatattttttttgaaaaacctaaatattatttaattaatagttggtcaagctcaaaattaaactgttaacatacgacttagtatatttctaagagttaattatactttgtaccatattttattaacaaagttttaatttggatcactcacacctcaataaactccctcatccatgccccagccatatttttgcctaaggatttgatagatatggcttgaaaagagagttaaggtggactaaagtataacaaatataaaattatttggtacaaagtgagaagatagatcaaatgaggatcgaaaacaaaatttttgataataaagtgtggtccaaagtaaaaaaaatccgctctatttctaaacaacatatttaatgatagatactctatccaacacgggaaactgtgtagtgtaaactaaaaagctatcataggatgcacaaatagatatatgtgatttgtccatattattttgagtaaattttttactctccatcttaggtgtgtacattcatgtatctgatgatatatagttttcatgtttgtactgtacatgaagtttatactggacactatatatttttccgttcaatacttattaaagatgctctgtgtaatactgcagaggtttaattaaatacataagccatatttttcttccattttgttgacaaatgtcaattttctcacttggattgcgcaagaccttttatctgtgctctgccttctcccaatattgtggagcctggcagaaaggcaactcaatacagcgatggctaagactgatctcccatccaccctctgtcgttgtctctgtgtctaacacatcaaatcatccaattatctacgtttggtgtgactatgaatcacccgaactcttgacaattgtcattagccccagaagacaaatgtgcaatacaagagatgataatttaccgataacacgacttgttctgttgcttaatttgtatatctaggtgactactgactagcttccacgttacgttatgtgaaaacaattcacacaaatatggtgtactagtgtgttctgcagtgtaaaggatcgattcctacttcccgaaaggaaaaaagattcagccaatcaatgtcggtcgatgtgcatctctgaaaattcattcatcatttctgcatttcacactgatttatcttggcagatctgaaaacaacacagctgcaaattaacaattaattacaatcaaatggaacgatcgaaggggctgacaaaaaccatagcccctctatctcgaccgatcacggcttcacacaaatctgtttacatgcagagatgaacaaacaaatcaactgaagcacaaatttccccagttatttagcagcctcaccagcaaatagtagtagtaaacactgctcaaacctcaccgaaatgaaatgagaagaagaaatcatagaaaaaaaaaatagaaacagctatacacaatagctaagcttaaactatagtcgttgctacatgatggagcagccgttgggatcgtcgttgctgctcgtcgtgtagtactcgtgctgcaccgcggcggcgccgtacggcgacgggtagtagccgccgtcgtacggatgctgcggcgcctggtggtagtacggcgagtcgtagccgccgccgtacagctggtggccgccggagctgtaggcgccgccgcgcccggcggagagctgggaggagtagtagtaaccgccgttgctgctgccgaggcggccgctcgttgaggtggcggcgtagctgccggcggcggcgccacgtgggtaggtgtcgtgcagggtgcggagctcgacgatgtcggcgtggccgaccttccggcggaggcggctggtgaggtggttggagtcgacgccggagccgaccacccgcagcaggttccgaccttccccggccagcgtcacggactcgacgccgtccatcgccgccgccaccttcatggccttggcgttcccattcttctccgagctcgcctgcatcctgataagcatctccgtctgcaagaagaacacagcaacatatatccattagaaaaaaaagaaaagaaaattcaattcatcttcatatatcgtcactaagaccaatcaatcaatctgaattctgaagagagagcaaatttaccctcatggcgccgtacaattttgcaacagatcgagcaagctagcgttcgatctgaagagagagcagaattgatcgaattggtttgtgtcagagcagagcagattagcagatatagcgtgatgtcgcgggcttttatactgagattatgcgtgcacacagatgctactaccggtttcagggcaattccaattcaccttgcggttgcggcgttgggtggcacatctttttcaagagattcttttaatttgcgacgaagcagcggggatccgaaccaattatcaacgaacacggcgggagccgaaaattttttatggacggttgactgcgaggaagactccaagtaatttaatggatgttacgtgggtacgtgtcgcttgtactccatttgattggtgcagagcgatcgatctcggccgttggatgcaggacagtcggtgtatcggacggtccgatcggggtgtacaaaaatgggttacaaggttcgggtttttggtgagctgaaagtgataagctcgagtgcaggtgagaaaaatgataactcaaatgattatcggctcaaaaaaaaaaaatcatccagtggaggttggagttaggagttgacaattattattttttggtcaatccaacttcatcagactatcaacgattcatgcatgcatgtatcttcaatctcttccatttcgttctcttttttttttttcaaaaacaaacattaatttctttcgttctctagtttgtttttccctacttagaaacaagttgagttttgttaattaacccgtgcgtgatgcacaatcggatgtttccgtgatgcagcgcaagctgccgcctgcaaaaccccgagttaattttctgttggctgaacaccgttcttggttttgcgattcagtttgtaagttcgtaacaattgatcgtactatttttgtgaatgttgtttatatcttcacagaattgggctacatcgactttatcaaagatgcggagagagcaaaacagtgtagcactcagctgcagaatttattttaagaaataatacgattttaagtaaaatcacaaaaatataggtcggttagacgaaaatcacaaaaatataggtcggttgttcgacagggtatctatcttcgacatggtacttgtcgaggtgataaaaaaattttaaaaaagagaattatcactgtagtggcactgttcatcaaacatatcgaacatgggtagttcgacatgcccctaccaatcactgtagcgtcactgtttatgtactttttttattttttattttgaccaactaccctattgaactgttgcagtttgataggtccccgtcaaaccacggttgtttgacagggtgctaaacttacgattttgcctaaccgatctatatttttgcgatttcccattctaaaaaaaaaattcctcagctggattagcggtttggttaaatagttaatttgggtgatattccaccggccattaattgaatctttaattcttggtgaacgaaagcatctttaattgagtaagaaagctctcactttctccgtaaagaaaatgagaagagaattgaaccaggaaatgtctcccgaataaaacaaaatttcccaggaataatcaaccgtcttttgtgattctgctactttaacacgtgttcggtgggactttctcttccttgaagagaataaacagaacccaatatgatgtaagatttcacttttaacacatgctttgcctttcggatgttccttaggaaataagtataatggttcagaagggaggaaaagaacgaaatttctatttcagaaacttcacaaagaagaataaatcattactgggctagtgcccatggatttgatcatttggcccattatttctttcaagaggtgatttggcccattaatgatcacttcttgcgagaacggcccaatatagaaccatatgaagatcatggcccagtttccagagaaatacaccttgggttgccttttaacactttccatttcttcttcttcttcttctcctcggcgaaaggtgttcggactgaaggtaacaaactaacaacggtgtttttattttcttttcagaccttcaccatgaaaattacttcttaagtatctcatgataaattctctctaatgaaaacctataaacgaaaagtcattttacaactacacctatagctttattttgaacggcagatctatattattcacgttcaaacatacacgcacatcatattattattattatattatatcatgttacactcacgcacaacttatgttattacaatattataagccatcgactggcgcatagtacatgtagcctttggaaagagctcacactcatggcctagcaagccgtacacgtacgtacaaacgcacgtcggcaccgcgtacacacgctgacacgcgtgccttaatttattgatgacgacgaagagtgcaataagcaatactacgatcgagcttgtgttgcgtatacagtcgtatacacacatagtacggcgtacggcgatatcgacgtatatacggcgggccgggctacttggagcagcacttgtggcagtcgccggaccagtcgtcgcagcaggatttgtcgtcgtatccgtcgcagtagtgcttgcagtcgccgccggaccagtcgcagcaccccttgcctttgcagacgtcctccttccccggagacgacggcggcggcggttcgtcctcgtggtccggcggcgacggcgacgggtcctcgtggtccggcggcgatggcgacgggtcgtgatcgccgccgtcgtgatcgtcatctgcatgcatatagacgacatatcaaatactaattaatactaaatgaatactatgaagaaggcatgcatgaacacaatacatgtagtagtatatcgtatcgtagtccctccgtttcataatgtaagtcattctagtatttttaatatccatattaatattattgttaatgaatctaaatagatatatatgtctagattcattaatatcaatataaatgtaacaaatactagaataatttatataaatgtgagaaatactagaataatttatattgtgaaacggaggaagcagtatatatgtgtatgtgcaggagaaaatttaacgaaaaattgtatgtatatatatgcatgcagggtgtgtgctagctagctagctagctcacgtacgtgtttcttcggcggaggcgacgtggatgaaagcagcggcggcgagcaggagagtgaacaccagtaaagccaacttggacgatgccgccatggctgctagctttaagaccttaagtgatcttaattaattttcaactcacggtataattaattaggactggatcgcacaatctcgagtgtggtgagaagcctatgcgtgcaaaccaagcgtatttataggcaggatgaagccttcttatgagatttagggttctggtagtagtgcgttagttactagttgatgacacactgcgtcttctcatgtcgaccgattcaaggttatacgtatagcagaacatatataattaagctgactagcgaccagctataagagcatccacaatagtaaagtaaggtgctctctataaaacatgtatatttcagcaatagactcgattaatagtaaaccaccttaatagtatgtctatattggtatctatatctctctcattcattgcctcgtttttctctatagactatctttaagttagtagatagctttgctctctctctctcttcatttaatacctttcaagtaggaaaatatgctgacatggatctcttgtagagagcctatagataaccattgtgggtgccctaaccgttttgccattctgattaccgcattaatccccggttgccgattactccctccgttccattgttccattttaattaattgcagttataaatttttatgtctaacatttgatcgcttgtcttattaaacttttttataattagtattttaattgttattagatgataaaatataaatagtactttatgctcaacttatttttaattttttttaataaaatttttaaataagacggatggttaaatgttgggtgcggaaaatcagaaccacacgagaaatgagtgggaggagtacattattcataaaaggtcaactttacgatggcccggccaccaatgtcaacaactaatcacgccataggcatgcccatttgcatcaaatatatatgtcatatgaaagcaaaattcgtggaaaccccaagcccacatgtctgtttagaatattttagcttttcaaaccaaacaccaccagtacaagtgtgagtgtgtgacgccataggagaagggcgattttatttgggcgcgcgtaggattaatttcattcgccgatccgttaggtgagctcggaaaatgcgagcacgccggcgctggtcgtcggtcggctcgccgcgagctacgatgattgggtcgtcgatcggtcgtccaggacggggtcctgcaaccgaggaggccatcggatggcttaatggggataagtcaaatgtcacatttacgaatgaaaaataatttgcaaaaaaatttttatatacgtgttattagtgatctaaaagcaaatgctgaaaaataaacttcgataaaaaaccctcaaaattaactccaaatttaatgttgaaaatttgaattttggttgataaggataagcataagcgaaaagatgagaccaaaccttttcacctttttaggtggcgggcctaaggcccaatgggctggcctatccatcacgtgagacccaactgaaaaaggcctcattagatgcgaaagtgctaattcgtgactagtcacgcaccggcctactcgcacgaagaaccccgccttttcattttttggcatacgtatgttttgtcggcttatctactttcttttttatgtaaatgtcggtttaataatttttttactatataggctaaatctagattggttttatgcatacttctttttcctttttggcttgatttttccatgggctcagtaattttggcctatttattttcttcaacttttttactttttaagtttgtttttaattttatacgtgtaaaatttatatatacaatacaaaatttatacattaacatgtaaacttatatacatgtatacatagtttttatacatatatacatatatacatatatacatatatatatatatacatatatatacatatatatatatataattctttatagtgtgtaatataaatttatacatataaaaaattgtataagtgtatatgtaccaagtatatacacaaatattttatatatacgcatataaatttatatatacattatatatatacacaaatttatatactttgtatgcatatgcatatacgtatacgtaatagaggtggagctggttgcgtatcaacggcctcctccttagtgatgggcttgtacatatggatttgatttggactgttgaggatttattgggagcatggcccatttcttcagcccaaaacaacaattatctgtggcaccttgcaaacttacaatttgagaagttgagaaagtatttctgggtatgtagctggagcgctaaatatgcatgcttatatttttgaataaagggagtagtcgagtagattaatatggtatagtgatgtatgttactaagactaatactcaggtgtatataaaagtacatgcaaataataattgagggctactacataatgctatatcgtttcgataaaaaagaatatgtaatacttataatgctatttccttaggtatcagatgtggtatctatgatactagataggtatatcgaatatgataccgtgataccggacgtaatactcatatcatgatgatgtcagcatgacaccataggtatcagatcatgacatcaactattttatttgaactgtatacatttttctagtaattttgaataatatttaattaaggagaagtgtttatttatgaaccaccatgtgtgatctgcttcatatgagttgtacggagctcgctccatcggcctacggcgagcagcactcgccggaccagtcgcatcagtcctagacacccttgcatgggcagcatggcggcggcggcggtggtttgccatatccaccgcctccgccgtagtacggcgacggtggcgggtcgtagtagtccggtgatggcggcgggtcgtagtagtccggtgagtgcggcgggtcatagtagtccggcgatggcggtgggtcgtagtattcaggggagggcggtgggtcttcgtggtccggcgactccggcggattgtcaccgtcgtcatctgcagcattaattgggagcacgcgttacctacatattaaatgcaaaaacaaatatgtacttcctccgtttcacaatgtaagtcattctattattttctatattcatattggtattaatgaatctagatagatgtatatgtctagattcattaacatcactatgaatatgagaaatgttagaatgacttacatcgtgaaacggagagagtacgtgcctatgttcaagttcatcaaaccgacgagcacaatatataattcatcgatgagccggttcgttaaatttttttttgaaaaaagatgaaattatgcatgcatgtgtgtgtgtgtgtgagaaaaacgatcgaattgattaagaaaatatttcaactccagtatgaaaatcaaactaaattatatgcacgaattaatgaggtacggtgtgtcggtgtgtgctcacgagtttgttcggcagaggcgacgaaagcagcagcgagcaggagagcgaaaacaagcaaagccttggacgacgacgacgaggaggacgacgccatgtattcttttaatttctctcctcacgaagtgaagatatatgtaatcgaaattgctagtttaatttgaactatttcgagtgtgtgatgagaatcgatcgataacgtaactagacgtgtttatataggcaggatgaggcacatacatgtgatctagtactgtatacgtactcttagtagatgacgaaccggtgcttaattttgagcttcttgacgccgtcgatcgaccgattcaaggtaaagaaatatgtactgtaatatactagcaggctaataactgcatgcaagtacttcatatatgcaagtacgcttggcatctaccatacgtacgtgctcgttcgattcaccggaaattaatcgagttgcaaattaagtgaaagtcaatcgttcgatttgatcgatttaaccacaaatggaggtgctcagctacaaaagcaaactcaattatatttgccagggccgtcggccacaaatgtggcaagtttagttaattcatcctcacaatatgtacacatataatttctggatatatatatgtcactatttaagcgaagttcatggaaacccaagtacgcacatttctattttccagaccaaaataaacgtaagataagatatgaggtggccttagataaaaagggggaaaaactaggagtagctagctagtccagattgagcgatccatccgtgaggaggcgtacgttatggacattcgtgagattgcttatgaggtggggagcgggctatcaattcgtcgatcgatccttgtgttatgaaaaggtttagctgcttctcacattttggatagataggacacaaacattttctccaacaaaagttggattaaatttggatactcgtagcacgtttttcaaactgctaaacggtacgtttcgtgcgaaaattttctatataaaagttgttctaaaatatcatattaatatatttttcaagtttgtaattaataattaaaactcaattagtcacacgttattacaacctcgttttacgtgaaacacttaatttttatcttcatctatatcttcaggacatttaaacaccaccataagctcgatcctgtaggccaactaggccgaagaaggtcaactctaaagaacgtttctatgagaacgctgacccacaaaagttgtctaggctagacaggttacgaaatgacaagtataccatgtaaatgttcctatcaaagagatgattatgtaaaacccaacataaacaaaacactagagtttgcttcagatgcttgtaagttataaatagactccaagatatgatttttattgcctttatatacttagagataagtgtttgtctttccacaacactcgtaatgatcactgtaaagaaaaaaaaaagtataaacactactccctccatcccataaaaaaacaaatatagaaccggatgtgacatattctaatacgatgaatttgaatattctaatacaatgaatttgaatagatgtatgtctaaattcgtagtatatggatatgtcacaggtactagtaggttttttatgggacggagggagtagaacgtagctaggcttaggacaactagaatctgagtcctaggcttagcttcttaatccccatgcaaattttataaaaatataatgtaatttctaaatgttgtcaagactatattagcatatctagactgtcaaagtacaataatattttttttccctagtaggtgtagatatctagtagctcagctctccgtatatacatatctagactgccaaagtacaataatatattctttttaaaaaatatatattggtcctactatatatgtggtcatagccttcccgaaaggccgaaagtgtacacatctcaaaattaatgattttgacttgatgatctccataatgaacatctctctcaaactctcagtcatcttgttgacatacaatgggatatctatgtaaataataactaatataatcttatgtctcacgccccagcccttgtgacctgttcaatcgtatctagtaggtgtagggaataagatcgacagacgcaatctctctccgaatacgcgaatattagagaataattaaatatcaaataattagattttaaactcagatcgtctagtgtatcattttatgaagctagccgaaagatgtctgatgtttcttcagtaagtcagggcagaacattgaaacaagcaaagccaaagttaatattcttcaaagtaattaatgagcaagtgacgttttataattcctctatatttgactatgtcatcataatttgtcaagtgtgtttttctcgctagctcaccgttttttaataatagatattttattaaaccggcatcgatatctgcaaagggtacacagccaacctagcttaacggaaatatatatccacaaaggaggcgcgcggggaggaccgcgagcggtggttccagtggcgggaggtgcgtgggctgcggatccggtggctggaggcggatccgacgacagggaggtattcgggtggtgaatttggtggtggggaggcccacaggtgggccgacggagctcgggcgcgcctgtcgatgggtgatgaagctcaggcggcgacggagcttggccgtggctaaggttatgagcgggtggcgacgacgaggcttgcaggcgtgggtcctacggtgtgttggcaacaacaagtacaaagattcggcgacgtggacctcgacctccttcctccgcgccggcaggagatgctctacactagtgtccaagtgcgctgtggtggtcgatttgtgaatctttagtgtgttgcatgcatgttgtggtttgtgatttcttgaatttgtgattgtgggattggaggatgcgatgtttgatttgtggatttgttattgtgggattagatgcaaattcatagaatctgcgattgtgggatgtgatgtttgatttggatttgtgattgcgggattaatgacaaactgatgtagattgtgaatctggttttggaggttctaaaaataaaatttaatatttttgccggtcgattttttttagccaaaaatctctttgctggcggtccgtataatgtagccgccattgaaaactgtttttcgcaagccgataaggcccacctacgatgattatctattttcattgaccctgatcacatgcggatagagagtccgctggtgaaaatgtgttatggccattaggaaaaatggattttgtaataatgacaagccatcgtcatttcacgacctctcccgagaaaaccaaagaaaactaattagtactccctatgcatgacatcgttgacttttagatgacattcgattattttccttattaaaaatattatataaatatcatttattttgttatgacttcttttatcataaagaaattatagtataaacttacacttttacttttacatatttatactaaaattttgtataagataaatggtcgaacaatcaacggtcgaacaatcaacggccagatcggctgacgctgcgcacgccgtcgctcggcggtggaggcggagccgctgcgtctcccgcccatagtcgcccgtcaccaccgtgcccgcagccgtaccgtgccgcgtcattatgtgaggcaaaaaattacacatctataatgtgagggaaaaaatacacatctataaaaaggacgaagattcattttatagcttaaaaagaaggcacgcagctgtagtatccatcactattcactgaaggtggacgacgaccacaaatggcgtgcaaaaaatacacaacagaatcagggcaacgcgcggatgtgctcgccgacgaccgcgcaggactgtgtcggcggaaggtgacgcagacgaccaggacaggcttcctctatgcccctgattctgttgcaacaccggagaggagtcagatccagcggtgcaccatctatgtccacgagctgccgcctaggctcactccctcggagcaaaccacgtcgccggtgtagggagaggttgtcgccccggtggccgatgatgctgccggctactcccagatccggaaaaaaaggatagagattggagagtgaatggggaac

SEQ ID NO: 74931 - DNA, 11941 bp, Oryza sativa
cgtgaaatgatgtttcgtttattaaaaatacttcccttgctcaaaaaagtcccagaaaaatctagaaaatagataaacaagcaaagtatttaataaaattttatctagctcaattttatgttgaaatttttcctagattataggagtttagcttgtaggtttttaaattaatttctaaaaatgcattaaaaactgatttattaaattaggcgattttcagggcgtgacattgatatagtttaaacatgtaggttaccgaatctttaattttgggacccgacaaggtgtgtgggtgggggcccctgcgatttgggagcctagagcggctgtaccgctcccccctcccaagcttgccctgaatacatgggccttgaaaggccacatggaatcttatgacgatttctgggcttgatggcgacgaaaatggacgtcatagactctatgacgacagaaggatcgtcactagattagtaacaaaaagataagctttctttatagaatgccattagagacgcatgataggtaacgaatgatattcgtcacaagaatgtcacagagttcacaacatagtgaatgatctatatatgggcctatttgtcgtccaaatacctacaaacaaccttggtgaatcatctctttgatcctaaattatattttcaaagagacaaagaaagagagagagggagttaaagtccaatttacacccaaacttcaccatacctctcatcttctcctaggaaacatctacatggggccactagacagccactcatacttggttgagcgaagtacaagtgggatcacagcctcaaaccactgccaactcctttaaatcgtttctacccatcatgttgacaactagctctcactttccacctttactttcaccattcactactacaaccaagatttttgtgtgagggctaaaacgatttttgcgtgcgagtaggcagcccgcacgcacctaggggtctgggaacatgacgatttttgcgtgcgggtggcgcaacccacgggaagacaaaaatccgaaaaaacttaaatttttttaaaaaaaacgaaaccctagaatccggctataggctttcacccgccgcccgccggccatagtgccgcctgcctcccgccggcctccgcgccaaccgccgtcagatccgcactcccctccggccgcacagccgccgacgcccctcccctccgccggatctagggacgaaaggaagaggacgggaggggagctgtatcccgtgcggggagagggcggccggccgccggatccgtgcgtgtacggccgccaccgctggattcttgcgttgacggccaccgctgctggatctgtgtagggacggccgccgcccgctagatcccacgccctccaccgccgtcacgtggaggaggccgctactcccaccgccgccgcaccgctgctgtcaccgcgcgctgacgccgctgccgccgtcgggaggagaggaggggagagtggagagagtggagaggagatgcaagagagagagaggactgaggagaagctctacgtggaaattttaaagtggaaaaagggatagaggggaggggagaggagagaaagaggaaaattttaaagctggtgagaggggaaagagggagttagtatttttgcatgcggctctctcaataggtccgcacgggaagatcggctcattttcgcatacagtccatttaagaggaccgcacggaaaaatcgatttttccatgccatcctcttaattgaaccgcacgtgaaaatgagccgattttcctagaagcaacgagttaccgcccctacggaatataaaagggtccctgtccaggaaaatcgtttctatattagtgattcgagaagttccttctctacctgatcgatccattttctttgtttccgttttggcatagattgaatacttggtggtgcactcgtcggcgtttcgagtgtccagagcaccaccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccattgagtcaccataagtgggcccgagtgtttagccactacattaggcgctaaggactttaattagtagaaatttaaattttgtaaggttcattttttaaaattgctttgtatgccatgtgggcatatggttctaaacgcaattcacctaatacccagtgacctttttgtatatggtttagggtaagccctaatccctactcagaaattactatttcttggatttattacttgatataatagcttgatgagtatattgtactcacccttgctttaaccccctctttcagaatcaatttggagtttttgccgaagccaggagtttaatcatataaattggtttcattccaacttagttcccaagtatagattagatatatggtttaattctatagcaaaacattagagttggctcatcctatagcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttggccagcctagtgcggctgtaccgctcccccccccctaagctggccctgactacaagggccataaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttataacgtaaataagcgtcacctataataagatctcttgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgccatgcatgcgaattttgtggatggagccaaaagctgcatgcacggagctgagtaggagacgacgtagacagatctgcacatcgtggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgttggatttacatgaaaaatacgagacagacaaaaatgatatctttcggttctaaattaatactcccggccatttgagagtgtaggatggtaaagggcctttcccaccccaaaagctagccattgaggtgaggggctcccccacttatatcttaggtcctttgcccttccacaaccaatgtgggactattcaacaatctcccccttcacacattggtgcctctcagcccttcaccgccccttcaccgtatccgggcccccaccggcccacggtccatcaggtatacgggtcccgcaggcacccacggtctatcaggccttcacacacgtgtccatcgggccagagaagttaacctagcctggctctgataccaattataggatcgtaaagggcatttcccaccccaaaagctagccattgaggtgaggggctcccccacttatatcttaggtcctttgcccttccacaaccaatgtgggactattcaacagagaggagcaatatgtacgtatgcatgcatcacatctcagtgttttttttcttttttttccttggagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccaaaggcaaatattcattttaatttgttgtgtatatatatatatatatatacacgagcatacatgtgaagatggaaatatgtgaaaaatataatggtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaatcgacaaaaatcgcaagatgagaggattgtggtaggtaatcttctccaactgtgcctctcaatcggccataacatattagctagaaggataaacaaacatcaatctgccttcacagttttgatcatctcatgagacacatatatataaaccacccataagcaagagtctccaaggtgaattaattaactatgttgatacacatatacttaattggtataagagcattagtagtggtagttaattagtataaaagcatccatcaaaaggagactgttagctagctaggagaccgggcaagcaaagcaaagcattgatcttgatgaatcctccagagagattaattgcatattgtccagttccccctgacctattatacacatgcaagtgctctatgtacttgtgcggtgcaacgacgagcaagagtgcgtacgtttatagtagaactgagggggtgcgccttatatacgccagacgaggaagagtgcgtacgtttgtagtgatgtctccaattttagtttctgtcatagtgaaatattcgacgtttgacacctcgaaccatagaaaaactggagctgtgaaatgttttcttcttttttatgcgtggagcactgaaatattgacagttttgtttttttctataaaaaaagaagaagagttgacgacttgatgggcaggctctcctcgatggagggagatgagcttaaaaagtcgcaataaatggaccgatgtagtggaaatgtggagtggagtggagcagtaataaaatttaaaacgccacgcgtagggcatatcgaccacgactggactctccttgagatcttcgaacagtgtgtgcttgctagctgaactgcagcagtggaacagtaataaaatttaaaacggatgtgcagtgttcacagaggatgagtgtgctatgtgttctctgcttgtgaatagatatggcgatctctgcatgtgaatagatatggcgagtactattactgggtatacatggttaggatagatgttagtttgttcagtttgtttggagatggatttgggagcaaatgtacatggttagggcgcaaatgttagtttgttttgctgtggaggggagtgggttttgctagaagtggacccatgaattttgctattccaaaattcctcaactagctatatgtctagctccaacaaatctgtgatgcctatatctcactagtcttgctatgtgctatgtcatgtacccgtgggtaaatagctaatttatgatttttgctgtctcatcatgattatgccaaatatacatatacctaactcatgaatttttctatgcctacctctcaccatttatgctatgtctaagctagacgattttgttatggccatacctactcttaaatttttttatgtcggccttgactcagccgccccaatagaagcgacaaaactgctgttgttgcaagagttggattccttcaagaaagtgatagatgaatctgaggcatcaagggagcagtaatcaaagaaaattgaaagtttgattggcctaaatgctccatattttgctctgaaattttgatagttatgttaccaatcatgtatcattgtcattttcatagccttcatcatggcgttgcgaatattatgaatataccaatggatcaacctgcacgccctaagtgtgcgcattcttaaaaaatgctgaagtgtgatgcatgcatatgtacatattgctcctcccaaatggacatcatgcaggatcgggacttgacaacacattaaaggctctcatgctacacgcttcttgcactgtagttaaacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactggatataagattttttctttgtttctcaattctttcggtcaataacgagcatgtgtgttattcatagaaacggaggtaggtagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcgtctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccatttcgatggtgatcatgtgcctggtcatcttgagcctcactgtcgactccgccaccgcggcacagtgcggctgctgcatatcctctcgggcaaaagcatgttgttttggttgtattgctgctggtggctccgactcagtctgcaagaacacttgttgtttcccatgtattctggccgattctggtaaattcactaatgtcactctatttaatgcatttcttatatgtagatacagactttgtagcatatcgtggactaatacatatgtacattgtcctcaatgtacattgttgatttcatttccaatctcacgacttcaggcatatatcttgcaacacgaagacatcttatgctctacttccactacaaaattgactaatgcgctaatgggattttcatattttaatttcacagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattattgaccatatgggacgatctatagtggatccatctgttggtctcaactctatgtatgtcgtgcatgtgtgctctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactataggacataattaagattgtcatgccaaaaattattgcaaaacctagtaggaaagcaaaagaggcgggggggaggaaacatggtcaatttctcggctgctatcacattcctcgttttctcaggtttgggagacatatagccacactaaaggcagtaaacctgaggaatgacaaccttactcacaaggacaaatagtcgttaaaaaactatgacatcactaaccatatcttatttcagttcaccaaacatacatttaaatttaggcagtattacggagaactaaatgaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacatcataagtacataatacagtatggtataatacacatatgcatactagggcctacggcaaaagaggcaaagatcaatgtgcatgctaacttgtgtataatacacatatgcacagtactttgaaatacgcataccaggatatatgcattagttcacaccattcattcttgcattcttgcactttcaacaacaatcagatctaccaagcattcttgcacattaaaccacaagtagatctaccaatgaatcacaaccttaggtagcaatgggggtaatcggaggggaaaaccttacctcgtcagacgacggaaggacaggagacggcggaagattcaccggctgctcaccatggcgcgcggatcactgaggtgtgggcatcacatctatcagcaccaatgacatcggcggggggggggggagggggaggactggggctctttcatagaccgatgtaaactagacttattggctttgatttagggagaggaaggaaaagagatagactttacccggcatggctttgggcctgcacggagagggatagtagttggcttggtttcagtcaaaagatatgaagagaattttaaattgtttttttcaatttaaataatgaccgaaattatgttagtattattaaaattacatctttagctcggaaaatttcaaaaaaatttaagagagcataattaattattgagaagttattaaaactattccaagtcatattttacaaggtaaaattttatttcacatatcaacttgtaacatacaaggaatttcaccttgaaaaatttttgtggaaaatttaaaactttttgaattcaaaagtttttggtgaacatagaagcatactagagcatataactcccttaaataaaataaaacacatagtttttctggccaaatcaaaactaagtccaaaagaaaaagtttacaaatcttgtggtaaaaaattttaaaacaaaaattttgctttgaccataaactagaaacctaatcttctcggttttgcattttcaacctaactaaaaaaatatatttaagttaaatataaaacaaattgaaaggtcagtatcaaaatacgcaaacctaaattgagataaaaagaacttgcttgtatgtgcatattattcttttaagattgtttttggatattcttggtacatctcataataggttgcatatgcatgctttgtctaaagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcagaatgttaaacatactttactctatcatctggtgcaatggcttagtctaattcgaaatgtaacctcataaaatgagagccataagttaggtaaacagtattctggactgtggtcaatagattaactagtcaactttactaaattaccatggcaaaagcaaaagtaattaaactttggaactaggcaccttgaaccatcaaatccttgtatctacctgtcacccctccctatcacccccccggccttaattctaaattaaatggatgagagaaagagagtaatatagtttactgcgatagtgccaacacatggaaaatttagagcttctagatctctccttctacatctctcttaaatgggggaccatgtcgctatggggcccactcatcatacaaccatagccaacacatcatcagcacttctctcatttacattttgttttatttctcaaaaagggagaggagggttaaattgaatttcccccaaattggcactctaccactccaagccttttaggaaacatctatatatgggcctattttgtcgtcaaatacctgcaaaccacccctggtgaatcatctctttgatcctcaattatattttcaaagagagaagaaagagagagagggagggaaagtccatttacccccaaacttccccatacctctcatcttctcctaggaaacatctacatggggccactagacagccagtcatacatggttgagtgaagtacaagtgggatcacagcctcaaccactgccaactcctttaaattgtttctacccctcatgttgacaactagctctcacttttcaccttcacttttaccattcactactacaaccaagatttttgtgtgagggctaaaacgatttttgcgcgcgggtaggtggcccgcacgcacctaggggtctgggaaaatgatgatttttgcgtgcgggtggcgcactcgcacgggaaaacaaaaatccgaaataacatatatttttttaaaaaaaacgaaaccctagaatccggcggtgggcttccacccgatggccacagtgcctcctgcctcccgctggcctccgcgccacccgccatcagatccgcgctcccctccagccgcaacgccgccgacacccctcccctccgccggatctagggagggaaggaaggggagaggagcggagctggatcccgcgcggggagaaggcggccggctgccggatccgtgcggggatggccaccaccgctggattcttgcgttgacggccactgccgctggatccgtgtaggggctaccgccgcccgccagatcccacgccctccaccgccgccacatggaggaggccggcacgctcctcccaccaccactacgccgctgctatcgccaagagtggagagaggagaggagaggcgtgagagagagagaggactgagaggagatgctctgcatggaaattttaaagtggaaaaagggatagaggggaggggagaggagagaaagaggggaaattttaaagtgggtgagagaggaaagagggagttagtatttttgcatgcagctctcttaataggtccgtacgggaaaatcgactcattttcgcgtgctgtccatttaagaggaccgcacggaaaaatcgatttttcccagaagcaacgagttaccgcacgaaaaaattgatttttccgtgccatcctctttaatagaccgcacacgaaaatgagccgattttcccagaagcaacaagataccagtccctgc

SEQ ID NO: 74932 - DNA, 2789 bp, Oryza sativa
tgttgttgttgtagaactggcgttgagggcgagcaactgaagaggatcctccctgtgggtatggtgcagcttgaggtcccaaagcaatgcgtgcctctggctacaaccctgttgagccttgaaatgagcagccctacgctttttctgttccatcctattatacttgtcttcttggcgaatcgccttgtccaccaactgctggaaattccggtaatccatagccatcaatgcataagacaactcatcattcagtccctctaaaaacatctcatgacgttcttcatcagtgcgaacatcttctggggcataacgagctaagcgattaaagtcatggaggtactctgtgacagaacgggatccctagttgagtgctctgaactctctcttcttaagggccacaacacttgatggtatgtgtgtcttcttgaaagcagcagtaaactcccgccaagtgataggctgtccctcggctctgtttagacaaaagtggtcacaccgctcagcagcaggaccatgcaactgatgtgaagcaaaggaaaccttctcctgctcggtgcactgaaacaaatccaacttcttttccatagcattcagccaatcacctgtctctactgggttagtggtgcttgagaaggtaggtggtctcacacgtagaaaatctgccaacttgttctgcggaggtggtggtggttgattcttgttatttgcctgctggttctgcgcttgctgcactaacagattaatcaactgggtttgctgggccaaaacttgggcaagtgtgggatctccttcattgtgaccatttccacttccagtgcgggtgttcaccatctgaagaaaagcatgggcaaaatgaaagaacgacagagagatacccttagaacggagaactttaattaatttaaattctatattgctcttaactgtgtatgattacatttaaattgaattaacactatctcaccagctaacttactctctgacaagcaaaacaactaaacttatgtagttacatcccaccaatgatgtaagcaacatgctaaacccacacacgcacaagcaatcttaagcaagcgaactaacacagcgaactacggcaacggtcaaactagacaacaactctcgccttgcgtcggaacgaagagatggatcttcctcctctggagtagctggctctctttcttctgggtcttcctcttcttcctcatcacttaagacatggatgacaggttcagcatgatcaggcacagcgtctcccaccacacgagtcttcgaagctaactggagacgaggtggtggacgggttctcttccttgcggtgaggcgaagcttgggtgctgacggtcgtgcttctcccttaagcccagctagttccttctgcagacggtacaccttgctctccaacttacaaatcctgccacggttccagttttccctatcatgagctgctttctcccgctccacgcctactgcatccatggcgctaagcatatacacggcgtgcatcacaatggcgctaccttcaccttcgggacagttgtaagttccatagtcttgaccatgaggcttgtgtgggtgatactggaaagctgatgactctaactcctcatccaagcgatgacgtagctctccaatggccaccaaggctgcttcttgacaagcatggctgtactttcttcccccagcttcaaactttatcgacggaaggtcttcacgatcactagtcaacgtcacgcgaacacgacacttctcctcgttggggtcatggggaatctggtgatacttaggggcaacctcgtaacctacttcaaatgccatcattctcagcaagcatatgacatactcaacaagccacacagcattaacgagcatatgatatactcaacaagccacacagcagatatgcaaatgcacaagataacaaaggatggcataatatgacatacccataaccgtgggcacggctattcgaatagttttactctgatcagagatgtaccactgtacccacaacacacaactccacatgtcaccatgcgcctcagtaccaccacggtaccttcgaaaggaactgtgacaatacctctaacacaacacaactcaccacagtgcaccgttcctagaacataatctccccatcataaccagaggcaatggactccccagcgacccccacggacttctcgccgcttcacaggctggcaccccgtaatgaatcatgctatacaaaaggtaaagccgttgcccacgctggcttgtggttggcacggtaaatgtttcacaacagtagctcgtgaaccggtccttaattgttataagcacgaccatcaaaaccatgtactcacaacccacctttaatcaggtttatgtatcaattaattatcataacacgattaactatcgtgagctaccactaaatataaccataagtaatatcgtaatatgattaaccccattgatgagctattcaatttattacccataggaaaataaagtgattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctggacctttctcaacgtaacgctctcctccggaacatcggaaactaaaagcaataaccaaatcaacaaacagttcaaaaacaagaataacagtacatgtggatattttaacatgtagatcttgattttagatgaa

SEQ ID NO: 74933 - DNA, 17327 bp, Oryza sativa
cgctggcttgtggttggcacggttaatgtttcacagcgaaaatcgtgaaccggtccttaattgtcatgagcacaaccatcaaaaccatatgctcacaacccaccattatcaggttttggttggcaagttaattaattatcaatcatgattaaccatcatgagctatcattaagccatcattaaataatagtgaagcataagttatcccaatagtgtgctaatgtttctaagcatggctaagcacttatatctaatatccagctgaacccatatataaagctcaactagtcaagttacaataacccaaggtatcaaggaataaagtaatgaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaattcttttcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagccaagatgaattagttatgaattttcaaagattaaatcggattaaatcatttatatagattttaatggaattatgacgcaataatgaattattttttaaaaggaaaagatgattattacgtcagcggctagggttcacggtggaccgggtgcacggcgggggctcacgaaaacgaacggccgagatctaaccctatccaaacagacggccgagatctaatgggtctaccgcggctcacgggaagcgacgatgatgacgtcggcgatgacgtcatcaccggcgacggctaggatggtgcaagctcgccggcgaactacggcacgacggcgctaacgaaaggcatctaccggttgcggacaacacggcgaactcaccggtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccctagtcatgagtgggtaagaaagctcatcatttagtccttccaagaacttctcttggcgctcttcatcagtgcgcacatcttccggagcataatgagccagacgattgaactcgtgaagatactcagtgaccgtgcgtgaaccctgagtgagcgacctgaactccttcttcttgagagacaccactcccgatggtatgtgcgtcttccgaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgttgttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcgaagttgattaaaggctcgttcggtgcgtccccatcgtcttgagttggtccccactcgatcttggaatgggtgcgcttggattcttcttcatcatcatcactcacattgacgaccgaaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccagtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaacaggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcataacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactttaattaataagcgaataaaatgtcattacagaggtagatagttcctctcaatcaaaagaaacagcgcaggcgactcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaaacagttaaataataattaaacaatattaatccaacgctatacaacataccctgttgcatgggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcacggctattcgaatagtttaaactctggccagaggtgtaccactatacccacaagacacaacctcaacatcatgtcaaccatgcgtcgcgatacttgacaagtacccgaatagagattgtgacaataccctctatataatacaattcaaagcaatgcaccgttcccgcatcataatcacccccttataaacaaggtatggactccacagcgacccccgtgggcttatctccgccacttcatagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttggttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagccaagatgaattagttatgaattttcaaagattaaatcggattaaatcatttatatagattttaatggaattatgacgcaataatgaattattttttaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgcctgagaactacggcacgacggcgctaacgaaaggcatctacgggttgcggacaacacggcgaactcaccagtgaccaaagtagcggcggaagatcaacggacggtgacggcgacgaggttgatacggcggtgaccttcggcttgacgacgacggcgatgctccggagacctacggcagcgacggaggggcggacgaggtcggccacggcttgtgatcacgatggcgaccttcctgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccaaatcgagctcaaatccgatgatttccaaagcgatatagacgatgcttccaaaaggaaaaaggtagaggagatctcggggatcctttcccctcaatcaatttcatcggatcgggaaaggggcgacggaattggaagggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagaggggggggttttgggccgaagccagaagagaactttttaaaacctttttcaatttaaattattcatgagatgcaattccatttattaaaaatacttccttagctcaaataaatcccagaaaaatctagggactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgccttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttgaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgtttcgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccggaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggtgtcaacccccttggtaagttatcctgtcgtcagatcgtacagccagaagaattacgccttacttcgcatcgaccgtttttcaggcctcggacgcgtctcccccgccttcacgacgacaacgtcttgtgacgattggcgagaagtaagtagacgaatcttaagcttccgtgattttattcgagtgttgtctgaaccgtggtcgtctcacagggcggcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctgcaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgaaaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgcgtcgcccgacaatgtggaccagacccttgctacggggacggagatggcgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagttgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatagagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcctggttaatacgcacggcgagaacccttacacgaccagatcttacatggtctttagtctctacaggatctgacaaggccttatcggctctgggcgtccccagccgaagatcccttaggttcctcggaggccttgtcaagatggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgattgccgactgctcgaacggcaactcgttcgcgatgttcctcgagtagatttacatcgacgtttcgctgttcctcctagtcctcgtaggagtgcttctgtactcgtgtactcggatgtcgtagctcgctggggagcatggcttcggagtcgtacacgaggaagaagggtgtttccttgttgtcggtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcagcctagatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccaatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgttggcaacggcgcgttctgcttttgtggcctccgagctaatgtcgggggtggccgagctgacttcgccgctaacctcttttactgatggcttcgtcaggatgtccagaaaagtgccgggctcgagcggttgtcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgactgcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtctgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccagaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgtgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctgatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcctttcggtcccggcatcttgagcacttgatacgcgtagtaagatccggccatgaacttcgcaagtgcagttctcccgataatggcgttgtaagttgtatgaattcaacggacatcaaaggtgatctgctctgttcagaagttgttggcttgcccgaaagtcacgggcaacataatcttgcccaatggtctgtatagtccgactaggtatggaatgtcatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccggacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaacgtgtttttcaatacgaatacaacaattctatgtatatattactagtcatcaacctgtgcacttgcatgggctagaaaaattacgtgacatcaattaactagcatggaagctttattggtgcctccaattactgaatataagattttttctttctttctcaattctttcggtcaataacgagcatgtgtgttattcatagaaacggaggtaggtagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagctagccatggtactaactcgtctactacgccatagtatgctacaaacacaactaagttatcttatgaaggactactcaatagtacacataaaacaatgttactcgttgccttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcagaaaaaaaacgtgtctaaggtcagaaaaaaaagtacgaaaaggagaaaaaaagagctcggggaggggatagccggcatgcgcgccagctaaattgatttagctggcgcgtacacgcccattagcaatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtaatcatttgcctggtcatcttgagcctcactgtcgactccgccaccgcagcacagtgcggctgctgcatatcctctcgggcaaaagcatgttgtgttggttgtattgctgctggtggctccaactcagtctgcaagaacacttgtcgtttcccatgtattctggccgattctggtaaattcactattgtcactcttttcaatgcatttcttatatgtagatacagactttgtagcatatcgtggactaatacatatgtgtggccttccatgcattttcctcaatatagtttgttgacttcacttcccatctgacaacttcaggcatatatcttgcaacatgaagacattttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggctatagcactatccaatgtgtcatctgttggtctctgaccttagcaatttaatgcaacatgattattattatttgtgtgtgcatgttctttacttaatttattcttagcgtatttctgatg

SEQ ID NO: 74934 - DNA, 5169 bp, Oryza sativa
tatactccttcaatgaggaatgtagtatatatacactgaccaaagagcaggttataccgtttgtagaagaaataagtatataccactccgagtagctgttcataccgattggagaagaaataagtatataccactccgagaaaagtcagtatatatactcgttccaaaaaaaaaatcagtatatactcattccgagaaagaacagtatgtactcattcgctcgttgcagtagtatatactgcacgtaccaataaaaagacataatcagtatatatatactcattagttctggagtaagtatattcggctgctaattaaaaaaagaagtattcactgctacaacaaaaatataaggtactccttattaggtactgctaatacacaaaaaactactatatagtactgctcatcacttcaaagagtatatatactgcggcttaaaaaacagtatatactgttgcatactagaaaaggtggggatatctaaggtacgttatcaaatttgaaagcaaatgcatgccaacaatcttgttcaaatctgcacccaatccggtgtgcagctatgccacatgcatgcagtcatttggaaattaatattattaatttttttcatagctaatttgaatgctaatggatcatccattaataaaagggtgtacatacacctgggcgtatgaaagagccatcatatatatatatatatatatatagatatatataatgcatatatatgtattgtaacataaaccctaaaccatgcagcaatagggccatgcaaataagaaaaaaattggtagatcgatctttagtccaggttatttcactcaggactaaggatagcgatctttagtcccggattcgtagtcccggttggataaccgggactaaaggggggttacgaaccgggaggaaaaagggtttctccaccagtgtagctgatgctaatttacgtcatgaaaattgaattttaagtcatgttgtgaaatctaacgttcgtgtgacaaatatcattcgtcacctatgtcacaccctaaaaatccgaaatatataaattgttgtttaattggaattattagaattgatattaaaagcctagaagagaagatctatttttaaataataaatttcaatataaaattgggccagataaaattttattaaatactttgcttaattctatagttcctagatttttctgggatttatttgagccaaggaagtatttttaatcaatggaattgcatttcatgaataatttaaattgaaaaaggttttttaaatcctcttttggctttgggccgaaagtcggcccaaacccctctctctctcccggcctaggtcggcccgcagccgagcaccgtctgcgcgcgcgccctcgcccgctgataggtgggacccacctgtcagactcgtcgtcttcctcgcgccgtcgcccggccgaaccctagccgagccacgccgctgcccttccaaattcgatcgtgtctttcccgatccggtgaaatttatagaggggaaatgatccccgagatcccctgtaccttttctcttttggaatcatcggctaaaatcgttcggaaatccatggattcgaactcgaatcggattcgtctctctccccgaaccctagactttccattgctgccgccggtcgccgtgggccttcgccgccaccccctagccgctataaaaggacccccggtgtctcctctacccgccgccaccctcgcctaagtctcttgtcgccagtagagccctagcgtcgtgtagtctagcgccgccgtcgccgccgttcgtccagccgtgcgccgccgtccttccggtcgtcgtcgtcgctcgggaaagccgccgttgtgatcgtcaaatcatcgccgacctcgtccgcctctccgccgtcgctgtagatcgccggagccccgccgtcgtcgtcgagctgaaggtgaccaccgcttcttcctcgtcgccgtcgccgtccgttgaccttccgccgctgctttggtcaccggtgagttcgccgtgtcgcccgcaacccgtaggtgtccttcattcgcgccgtcgcgccgtcgttcgccggcgagcacgcgaggccgagccgccgtcggtgatgacgtcactgctgatatcatcgacgccgtccaccgtagaccggtcgtagaccgttagatcttggtccgttttggatagatcgatctcggccgttcgtttccgtgaaccaccgccgtgcacccggtccaccgtgagccgagtcctctgacgcaataatccctttttcctttttaaaaataattcattattacgtcataattcaattaaaatctatataaatgatttaatccgatttaatctatgaaaattcataactaattcatcttagctcgcatttagttggttcaagtctctaaatttttctaaaattgagatctacatgttaaaaatatccacatgtactgttcaggcttgtttatgtgctgttttggtgattttgctcttttctctttagagtccgacgttcccggagagtccgaatttgcaggagaagactttgaagagttccaaggccagcaaggcaagtcacacagatcccaaacaaccctttgagtatgttgatcccgtttaaagctattgtttctattcaactattgcatttattttcgaatgtcattgggtggaattaacctattgccttgttatagcccttttgttcttgattactctattccttgataccttgggttattataacttaactagttgagctttatatattggttcagctagatattagacataattgcttagccatgcttagaaacattagcacactattgggataacttatgcttcactattatttaatgatggcttaatgatagctcatgatggttaatcatgattggttaagtaattaatttgccaactaaaacctgataatggtgggttgtgagcatatggttttgatgggttgtgagcacacgattttcggttgtgaaacatttaccgtgtcaaccacaagccagcgtgggcaacggctttactttctatatagtatggttcatagtagagcaccagagtgtgaagtggcggagataagcccacgggggtcgctggggagtccataccttgtttataagggggtgattatgatccgggaacggtgcactgctttgaattgtattatatagagggtattgtcacaatctctattcgggtacttgtcaagtatcgcgacgcatggttgacatgatgttgaggttgtgtctttgtgggtacagtggtacacctctggccagagtttaaactattagaatagccgtgcccacggttatgggcgggtctaacaatgtctttcgtgattagtctcacacctctcaccatactaaatgatgctgttaataacttgatagctcctggtttggaatggttaattcctggtttggagatagaactgtgcagtcgggactggttgttcagaatggttgggcctatgcaacagggtatgttgtatagcgttggatcaatattgtttaattattatttaactattttattaaattctgaaataattgttacatgctatttaagcaattgagactatactatgccatcctttgttatcctgtgcacttgcttaattgttgcgtggcttgctgagtatatcatatactcaccttgcaatcattcatcagaggaggagttctacagtgatgctgatagtgtggatgattaggcgtagccttggtcaagttgcctgtggagaggagtcgcctgcgctgtttcttttattttccgctgcttagatctttattgattgagaggaactatctacctctgtaatgacattttattcgcttattaattagagtaataattgtgctctattatcaatttgttattgtgtgcctcggctgattccaggacgagggtttacacacatgtaagcatttggaattttggatagaaattccgggcgtgacaacctatcatgcgtctctaatggcgttctataaagaatgcttatcttttcgtcattaatattgtgatgatccttctgtcgtcatacagtctatgacgtccatcttcgtcactatcaagcccagaaatcatgataagatgccatgtggcctgttaaggcccatgtagtcagggccgacgagggggggaggggggagcgggatggccgctctaggcccccacccacacaccttgtcaggtcccaaaattaaagattcggtaaccgacatgtttaaactgtatcaagccctggatcagtagattgatacaggttcaacaatctgaatcttcatcgcatacatttgatcaaggctccaaaggtgatttctttacataaaataatagggtatttacaagattgtggctatctattactgtagaagctataggatgagccaactctaatgttttgctatagaattaaaccatctatctaatctatacttgggaactaagttggaatgaaactaatttatatgtttaaactcacggcttcagcaaaaactccaaattgattctcaaagagagggttaaagcaatggtgagtacaacatactcatcaagctattatatcaagtaatgaatgcatgaaatagtaatctctaagtagggtttaggacttaccctaaaccctatacaaaaaggtccatgggcattaggtgaactgcatttaggtccataggcccacatggcatacaaagcaattttacaaaaagaaccttacaagatttaaatttctactaatgaaagtccttacgcctaatgaagtggctaaatagccggggcccacatgtcagtgacttggcggctagggaagcagaggcaataggagggcaacggcgactgatggcgttcgcggcggcatattggcttgatcatttttgggcgtctttctcctgggatgtaggcgacgtcggtggcgcaatggctcggccagggatggttcgagtcgacgggaatgacgaagtcgggcgatggtggcgcaatggaccgggaacgccgacgagcatatcaccaactgttcgatctatgccaaaataggaacaaagaaaatggattgattaggtagagaaggaacttcacgttcccatggttggagtgcggtgaagctcaccagagaatacgtgcgatggatgaaactccttcaggtgaaaagag

SEQ ID NO: 74935 - DNA, 3532 bp, Oryza sativa
ggatcgtcttggtatggataaggtgcggatggctgcctacttgtatattatgaatatggtgcaaatggctacctgcattgtatgtatgtatcctatgcatgtatatagttgatggatgtatatgtttgtttcacaatctctgaacaaactcttcatatctagtcctgcgtaccagggaattttaaatttgcacgttttcgccgatggacagaaggagatgattttcagatacacttagctcgtacccgtcagatgaaggtaaaaggaaacgagtaataatgttttaagtgtactattgagtagtccttcataagataacttagttgtgtttgtagcgtactatggcgtggtagacgagttagtaccatggctggcttgcatgccatgtgagtccatgttagtttagttaggctgcccaatgtgagtaagtgaccgaataggtttagaaatggtatatttctaggtctagctagcttgcctatgtaggttaatgtgtgtgtatattatcgcacaaggtcagaactttttggaaattcgatactgtacttcttacaaatactacatacgtttctatgaataacacacatgcacgtttttgaccgaaagaattgagaaacaaagaataaatcttatatttagtaattggatgcaccaataaagcttccacgttagttaattgatgtcataatttttctagcgcatgcaagtgcataggttgatgactagtaatacataaatagaattgttgtattcgtattgaaaaacacgttgaaatgatgccactagaacggataccctcatctcaatcgggcggtaagccccatctcaatcgggcacagcgtccgtcacaggctagaaatcactgatgtgaagagttatctcaatcgggcaaacggccgtcacgaatgaatatatctcaatcgggccctaagtaaagcccgtcacagatagctttgacccagacgaccagtcaaactatagcccgtcatagatgacctatctctatcggaccacaactagagcccgtcacagatgactactaacctttatcgggcctaaactagagcccgtcacagatgatactcatctcaatcgggcctaaactatagcccgtcacagatgcctactgacctcaatcgggcctaaactagagcccgtcacatatgatctcatctcaatcgggcatttagttatggcccgtcacagatgactataatacacaaaaaaaataaattttgttttttggctagcctcaagcctttgctagccatgcccgctgcaaaaatgacagaaacaaacacagatattcaatatccccagctccccagcctcaaccattcatatacatatgcattcacatacacagacatgaacatatttcacacaaccacacattcacagccatctcatatttcacatccattcacatatttcacattgaatatttatcatgtttcaccaacaaaaccgagttaattggaacaaatatttatttagcaagtcttagtataaacatatgaaacatatacataaatataaacatcacagttacatcatcacagttgcataataagtgttcatcattgcctaaacataaaagatcaacattgttcatcattttagtttaagcctaaacattcctttggagtattgtcacagtttctttccaaggtaccgtggtggtactgagtcgcatggtgacatgttgtgggattgtgtcttgtgggtacagtggtacacctctaatcagagtaaaactattcgaatagccgtgcccgcggttatgggtgagttgaacaatgtttttcatgattagtctcacactactcattattggtaattgtgttaattaatttgactcctggtttggaatggcatattcctggtatcgaggtttgatttgtacaaccggggtggttgttcagatgaggtggggcctatgcaacacgggtgtgttgtgtagtgtttatttaatactgattaattattcaactgttttactattctcctaaatatttattaaatgttgtttatgcaaatgaactttattatgccgtcctttgttatcctgtgcacttgcatatttgctgtgtggcttgttaagtatggcatatgctcattcttgcaatattcattcatcagaggaggagtacttcagtgaaggtgatgatctggaggactaggcttgatccgggttaagttgcttgtggagtggagtcaccatagctgttccatagtttgttttattttccgctgcgtagaattttattctttgagaggaactatctacctctgtaatgatttattatttgtgaatattaattcgctgtttattcatactctattatcaatttgttattgtgtgcctcggctgattcctggacgagggtttaacacacatgtaagcgtttggaattttggatggaaattccggaggtgacaaaaacccactcccctccacagcaaaataaactaacatttgcgccctaaccatgtacatttgctcccaaatccatctccaaacaagcagaacaaactaacatctgtcctaaccatgtatacccagtaatagtactcgccatatctattcacaagcagatatcgccatatctattcacaagcagagaacacagagcacactcgtcctctgtgaacactgcacatctgttttaaattttattactgttccactgctgcagttcagctagcaagcacacactgttctaagatctcaaggagagtcctgtcgtggtcgagatgccctgcgcgtggcattttaaattttattactgctccactccactccgcatttccactccatgggtccatttactgaaactttttaagctcatctccctccatcgaggagcgcctaccgataagccgtcaactcttcttggctttttttatagaaaaaaacaaaactgtcaatatttcagagctccacgtatataaaaaaagaaaacatttcacagctccaatttttctccagtttgaggtgtcaaacgtcgcatatttcactaccatagaaactaaaattggagacgtcactacaaacgtactcactctttactcgtccggcgtatataaggcgcaccctcagttctactcgtcgttgcaccgcacaagtacagagagcacttgcatgcatataataggtcaggaggaactggcaatatgcaattaatctctctggaggattcatcaagatcaatgctttgctttgcttgcccggtctcctagctagctaatagtctccatttgattgatgcttttatactaattaactatcactactaattttcttataccaattaagtatatgtgtatcagcatagttaattaattcacctaggagactcttgctaatgggtggtttatatatatgtctcatgagatgatcaaaactgtgaaggcagattgatgattatttatccttctggctaatatgttatggccacttgagaggcacagttggagaagataacctaccacaatcctcccatcttgcgatttttgtcggttctcgtag

SEQ ID NO: 74936 - DNA, 7108 bp, Oryza sativa
attttctttagacaaagcatgcatatgcaccctatttaaatccctcttcctatctttggcgtgaaaccaagcaaactcctatccctctccacgcaggcccaaaggccagccgggtaaagtttatctcttttccctcccctccctaaaacgaagccaacaagtctagtttacatcggtctacgaaagagccccagtccacccctgcctctgccgatgtcgttggtgctgatagatgcgatgcccacacctcagggattcgcttgccgtggtgtgcagccggtgaatcttccgccgcctcctgtccttccgtcgtctaacgaggaatggttttaattctcctccgatttcccccattgctacataagttagtgattcattggtagatctgcttgtggttgaatgtacaagaatgcttggtagatctgattgatgttgaatgtgcaagaatgcaagaatgaatggagtgaactaaagcatatgttctggtatgcatatttcaaagtactgcgcatatgtgtattataccatattgtattatgtacttatgctgtgaaattatatgtggaatcctccactacatattttctcttggttaattagtttaggaaaaattgcaaatatgatcttgtgagaatttgtaaagtacatagaaggccatttgttttgacaatgaagtatggtttgttgtttgttgatttagatctccgtaatactgcctaaatttaaatgtatgtttggtgaactgaaattagatatggttagtgctgtcataattttttaatgactatttgtccttgtgagtaaggttgccattcctcggctgtattgcctttagtgtggctatttgtctcccaagactaagtgtcgtaggctctccggaccttccattatatttgagatgaagtgaataattcaagtcatcaaacaagcataatgaaacatccgacgcctcgagagaggaatattggagacattgctgagcccttagcctgccagtcaacttcagcctgagatgtgcccgtcaaaccactcgaaggcggcgaccagatgtgttacacattcaggagacttgataaaaatagctaaagatctacaacctctcaaatattcctaactcatactcatgtgaatctagttcccaggatgtgcactagattcacactttcatcttaagcatgattacacatagcaaacacaactaagatgaaagaaacttaagacttacaacaacttaataattacataggccaaccggccaaatagacttattagagaacagcggaagcttgactacccaatcacaagcacaccgactaggggtttaccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaagacaatatgtagttcattttcagcataaagcaagttttgtttcgcaattcttttgtaaaagagttgatgcttcaattaacaaagacaagttttgagtttcattattaacttcttcataattccatcataaacaatctcttattgccatacttaacaataagtcataatgtatcaccacatacacaactcaacacatttatcaatttcaaaccagtgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacacgcttagtcacctaaactaccacgtcggggtaaataggaagctcctctgaattatacgaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactgtatgcacaccacttgctgcccaagtgtaaaatcacattttacacattttagttcgcaaatacccatcatattcattttattctagcgaaggttcaagtatcaaaaccacattttaattataaatggaatgagcatttgcatatttctaagcatggctaagcaaagtagttgcacatagagcatatataaacccatttgagcacaaagagtgtactctaaccatttctaggggttcaaacagcaagaggatcaattattcaaggtggggtatgcagcaaataggtcataactaccttaacccaatttcaaataccgatataatctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaaggacacgatatgcaattaaacaccgaaagagctgaaaatccaaaatgctctaaaatgcatgatttatgcacagtgggttggtactgatctaaaatgaatttaggtgaaagaatttttattttaacttattccattagggagttatgaactttttagaagttttatcggtttatagtagtatagtcttaggtagtgttatgaaatacttttgtaaagtgatttttactagattagacttcacaggggtgtggagatgtgttttctaatactaacacatttggtttcacaatttttggatttataatgaattctttatgcattttacaagttataacgtgttattggtgtatagtgttttatatgttcatgacttttgagttataggttcagaacatgctacttcctgtttaagttgaataaaaggaataatttggttatctaaaacatttttagttcacatgtttatggtctttactagtatggttcatattttataaactagagatgctctaatctaaactagcaatatattatattaacctagaaattgttatatgagccaagttcttctaagttttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggtttcgatctatgttctctacaaaaggtgccaaattttattttaccatgttgaagataactattttctggttctatagaaactttgttcatttcatttggactaaaaataaattttctacaagttttacaaattaaaggctgctctatgttagtaaatccttatatgaatatttagagacttttactacacagtaagtatataatcttatttcataacttagaaatacatgtttagtgatcctacagaacttaagtttactcaaattgaagctaaattgggttctacatgaatttctaaagtttagcttatctaaaactaatcattatagagataatagttttagaggcatttgatgcaaagtaagtaattacttttatttcacctaatcagagactgtatgatgatgaatctgtagaatttgattttgtttcaaaatgagttgggatgaattttctatgtattttataagtttgtacatgttttatgtatgacctatcttagataaattttagagacattatttgtacagtgagtgtcaagttttatattcctggaataaagttcataacttcaagaatctacagcaactagaatcacttcaaaatgagttatatttgattttatatagattttacaactttgtgcatttttctgctaaacatatttgtttgggcattttcctaattattcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcggcaaacggtggctcgtttgaggttgaggtcaaaagataaaatgaagagaaagctctcgcgattccattcctctagttttcttggttagaggacatcggagtagcgccgatggcgagtgtgagcggcggtggttttggggtgaaagtgcatgtgtgcatggaagtcgattacgaacgaaaaggatgcatgcatgtagtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaaacgacgatgacggcggaggcgatccaagattggtgccggtgaagaaaaggatgtgttctctgtgttcttgatgtttccggctggggttcttgaggcgttttgaagaggaggtcgaggcgatgacaatggcgcagcggctttctctgaggtggatgagaatggccggacggcgacgatggttgaagcggcggcgctccggtgcgtgctccagggcgttgtcggcgtggcttgcgttcctggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccagtggcgaggttgaggatgacggagaggctgaggacctctccctcggcttcttcagctccagagtgatgtgtggagttgggcgactcggtctggaggagatggaggcatgactcagtgacttgaaggcgtcgacacgtcgtcaccacgcgtcgacgcgtccaggactcggtcggctctcgatctctccctctatgtgtttcttggtcggctgaggatgagggacagaggaagggcgagctggagaggctgccaggtgggtccaggtcatggcaaactaggctagggtgagagggttgggtaagattctgggtaaacttgatttttagatcatttttttcggaattattttctcctctaactttgtaactacataattcaatgtgtagaccagaagaattagtgtagattttactggtggtagatgattacacctagattccattttctttggttgcactaaaaaaataatgggtggactgctcacagaaattaaacaaagatgggctattagaaagctagattgaatttttaggaggcttaaacagaggaggaaaattctagaaaaattatatttaggcatgataactagtctagtatttgaataaattatttcccatgttcacttatgtgcagttaaatgtacttttggatgaaatatggttttagccgattaaaatttaatttgatttcttttagttgtctgctttgaccgtttaatttgaggtatcaacttgagtgttaacacgttaccaaattacggaggataagtttgtgctaatcactatccacataaatttttccatgattttatcttgcacaaaatattttagagaattaggatgacctttgtttgtatatgtattcccacttcataattgcatttaatattattatagggattacattaaattttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcaagcctaggcatgcattatgtacatgtatgcttggtgacatttctagtctaatgttgggaatgaaaagattttattttgttctcaaattataatcatgcaatggtttaagttgatcttcacctaaattaaaacggaaatttttggctctctcaaaattggagaagttaacctctaactattttgacaagaaattttaagtcctaaaatttcgggtatgttacactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatacgctaagaataaattaagtaaagaacatgcacacacaaataataataatcatgttgcattaaattgctaaggtcagagaccaacagatgacacattggatagtgctatagccttattaaaagtagcaagagaaattaaatatgcttgtgagcgcacatatgcacgacatacaaatagttgggaccaacagatggatcgactatagatcgctccatatggtcaacaatttattggagataaacattaacataacttggccataacttgaagcaaaacaacatattcttatgaaaggcattaagactggtagcaatgcgagtaggttgttttaggcttgtccttccatcttagcaagaactcccatttcgtccatcttagcaagaactcccatttcgtccatcttagcaacaactgtg

SEQ ID NO: 74937 - DNA, 13926 bp, Oryza sativa
cattcttgctcaatctttcccccccttcagtaagagaagctttggagatgaagtcctaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgtcagaattcactatcatcctggtaaggccaacgtggtcgccgacgctctaagtcgaaaaagccattgcaacactcttaacgtccgtggcattccactcgaacttagtcaacagatggaagccctgaacctaagcatagttggtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggactcccaaagacccaaggtgggtatgattccatatgggtagtggtggatcgattaaccaaggtagctcgattcattcctgtgaagaccacctatggagggaacaaactagccgagctctacttcactaggatcgtgagtctccatggcgttcccaagaaaatcgtatccgataggggaagccaattcacctctcacttttggaagaagcttcaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctaccaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtagcccagtcccggcagaaaagttatgcagataaccgtcgccgtaacctggaattcgcagtggatgattttgtgtatcttcgggtcacgccattgcggggtgtacacaggtttcagacaaaagggaagctcgcaccttggtatgtgggtcctttccgtatcattgcccgacgcggagaagtcgcttaccaattggagctgcccgcctccttgggcaacgtgcatgatgtgttccatgtgtcgcaactcaagaaatgcctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagccacctgggagcgtgaagacaagctgaaggcagcccatcccgatctcttcgccagttcttccgaatctcggggtcgagattccgtttaaggggggtaggtttgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatctttcctaaaagcctaaaatgcgtaaataaattttagtggaattttcagagcacaaataataattaagaagaaataaacaaagttaaaaaggttttataaaaagaaaaaaaccctaaaaagtctttttccctccccccttccccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgcaaccgccgcctcgcccgtgccctagcgccgccgccgccgcggattccgccgcatcctgccgcccccgcgcgcaataaagagggggaaatcactccccgtgattccctctccctttccccccacttttccctctctctctccctcggattcgtttggaaacactcccgcaaacttcgccggcgcatcaatggcggccggatcttccgcggccgattccccctcatccgtccgttctctccccctcccaacactatttaaacgctccccgtgcctccctccaccgtttccgccactcgccgctctctctccccgtcggaatcgagctcgcgccgtcgttctctctctccgccgtcgccgccgagctccggtccgccgccgtcgtcgccccggaccctctcccgtttcggcgtcgcctccttcggctccgccgcgacctcggcgacctcgtcaccccccccccccccccccgtttcgcccgccgaccgccggaacgccgccgtccccgtcgacccgagccgcgccgccgcctctctccgcttcggtcgccgtttccgttgtcgccgtcgacccggggtgagccgtggaccgccgtttcgcttcccccttccctcccttctctcgggcgccgctccgccgcgccggtggtcgccggcggcgaccatcggggcgcgggcgcgccgcctcccgtcggctctgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccacgtgggccccactcccgtggacccggtccgcgcgctcctctctcccggctgacgcaataaatccgattttaaattaaaatttaaatgaagaaagtcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgtgttatttagccatgcctatttacctttgttatgaccttattattattggtattgttattattaccttgttcaccctagaaccaacaaaaccccaactagtggacactctactcatggtaccactagtatgattttaggtagatgcttcgctttaattaggtaacattaggtggttttacaactctagactttgggaatattcatatcacctggatactttggaatggtttggttattgtggaatgggcttcacaccgctccttctattcaaaatccccaaaatggttttaggctgggctcggggtgcatggttttgatagtagcacctcagccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatagccgtactcatggaattgagtaccgggactcatatgacaccttggttagaaatctaaagtctatatgtttataaattcttgctataactcttccagattgcttattactgccttttgcaaagaaccctactatatgtcaatacataacatatttccatgatgacttgctgagtattgcgaatactcattcttgctcttataacccctttttcagatctggatcaagaggaggacccttatgactattactacgatgaccccgataatttagggaacccctaaaggttataccttcctagtcaaaatgtactaaaatttccgctgtgtaatattagtacttatgtaggtaagtacctacccttgtaaaaccctagcattgtaaactttaatgtatgcaattaagaaccagttatattgtatgtatcaacatctactgatccagggatcgattcattaattttagtcggatccaaatttttagtttcgggtcccgacattggttgaaatctatattgatgatgtggtcgttaagtcaaaggaaatagatgaccacatagccgatttgaggaaggtttttgagagaactaggaagtatggcctgaagatgaatccgacaaaatgtgcttttggcgtatcggctggtcagtttttggtattccttgttcatgaaagggggattgaaataactcagaggagtgtgaacgcaatcaagaagattcaacctccggaggacaagaaagagttgcaggagttgatcggcaagatatatattgttagaaggtttatacctaatttgtctggaaggttagaaccttttacacctttgttgagattgaaagccgatcaaaaatttacttggagggcagagcagcagaaggctttggataatattaaagaatatcttagttctcctccagttttaatccctccacaaaagggaataccttttagattatatttatcggccggtgagaagtcaatcggctcggtcttgattcaggagcttgaggggaaggaaagagttgtgttttatttgagccgtcggcttttggaggcagagacaaggtattctcctgtggaaaagttgtgtttgtgcttatatttctcttgcataaggttaaggcattatctattgtccaatgaatgcactgtaatatgcaaagccgatgtggtcaagtacatgttatcagctccgattctgaaaggaaggattggaaagtggatatttgctttgatggaatttgatcttcggtatgagtcaccgaaggcggttaaggcacaagctatagccgattttattgttgatcatcgtgatgactcaatcggctctgtcgaaattgtgccttggactttgttttttgatggatcagtgtgcactcattggtgtggtatcggcttggttataatttctcctcgggaggcaagttttgagtttgcctatactatcaagccctatgcaactaataatcaggctgagtatgaagcggttctcaagggcttgcaattgctcaaggaggttgaagccaatgctgctgaaattatgggtgattccttgctgttgaaattatgggtgattcaattagtaggagaatatgagtgcaaaaatgatatattaatggtttacagtgagaagtgccgagagttgatggatggatttcggctggtaactttgaagcatgtatctcgagaacaaattgtcgaagctaatgatttggctcaaggggcatcggaatataagccgatgatgaaggatgtcaaagtagaagttgccacaataacagccgatgattggagatatgatgtttttcgatatttgcagaatccgtctgaatcggcttcgcgaaagttacgttataaagctttaaaatataccttgttggatgatgaattgtattgttggacgattgatggggtattacttaaatgtttgagtgccgatcaagctaaggttgcgataggagaggtacatgaaggaatttgtggaactcatcaatcggctcataagatgaagtggttgctttggccatttagaggttgattctggggatgctataaaatttgttcaagagcatattatttatcgatttggtattcctcaaaccattacaaccgatcaaggctcgatcttcgtgtccgatgagtttgttcagtttgacgatagcatgggtatcaaattgttgaattcttcaccatattatgcacaagccaacgggcaaccgaggcgtctaacaagagtttaatcaagttaattaagagaaagattttcgattatcctcggcaatggcacacttgattgtggtcctataggatggcttgtcatggttcgatccaagttcctccttataaacttgtttatgaacatgaggctgttttaccatgggaagttagaattggctcaaggagaacggagttgcaaaatgagttgacagccgatgagtattataatctcatggccgatgaaagggaagacttggttcaatcgagattgagagcccttgcaaaagttaataaggataaggaacgtgttgctcgacattacaacaagaaagtggtgtccaagtcttttttcggaaggtgaacttgtgtggaaattgattttgccgatagagactggagataacaagtttggcaagtggtcaccaaattgggagggactgtttaaaatccataaggttgtatctaaaggagcttacatcctacaaggacttgatggggaagtttatggccaagcgctaaatggcaagtacttgaagaaataatacccaagtgtttgggttaatgcatgatcggctggtgttgccgatacatgatagccgatgtatttacatcgccttgagatggccgatattgctatatcgcccttagttgtttttatgttgtaatcggttgtgatttgccgatgtacaatggccgatattgttatatcgcccatagttcaatttataattttatcaatgccttcgtccttgtaaaattaggggggcacatatatagaaaagttgcaaatttgaatttttgagtttttgaggaaattttttgagcaaattgaaagttatattaatcggcacagcagtacagtgatacaaggagcattaaagtttgctagccgattacaaagataagttatcctattacaagaccaatcatccagacaaataacactggatagccgatacaacccgttgtctaatttgaactacttcttcgatggcttggatgtcttgggcgtcggttccagggatgattttgagggacttggtcatatcagccacattctttatagccgatttaagtatggatttatgttcttcgacagcatttggaagattggctaacttttgcttctgcagatccaactcagcattgcattcttcaagttgagctattagatcaatcttgcgggcttcaagccgatctatgttcgattgaatcggaccagtagagagttgatcaagcttggctttctcctcatgcacaagctgccgattggcttggatagtggcttcaatatcttttcgctcccgtcgatcagctattctttgcttagccttctccagcttgaattgatgttgctcgaggtatacagctggagtaatggtgttcgccagatcatccgggattaaggcttggatttcagcaaaccgtgcccggattgagccacaatcggccaccagattatccaatgatgactctagcggaagggatatgtcttcaagtgttttcttgatagtttcatccagagggtctagagccttgctagtggtttcttcctttgtctcatcaaagtaatcctttatatcaaaagagaacaaatcggctaaggcctgcaaaagagaaatccgaagatagttaaataatcaaacaaatttagccgatctaagatcttattatagagagaaacttactaggatggcaggagcggctggttgttcttcttcttcatgatgatgacttcctgtagccgatggggtacagtcacttgacatctgctatacaggtggggaaggaggagcaggaggctgcaaaaagacaaatgttaagtaaatatcagctatgatcggataaatggaaggatttatataggacaatcttaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccgatgccttggcctttctcttcctgccaacatcggccggttctctcatctgtccttgaagcagacttgaggtcttgggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatctgtcaaaattcctactcctgagtcttgccaactctatgttctcgatgctgcccagagggggtgatgtgcactagggttcccgatcttccgaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcacccattttagtgtagactggtcctggactccgaattgcacccgatgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatatccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacggctgagcagacaacaattttagccgatgcattgttcagcatttgaaacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacatgttctcgggaggtggcaggtcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgatacccgtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaacaagatgaggcaaggaagaaccaatctattgcgaaagaagaggatctagccgatgggtacttaactctgcgtattctgccgatggcgcgacggatggactggcggaggacgacatctttgcgggcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagaagaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgtttgggcaaaagtctgccgaaaaggattatggtatctttgtcgacgggtggcacccgtagaccggatatattgggtattggggtatgttggtacaaggatctacgtaatacgacatcaagcaaacaaaagacaaggattatactggttcaggccccttgacaggtaatagccctaatccagttgatatgggattatatggtggaaaacacaggttacaaagggaacaatggaacatgacggatccggcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcagaaagtatccgtatgcgcgtgggtataccataccgatatgtgacgtatatcgaagggtaaagggtatgcctaacccgtaaccctgacagtagcccccgacttctgcttaaaatgagttcgtgtaaccgttcacaacttctagcgtcgagactgttgtcgttcccagtgcgaggaccgtagagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataaaaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcagcaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattatgaacaaccaatcccggctgcacagttctatctccaaaccaggagctaaacaagttattaacatcatcattt

SEQ ID NO: 74938 - DNA, 12801 bp, Oryza sativa
caagtctctaatttttctttaagaagccaaagaacaatttttgtgctttatttcggtttgtatatgaagtttagtaaagtaaagccttttctttccgtttggtcgtgtagacactcaagcttcggaagatcggctcttcgtgaaatttaaaccggcgtttgggaaagcaagcaaggcaagtcacatcatctttgaacatattgaatcccagtatgtaaaattatgttatttacttattgcattatcgctttatttaaattcccgagttatcactgttttatttagccatgcctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgatgacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcaagtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttagcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcggtgcccatgtaataaattaactatttacgcttccgcttgttaaactctgaattgtatcaacttttggtgtaccttgcctcctgggacaaggattaatgcacgcacataaggaacgctcgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtgggtttttctttctgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggactgtgacgatgcagagccccacgctggttgggaggtcactgcagtgatcctctctggctctcccgagcggacttcgctggcagtcaccacgggtggagattctttccccgccgcttgccagagcgccgctctcctcgccatcggcactcttcaccagcgatacccggacgagttgcagcactcgccctaccgctaccaccctcgccgcggaggagcccgcgactacgccaccttccgggatgctagctcggaggatgacgctaccctcgtgcacctggcgtgcatggtggaggcgtacgacgcggctcgtatcgacttccatcagatggtgcgccgtgggatggtcgagaacaacatgaagatcctggagctgcgtcaagagaatctgcagctcaagaaggacctagacgcagtggaggcgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccagcgttggtagcacggaggatgcgctgttgctcaccttccgttcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacctgaaggcagcaaccaccaccaccagggcagcccaccttcaccttcttcttcgccttcaccaccaccaccagataccaacgccattctcacccaaatcctcacccagcaggccaacatgatgactgctttcctccaccacatccaaaatccgccacaacataatgctccaccaccacccccacaacactctaaactcgccgagttcctgcgcatccgcccacctaccttctctagctccaacaaccccgtggatgcgttggattggttgcatgccgtggggaaaaagctggacactgtgcagtgcagcgatgaggagaaagtcatcttcgccgcccaccagctgcaggggcccgcatctctatggtgggaccatttccaggctacgcagccagaggggcaacctattacttggacccgtttcaccgccgctttccggagaacccatgtgcccgccggagtcgtggcccttaagaaaagagaattccgagagttgaagcaaggcaaccgctccgtgatggagtatttgcatgatttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtggcacaagcgccgcttggcgaatttccgcaaccaacagggtgctaaccaaagggtccgctacaccaatccctatccagggggatcctcctcgcagcagcaacaacaacagcagcaacctcgctccgcgcctcgacctcaattcgtggtgcgcgtcccacagccgcagcaacagcagagtcagcaagggactcgtgcgcctcgtcctcctacgccaactgtgcagcctggccaaggccgcagggacgcttcaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccatgtgacggccgagaaggtgttgacaactccagacgtaatcgttggtacgttcttcattcattccatccctgctaccattttgttcgactctggagcttcccactcgtttatatctgtgccattcgtggggagaaatcagttggggatagaaaggcttaggaaccctctgctcatcaccacccctggaggggttatgacagcaaagtattatagtcctgccgtccctatagaaattcagggaattccttttccctcggatttgattctgctagacaccaagaacttggatgtgatccttgggatgaattggttggctcaattccaaggagtagtggattgcgcgagacgcactgtcaccctgtaccgagggccggaacaaccgattgttttctttgcacccccaacctctgtcagaagttcagaacttcatcagataggactgtcagaaatccccatcgtcagagagttcggagacgtgtttccagaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatataggtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacatattcgtgaagaagatattccgaagaccgcattcaccacgcgatacggactgtatgaattcacggtgatgtcgttcggtttaaccaatgcacctgccttcttcatgaacttaatgaacaaagtgttcatggaatacttggataagtttgttgtggttttcattgatgacattctgatatactcacaatccgaggaagaccatcagcaccatctccgtctggtgttgggaaagttacgggaacatcaattgtatgccaaacttagcaagtgtgagttctggttgtccgaagtcaaattcttagggcacgtgatatctgctaaaggagttgcggtggaccccgaaacagtgaccgccgtcactgattggaagcaacccaagacagtcactcaagtccgcagtttcttaggtttggcaggatactaccgaaggtttatcgagaacttctccaaaatcgctcgacccatgacacagttgttgaagaaagaagagaaatttgtgtggagcccgcaatgcgagaaggcgttcaaaaccctcaaagaaaagctggtttcctcaccagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagcttgaaatacatcttcacccaatcggatctgaatcttcggcaaaggagatggttagaactcatcaaggattatgatgtgggaatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggttataattattaagtaacaaaaaccattatcaaagtttattaaaaagaacaacctaaaaataaatcctcttcctcctttgggccaagcccagcccaaagtctccctctcctccctctctttctctcttctccttctctccctcctcctcttgggcctcctcccctcccggcccactccctcctccctctctctcccgggctccctcgccctcctctcctcccgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtgaggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgccgtcctcctctctctcccgtgccaccggccggctccagccggctttccctcctcgccggagcgccgtccggtcgcgccgtcgcctcctccagcatcgcagtggcctccccttccccggcttggcctccgtttcccgcggagacccccggagctgcgttcccgccgtcgccctttcctttcctccgcgccggccgcctccagccgcctctgtctccctgcctgagcaccggtcgacgtcgccaccacctccctcgcctctgcgacgccgctctcatccccggcatcacctcctcctcgcccgaatttcgccggaacaaccgtgccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgttggtagtcgttcgcttgtgcgtgtggtgaccgtgttagtgtgcccgctcggtagccgcgtggtttccacgtgtgcagcccgtgtggtgtctagtggagtccgtttgttggcccctcgcctcggttgacacacggggtccgcttccgtcaacccgtggaccgtctctgtgtactcggtctaccgtggtcctttaggttgacatgtggggtccgcatgtcaacagcgcagccttcctgtcttttccaggctagcgcttccacatgttttatagttgcaaagcttaattacaataatccgcaaatctccatgtaacagcattaaacttcggatgatcatatcttggtcatacgaactctgaatcgacccgttcaagtctcttaatgtttgttataacctaaagaaccctgtgctttctttttatgtattgttattgcttctttataggcttgtagctttgcttgtgtgcttcgcgtagcttttgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgtttaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttatggtggaattggacatacccctctcttcctctttcaaagcccctaaaacctgtttttcggtggggtttgggtgcatgatagttgtgggaagtagcaccccggccactataaggattaagctcgggcctttgttgcaaagcactaccgtacttccacatgtctagtgggtaaggcttagtttgtggctcagtctggttataaacagaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaaatgctgtttactgcaaaacctaacccttatattattaccccttgtacccccttgcattaatcatgcatctgccggtgtggcttgctgagtactgtggttgtactcattcttgctcaatctttcccccccttcagtaagagaagctttggagatgaagtcctaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgtcaagctggtatcagagccatctcgactgtaggataagccaagtggataaaacctaaggacatattttataaatgaaactatttccgaaagtccctttttcctcctttcccctgtgctatttgcaaaatatttactctttcttccttcttcaaatttcaactagtactggatggttagttttgcgaagaagaagatgtcgccaattgtctgccgaagctccggaaggctgcaggatctgctagcgaagtggaggaagcagtgaagatcttggagaacccgtcgcagaacctaagccaccctctagggtagagtcgttagttgtgtgtttccttgcttgtgtgtgtagcgcgtggtttgcatctgtggggtgtgatgtaaccatgctaggttgtttgcttaatcaacttgcagaagaagtgaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattctgagcatgctgcttggttcacagttaccattagttggaagtcaagaccaaaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaaatgctttcctcctagcctttcgtaccacgtggggtcacgtactaagcaagccaaaagcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatctcggtgaggaagagatggaatcaaaggcatgcacccgttgtggagaaattggacacattgctagcaggtgtctcacactctgccctcattgtgaagaagaccatccaccaggggagtgtcccacccgcaaggtcacatgttttctgtgcaaaggtacaaaccatgtgcccaaggattgccaactcagtgtgttgttgatcaagaccgcagaaatccaacgaacaaccctacgattgtctcgtcagctagtcagctccaacagcaacatcgacgatatcatccacagcaccaatgctcctcctgctgcgcctgactctgcaacaaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatggttatggatgattcatgttgaggatgcaatgtaccgatgttaagcaccttccctttttgtttaaggcaaggccttgtattcatgtaataagggagacatgtgtaataaaaacaagttctatgaggattatttcggaagatgttgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacaacgaagcttcagatttggcaggataatgatcagacaataacaagtccagcagtaaagccatttgggaagacatcaaagcatgtcaagtgggataagttggttcttttagaaacataattcaaaggaaaagttaccgacccttgcatcgaatagcagaagtagctggcactcggagagcaggaaagctaatatgaggcagttggtgacaagttagaagtaaatgacaagcatggtaccctggtaatgacgagctgatctcgacacatgacatgaagtgggtaacttgtatgaggttgactccaaagatttgaactatgcgaagttctggaactgaagccccatcctcaagtgccgcaacccagtcgaagtcagctaaaggttcaaccagggacaagtcaggtgaagagaagattccatctgcaacaagggatcgagacaagcagcctagagtggagaagtttttctaggcaagtttgttataaaagacgcgacggaagaagtcagacaagaagagaagaccgcccaacctatcttcatgctagcctcctcgaatctccgggacgagattcttgtaaggggg

SEQ ID NO: 74939 - DNA, 3045 bp, Oryza sativa
cgatttttggcggttctcgtaggccaattagagatgcaaggaatcggggacttaatctaattaattaatgaaatggcaggacagtagtagacccttaatcccggccctctggccaattattcattgataattttgataatgacacaatcgctaaaatttaactttgtccttatcgagtgtcctgatcatagtattatggaagtgttttagacaaatctactagcaccattatatttttcacatatttccatctttacatgcatgctcgtgtatatatatataccacaaattaaaatgaatatttgcttgtggttaattagcacctcaactctcatggttcattttctctcttgataaaaattggggataaattaaccgatattttccataccaaaattaagctaatatcgtcaacaatttttaaaatgaaaaaaaaatcgtcaaatattgcgaatatatcaatggatcaacttgcatgccctaattatgagcattcttaaaactccaaggaaaaaaaagacaaaaaagctgaagtgtgatgaatgcatatgtacatattgctcctcccaaatggccgggagtattaatttagaaccgaaagaaatcatttttgtctatctcgcatttttcatgtaaatccagtgtgcgatttcagttggtgaattgaacttggtcatcaggagcacctttccaaaaagtttcatctttgttcagactctaaaaaaactactccctccgtttcacaatgtaagtcattctagcatttcccatattcatattaatgctaatgaatttaaacatatatatctatctagattcattaggaacattataaatgtgagaaatgctagaatgacttacattgtgaaacggaggaagtagttggcaagtgaagttctttagtttcactactacgaaaaggattattcctaatgcatctagatccgaccacatgaatcagcatgatccatgatgtgccagaccacgttgagcacatttgatcttaacgtatatagttccgaccacgtgaagcagcatggttcacgatgtaccagacttttaaaaaacctagttggtaagtgggattttttggtcttatctacccaggaaaatacagcacgaatccacacagcatgcacattatgcatggacttttgaaacgaggatattccatcggtttctctgacaaaggcatgcatgctagtagtttggaataaaaaaactaaggataaattaacactagcaaagtaattaataataaattaacacacatgcttaattaggtactagctggcaacaagttaattaattaaatcagctccgtgcatgcagagcctctgactccatccacaaaattcgcatgcatggtgacgtggctggatagcatccaagaaaccaaagtgaatcaccgatctattagctccctctttaatgttgaagcagaggacgacaagccagcagcacagttagtagctgcaacgtgcaaaaaattttaggctagctaactctactagcctcttagacacacacacacaaacacaagtgtaggaagagaagattaagagaagaaggattgggttgggttgaatgtttcaaaatttgcatctactaggatccagttgccaactaggcacgcacacgctatgaaactgtgtgctgtatgtctcaaactgcctctctaatagccaaacaagccatcactacaagaatctaattatatgtgatgctcatttacgtcataaaaattgaattttaagtcatgctatgaaatctgtgacattcgtgtgacaaatatgattcgtcacctatcatgcgtctctaatggcgttctataaagaaagcttatctttttatcattaatctagtgataatctttctgtcgtcatagagtctatggcgtccattttcgtcgccatcaagcccagaaaacgtcataagatgccatttggccttttaacgcccatgtagtcagggccggctcaggggggagggggtgcgagcggtacggccgctctaggctcccaaatcgtaggggcccccacccacacaccttgtcgggtcccaaaattaaagattcggtaaccgacatatttaaactgtattaaccctggatcagtagattaatacatgttcaacaatctgaatcttcatcgcatacatttgattaaggctccaatggagatttctttacataaaataatagggtatttacaagattgtggctaactattactgtagaagctacaggatgagccaactctaatgttttgctatagaattaaaccatctatctaatctatacttgggaactaagttagaatgacactaatttatatgattaaactcctggcttcggcaaaaactccaaattgattctaaaagagggggttaaagcaagggtgataacaatatactcatcaagctattatatcaagtagtgaatgcatgaaatagtaatttcatgttttagggtaagccctaaaccctatacaacaaggtccctgggcattaggtgaattgcatttaggtccataagcccacatggcaaacaaagcaattttacaaaaagaaccttacaacatttcaatttctactaattaaagtccttagcacctaatgaagtggctaaacagccgggcccacgtgtcggtgactcggcggcaagacaagcagaggcagcaggagagcaacggcgaccgacggccttcgtggcggcgtattggcttgatcatatgtgggcgtcgttctcctgggacctaggcgacgtcagtggcgcaatggtacagccggagatgattcgagtcgacgggaatgacaaagtggggcgatggtggagctctagacaccgggaacaccgacgagcgcaccaccaagtgttcgatctatgccaaaaaagaaacaaagaaaatggatcgatcaagtagagaaggaatttcatgaatcactactacagaaacgattttcctggatagggaccttttagattccgtgcgggcggtatctcgttgcttctgggaaaatcggctcattttcgcgtgcggtcca

SEQ ID NO: 74940 - DNA, 4461 bp, Oryza sativa
ccgattttcccgtgcggacctattaagagagccgcatgcagaaatactaagtccctctttcctctctcacccactttaaaatttccactctttctctcctctcccctcccctctatccctttttccactttaaaatttccacgcagagcatctcctctcagtcttctctgtctcacgcctctcctctcctctctccactctcctctcctctcctcccgacggcggtagcggtggtggcgtgtggcgacagcagcggtgcgacggcggtgggagtaggagcgcgcaggcctgctccacgtggcggcggtggagggcgttggatccggcgggcggcggcagtccctacacggatccaacggtggtggccgtcaatgcaagaatccagcggtggcggccgtccccgcacggatccggcagccggccgccatctccccacgcgggatccagctcccctcctctccccttccttccctccctagatccggcagaggggaggggcgtcggcggcattgcggcgggagggaagcgcggatctgccggcgggtggcgcggaggccggcgggaggcaggcggcactatggccgtcgggcggaagcccactgccggattcttgggtttcgtttttttaaaaaaaattatgttatttcggatttttgttttcccgtggggatgcgccacccgcacgcaaaaatcatcattttcccagacccctaggtgcgtgtgggccgcctacccgcgcccaaaaatcattttagccctcacacaaaaatcttggttgtagtagtgaatggtaaaagtgaaggtgcaaagtgagagctagttgtcaacatgaggggtagaaacgatttaaaggagttggcagtggtttgaggctgtgatcctacttgtacttcactcaaccaagtatgagtggctgtctagtggcctcatgtagatgtttcctaggagaagatgagaggtatggtgaagtttgggtgtaaattggactttaactccctctctctctctttcattgtctctttgaaaatataatttaggatcaaagagatgattcaccaaggttgtttgtaggtatttggaaaacaaataggcccatatatagatgtttcctagaaggcttggagtggtagagtggcattttgggtggaaattcaatttaaacccttctctcaccttttgagaaataaaagaagatttaaatgagagaagagcagatgatgtgttggctagggttgtatgatgagtgggccccataaggacttggtcccacatttaagagagatgtagaaggagagaactagaagctctaaattttccatgtgttggcactatcacactaaactatattactctctttctctcatccatttaatttagaattaaggccgggggagggggggtgacagggagacagcaaggtagacaaggatttgatggttcaaggtgccaagttccaaagtttaattacttttgcttttaccatggtaatttagtaaagttgactagttaatctattgaccacagtccagaatactgtttacctaacttatggctctcattttatgaggttacatttcgaattagactaagccattgcaccagatgatagagtaaagtatgcttaacattttgacctagagattttgcaagatgagttatggtttaattttggtgaaggtgcaaagtaggctaattggtatgctgtttccagattttttagctgagttcaaggatttatttgggttaccaattgatgtgataaattattataactaaaatttctgggagcttagggtattgtttagtatttatgagaattttggtgggatttattgttgcctcatttatttttaggaattttctctttagacaaagcatgcatatgcaacctattatgagatgtaccaagaatatccaaaaacaatcttaaaagaataatatgcagatacaagcaagttctttttatctcaatttaggtttgcgtattttgatacctacctttcaatttgtttgatatttaacttaaatatatttttttagttaggttgaaaatgcaaaaccgagaagattaggtttctagtttatggtcaaagcaaaatttttgtttcaaaattttttaccacaagatttgtaaacttttacttttggacttagttttgatttggccagaaaaattatgtgttttattttattttagggagttatatgctctagtatgcttctatgttcaccaaaaacttttgaattcaaaatgttttaaattttccacaaaatttttccatggtgaaattccttgtatgttacaagttgatatgtgaaataaaattttaccttgtaaaatatgacttggaatagttttattaacttctcaataattaattatgctctcttaaattttcttgaaattttccgagctaaagaaataattttaataatactaacataatttcggtcattatttaaattgaaaaaacaatttaaaattctcttcatatcttttggctgaaaccaagccaactactatccctctccgtgcaggcccaaagccatgccaggtaaagtctatctcttttccttcctctccctaaatagaagccaataagtctagtttacatcggtctatgaaagagccccagttcctcccccccccacccgccgatgtcgttggtgctgatagatgtgatgcccacacctcagggatccgcgcgccatggtgagcagccgatgaatcttccgccatctcctgtccttccgtcgtctgacgaggtaaggttttcccccccgattacccccattgctacctaagttggtgattcattggtagatctacttgtggtttaatgtgcaagaatgcttggtagatctggttgttgttgaaagtgcaagaatgcaagaatgaatggtgtgaactaatgcatatgtcctggtatgcttatttcaaagtactgtgcatatgtgtattatacacaagttagcatgcacattgatctttgcctcttttgccgtaggccctagtatgcatatgtgtattataccatactgtattatgtacttataatgtgaaattatatgtggaatgctccactgcatatttgctcttggttaattagtttaggaaaaattgcaaatatgatcttgtgagaatttgtgaagtacatagaaggcaatttgttttgacaatgaagtatggtttgttgtttgttaatttagttctccgtaatactgcctaaatttaaatgtatgtttggtgaactgaaatagatatggttagtgatgtcattgttttttaacgactatttgtccttgtgagtaaggttgtcattcctcaggtttactgcctttagtgtggctatatgtctcccaaacctgagaaaacgaggaatgtgatagtagccgagaaattgatcatgtttcctcccccccccccgcctcttttgctttcctactaggttttgcaataatttttggcatgacaatcttaattatgtcccatagtctaaaactcacaaaaacatcagaaatccgctaagaataaattaagtaaagaacatgcatacacaaataatattaatcatgtcgtaataaattgctaaggtcagagaccatcggatgacacaatggacagtgctatggccttattaaaagcagcaagagaaattaaatatgcttgtgagcgcacacatgcacgacatacatagagttgagaccaacagatggatccactatagatcgccccatatggtcaacaatttattgaagataacattaacataacttggccataacttgaagcaaaacaacatattcttatgataggcattaagactggtagcaatgcaagcatgttgttttaggcttgtccttccatcttagcaagaactcccatttcgtccatcttagcaagaactcccatttcgtccatcttagcaacaactatgaaattaaaatatgaaaatcccattagcgcattagttaattttgtagtggaagtagagcataagatgtcttcgtgttgcaagatacatgcctgaagtcgtgagattggaagtgaaatcaacaaagcacattgaggaaaatgcatggaaggccacacatatgtattagtccacgatatgctacaaagtctgtatctacatgtaagaaatgcattaaatagagtgacattagtgaatttaccagaatcggccagaatacatgggaaacaacaagtgttcttgtagactgagtcggagccaccagcagcagtacaaccgaaacaacatgcttttgcctaagaggatatgcagcagccgcactgtgccgcggtggcggagtcgacagtgaggctcaagatgaccaggcacatgatcaccatcgaagtggtagtcctctttccctccattgcctcctgttgctgatgctaccttccctggttatcttgctatgtttcttagttttgtgttgagaggtgattcttgaatg

SEQ ID NO: 74941 - DNA, 3874 bp, Oryza sativa
  unsure (1)..(3874): unsure at all n locations
ctcaacaagttataccggaagaggaggtatgatgcatgatataaccaaaggaggctaggggttcttttgcataagctagcatttaaaaacagtagttgaaagtagtaaaacagttgtagtaattaagcagtactgaccaaatcactgtccaacgctacaccacgttgcaacaggcccaatcaaccacctgaactacaccagttcattaaactaaactaggggtgagactaatcacggtaaatctggttgatcgcccataaccgcgggcacggctattcgaatagttttactctggccagaggtgtacaactatacccacaagatacgattccacacatgtcaccatgccccgaagtatcaccatgatactgcaaagggggaaatcgtgacaagaccctccgcataaccctcccctaactatccacaccacgctaaggtttcactcccaccactcaaaaggcagtgggcggtcccctcttgcgccgcggtgaatccggcagctggacaaccggacaccccggctgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccacgggtgcgaccagcaaaaccgtgcacccacagcccaccattcagtgtattttaattaactaacaccattgcggtggcaccaatccaaagctattgccaataatcaaagtcaatgctttaatgtgattccctttttgtgtactagtagaactaagcatggctaagcatttcctaaatcaacatctagtcattttaaaacccaagttgccaatggcataaggaaatcaatatatggctgagtagtaggacccatcccacgtgatattgtaaaagaatgcaacatttaatagaaatgcgagatattggtaaattgggtacaatatgatcaacgtattgcatgacttgccttgctctcgcactaatgagacctcagcaacgtcttcgagaaaccgcggatcgacgaaacggccaaaatctacgcgacaaacaaagcacacaagcaaaacatgctataagactactgaaacaggaaaccaaaccatttttaatggattcttcgcatttttcttgatttactgagacttgaatggacttaaacggagctcggatgaattacttatgaattttagaagataaactgtgtttattactataaaagagaagccttgatgtatttattgcgcaataagtcccaggactgacgtcatccaaaagggggcggcgccgacatgcgggacccacgggtcagcggctcaagggggaggtcggtccaccgtggaccaagtccacggggccgagggtggtacccggcgggtggaccccaccaggcggtggctcaaaggggaggggagggaggtgccggcctggctcggctcggcttcaaagccgaccggcggccatggcaaccggcggcgacgcgcacggtcgccggcgacggcaatcggcggcgcgggaagcgacggcggacggtgtataggacggcggcgtcgaccgaaggcgacggcgagcgcatgaagagaggcggcgcaaacaagagagaggggaagagggaggagaggggatcctcaccggcgagtatggcggccggagcggaggatgaaggtggcggcgacaacccggcgatgaggaggggcggacgggcggcggcagcacctacggagggagttgtgaaggattaggagtagagagagtgaccacggcagccaccattgttggccggagacgaatgagaatggatagctcaccggcgtgcgaggagaaccgggctccggtggggttcagcggaaaccaagcggcggccgaggtggctcacgcggcggcaatgctaatggcggcggcggcttggcgcagcggcggctctagcggctgcggcgcgcgaccggaggtggcggcaagcggcggcgctagtggcgagtggcgcggcggcggtaggaggcacgggagagcgtagcgaaaaggggaaaagggagagggggatgcagggaagctttataggggctcgagaggggcggacatggccgggaaaccccccgatttggccggcgacgtgggggggagagagagagagagtggggggaattctaatcgaatcccgcccatttgcaggcgcgcgcgcgggcgagaatggcggggagggcggcgacgtggggacgcggagcgggggtgcggatgtggaggaaacgggcggcgtggggaggtgggggcgccggcggttgcagctcggctccaaccggctggaggaggaagacggggccgacaggtgggccccacctgtcggtgacccggagagaggagggagggagacgtgggtcgggcccaacaaggaggagggcagcgcgggaagagtgggccgacggcctaaaggaggaaaagaaaagaggaaaagaaaaagattttcctgggattatttattgcggtttaatgtttttaattggttaaaattatttcgagagctctgaaaattccactaaaaattttgttagcgaatttcgacatgtagaactcaagaaaaattccacatgccaattccgattattatttgcatttattaattaaggaattagctctaagttaatcaaacaatttcttcgcgcaattcatttaaccatttttttaaagcaaggaaaaagggggaaacttcagggcgtgacaatacagttgatggatgtacatgtttgttgcacaatctctgaacaaactcttcatatctagtcctgcgtaccaggcaattttacatttgcacgctttcgccgatggacagaatagaagattttcagatacacttaggtcgtacccgtcaaatgaaggtaaaaggcaacgagtaacattgttttaagtgtactattgagtagtccttcataagataacttagttgtgtttgtagcgtactatggcgtagtagacgagttagtaccatggctggcttgcattccatgtgagtccatgttagtttagttaggctccccaacgtgagtaagtgaccgaataggtttagaaatggtatatttctaggtctagctagcttgcctatgtaggttaatatgtgtgtatattatcgcacaaggtcggaaacttttttgaaattcgatactgtacttcttacaaatactacctncgtttctatgaataacacacatgctcgtttttgaccgaaggatttgagaaacaaagaataaatcttatatttagtaattggatgccccaataaagcttccacgttagttaattgatggcataatttttctaaccccttccaatgccccaggtgatgactagtaatacataaatagaatggtggatttcgtattgaaaaaacacgttgaaaatgatgccactggaaacggataccctcatctcaatcgggcggtaagccccatctcaatcgggcacagcgtccgtcacaggctagaagtcactgatgtgaagagttatctcaatcgggcaaacggccatcacgaatgaatatatctcaatcgggccctaagtaaagcccgtcacagatagctttgacccagacgaccagtcaaactatagcccgtcacagatgacctatctctatcggaccacaactagagcccgtcacagatgactactaacctttatcgggcctaaactagagcccgtcacagatgatactcatctcaatcgggcctaaactatagcccatcacagatgactactgacctcaatcgggcctaaactatagcccgtcacagatgactactgacctcaatcgggcctaaactagagcccgtcacagatgactact

SEQ ID NO: 74942 - DNA, 10786 bp, Oryza sativa
tcgctctatatatatcgctcatatatatatatggaatacatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagtacaattcatttgctcactagctagctacgactttgacgccggcattatgtcaaaagaagaaggaccgacgttatgaattgtcgatccgttgtagtagaattcaccctcgggattaaggacttcttcgttgatgaatctcatcagttgttcttgaacagccgtgatataatccttgtgtgggagattgtccctcatgtgaatacactatcattcgaaaaataatgacatatgaatatatgaaattaataaacagcaaatcgatacgcaatgaaattttgaatggtttatatatacgtataccgagctctcgtgtggtgtagatttgggttgataggaagtgggcatactcgcatacgtagtagccgcacaggttagttcccaggtcatgctttgcacactatatgagaaaggacaagagatttaatatacacttatattaactgtaactagtaatcatatataattagcatatgcatgatttaaaattgttaaaaattctaattatcatatgtaaataccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacaaaaggttcgtccgagtatcgaaccttgttaaggtcaaccgttgtcatcccactgtcatcaatcgttacgcctccaccaatcaacctaactcattggcaccggaacagaggaaccttgagaggtccatagacaagttcccatatgtcctcgatagcaccgtaatacgtgcaagttgtaccatcgtgtcccatggcatcgatacgagcagcactgttctggttcgtgctctttatgttttggtctctcgtgtagaatgtgtacccattgatctcatatccttggaatgtcgctatcgagccagatggtcccctcgccaggtaggcaagttgttggctaatcgtctcgttacccatgagatgttgtcgcagccacacgggcaatttatcaatgtgatgccgtgtaatccatgcatcggacttaccgatgtttctggcgggaactagagccaagtgctcctcgatgtaaggagccaccaatgaagattattgcagaaccgtgaaatgggctttacggaataaattgttgtataccgtcattactgcgttccttctgagagtcccctttccccgtagtttcccttcatggcgtgattcaggcaccccgattgggcgaaggtcttcgataaattctacgcagagttcaatgacctcctctgttccataccccttggcgatgcttgcctctagacgagcacggttacgaacatacttcttcaaaacgctcatgtacctctcgaaaggaaacatgttgtgtagttacacaggcccgagaataccgatctttttgacaaggtgacaaagcagatgcgtcattatattgaaaaatgaaggtggaaatatcaactcaaagctgacaagacattgcaccacatcattttgaagggcttccaatctatccggatcgatgaccttctgcgaaattgcgttcatgaaagcacattgctttgttattgttgcccggacattgtctggaaggataccctgaattataactggtagcagttgtgtcatccacacgtgtgacagtcatgagactttaggtttgtgaacttcttctccttcgtgtttattattcgctttatattcgtggaggacgtacaagaattctgaatagggtaactcccaaaatatagagttctttttccacatcaccacgtgaccatgttcgctatcaataggctggctgctaggcccctttccaaacactactttaagagctttcaccatagcaaacactattttctcactgcgatgtttaggcttcgtacggtggtccgccttatgttcaaagtgcttgcctttcttccgtacagggtggtttgcagcaaggaatcgacgatgacccatgtacacaaccttcctacagtgcttaagatatgtactttctgtttcatccatacagtgagtgcaagtcttgtaccccttgttagactgcccggataggttgctaattgtaggccagtcgttgatggttacgaatagcagcgctagtaggttaaactcctcctgtttgtcctcgtcccacacggggacaccttatttcttccacaacagtttcagatcttcgaccagtggtcttaggtacacatcgatgtcattatcaagtggcttggggccttgaataataatcggcatcattctgtacttcctcttcatgcattgccaaaattttggcaggatttcttatgtattaaccagatttggcaacaactaaacgtagatattttttggtaactttggcaaaaaatgatatggttgaaaatggcatcaaagtgaacaggccctaattaacttgttgacagctactccctccattccaaaatataaagtataaccacccttaactcaaagaccaagaaaaaattattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaatagagggagtagtacctaattaagcatgtgtgttaatttattattaactagtaatctgcccgtgctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagtgaaagtccaatttacacccaaacttcaccatacctctcatcttctcctaggaaacatctacatggggccactagacagccagtcatacatggttgagtgaagtacaagtgggatcacagcctcaaaccactgccaactcctttaaatcgtttctacccctcatgttgacaactagctctcacttttcaccttcacttttaccattcactactacaaccaagatttttgtgtgagggctaaaacgatttttgcgcgcgggtaggtggcccgcacgcacctaggggtctgggaaaatgatgatttttgcgtgcgggtggcgcactcgcacgggaaaacaaaaatccgaaataacatatatttttttaaaaaaaacgaaaccctagaatccggcggtgggcttccacccgatggccacagtgcctcctgcctcccgctggcctccgcgccacccgccatcagatccgcgctcccctccagccgcaacgccgccgacacccctcccctccgccggatctagggagggaaggaaggggagaggagcggagctggatcccgcgcggggagaaggcggccggctgccggatccgtgcggggatggccaccaccgctggattcttgcgttgacggccactgccgctggatccgtgtaggggctaccgccgcccgccagatcccacgccctccaccgccgccacatggaggaggccggcgcgctcctcccaccaccactacgccgctgctatcgccaagagtggagagaggagaggagaggcgtgagagagagagaggactgagaggagatgctctgcatggaaattttaaagtggaaaaagggatagaggggaggggagaggagagaaagaggggaaattttaaagtgggtgagagaggaaagagggagttagtatttttgcatgcagctctcttaataggtccgtacgggaaaatcgactcattttcgcgtgctgtccatttaagaggaccgcacggaaaaatcgatttttcccagaagaaatgagttaccgcacgaaaaaattgatttttccgtgccgtcctctttaatggaccgcacgcgaaaatgagctggttttcccagaagcaacgagataccgcccgcacggaatctaaaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctagagatgtccatcgagccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccagaaaacaggttttaggggttttgaaagaggaagagaggggtatgtccaattccaccataagccaaccattccatagtatccaagagatatgaatattcacaaagtctaaagttataaaaaccacctaatgttgtcctattaatcagcgaagcatctacctaaattcatactagtggaaccatgaatagagtacccactagttggggttttgtttattctagggtgaaataggtaataataacaatagcaataataatgtcttaacaaaggtaaatataaatggctaaataaaacagtgataaagcggtaatgcattaatttaaatcaaaataattttataaactgggattcaatatgctcaaggatgatgtgacttgccttgctcagagagaacggccttccgaaccttcggcgacacccgcgaaccacgcttctggaacctccggaacgatagaagctacgcgaagcacacaagcaaagctacaagcctataaagaagaaataacaatacataaaaagaaagcacacggttctttaggttataacaaacattaggagacttgaacgggtcgatttagagttcgtatgaccaagacatggtcatccgaagtttaatgctgttacatggagatttacggattattataattaggctttgcaactataaaacatgtggaagcgctagcctggaaaagacaggaaggctgcgctgttgacatgcggaccccacatgtcaacctaagggaccacagtagaccgagtacacagagacggtccacgggtcgacggaagcggaccccgtgtgccaaccgaggcgagtggccgacaaacggactccactagacaccacgcgggttgcacacgtggaaatcacgcggctaccgagcgggcacacaaacacggtcaccacacgcacccacgaacgactaccgacaccggtacacgggtaccggggtcgacaaccgcacaacgggtacggcgcgacaccaaaaggacgaggacggggaagcgagaggacggatccttaccaccacgcgacgaggcgtgggaacgacaacgacgaacgggcgcggcggagacagctcggggatgacggaggcgaacggcgagggaacgacttcggcggcgatccttggacaaggcttgacgacgcggagtcgaggacgaagacgaggacggggctgccgcggcttgcttggcggacgcggacgacggacgagaacggctcgacggagggacgaacgccacgacgaccgggaacgacgagaggacgacgatgatgaccaccggggccggtgaggaggcgacgagggcagccagagcggctgcacggagaagaggcggcgctgaacacgccgctgcgatgacgatgacggtggcggcgcagcgagccgacgagccggggaggaggaaggggcggccaaatggacgttggcgacgacgaggatggagaggccggcacgggcgacggcggtctccagacgaatcaaagagcaggccggggtggaggtcgacgcggcgacgccgaaggaggagacggcgcggccggcccgcacctgagcggcgcggcaggggcggctggaggtggtacagtggcggcaacggcactggacgacggcgggaacgcgcctccggtggtcaccgcgcgaaacggagggcaggccggtggagaggaggcggctgcgacgctggaggaggcgacggcacggccggacggcgctcgggcgaggagggagaggcggctggaggcggccggcgcgggggaaagagaagggcgacggcggggaggggtgatacgaccacggggaggctcgggatgaggctaaaacgatagaacggaggatggggattccattttataggagaggagagggagccggccacgggggaggtcggaacggaggcgggaatggcgaccggcggccatggaaagcggccggggtagacgcgtccgttcccgacgattgagggcgccattcaagggggaaattggggggaattgaagaggaatcaatggggattaaaaccccccacttaattttggaatccccggtttgaatgaggcggatttggaggagggagcgagctagggtttcacgggagagagaggagccgggcgggaggaaggagacgaccggcgcgtgggccccacgctgtcgggcgcgtggtcagcgcacgcgcggcgcgcgtgtgcacggctggctcggctcggcctggcttgggcgcggcttgggccgagcggccggcccaggaggagtggagggaggggaggcccgggagagagaggggaggggagggagctgggctgggagggggagagaagaggtgggccgggaggaggaggagaggcctgggagaggagggaaagagagggaggagagggagactttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatca

SEQ ID NO: 74943 - DNA, 26331 bp, Oryza sativa
tactgtttgacaccttttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggtcaaccgtcaaggtgaaataataagtcggcgaaaacataatcatccattagcaacagcggagatgtcagggtcgatgaagcagaggtgctggagatgatgtcagtgacaataatccatcaaattaatgttatagctgttgtagatgcttcacttggaggagagttgatgatgttgtccaactcgtccaaaccgaaatatttgaagttgttggagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcatggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataatccagacgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagtcagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtagacgcccaacaacggcggcataataggccagccgtgcaggcggaaacaccagtcggcggcggacgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaataaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagatctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattaccaaaccaggactttaggctgttccgtaatatataaggaaacgtaatacccgagccatgatctgttacatattccatagatataagttatcccctatgactagtcggataaccatgccgtatgggtatggggtacccataatatccacaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccaatgccttggcctttctcttcctgccaacatcggccggttctctcatctgtcgttgaagcagacttgaggtcttaggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatttgtcaaaattcctactcctgagtcttgccaactctatgttctcgatgctgcccagagggggtgatgtgcactagggttcccgatcttcctaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcgcccattttagtgtagactggtcctggactccgaattgcacccgacgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatacccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacagctgagcagacaacaattttagccgatgcattgttcagcatttgatacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacttgttctcgggaggtggcagttcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgataccagtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaataagatgaggcaaggaagaaccaatctattgcgaaagaagaggatctagccgatgggtacttaactctgcgtatttttccgatggcgcgacggatggactggcggaggacgacatctttgcgagcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagatgaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgttcgggcaaaagtctgccgaaaaggattatggtatctttgtcgacgggtggcacccgtagaccggatatagagggtattggggtatgttggtacaaggatctacgtaatacgacatcaagcaaataaaagacaaggattatactggttcaggccccttgacaggtaatagccctaatccagttgatatgggattatatggtggaaaacacaggttacaaagggaacaatggaacatgacggatccagcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcaggaagtatccgtatgcgcgtgggtataccataccgatatgtgacgtatatcgaagggtaaagggtatgcctaacccgtaaccctgacagtagcccccgacttctgcttaaaatgagctcgtgtaaccattcacaacttctagcgtcgagactgttgtcgttcccagtgcgaggaccgtaaagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcaccaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcatggttattcgaatagattaaactctggccagaggtgtaccactgtacccacaagacacaacctcaacatcatgtcaaccatgcgtcgcgacacttgacaagtacccgaatagagattgtgacaataccctctatacaaaacaattcaaagcaatgcaccgttcccggatcataatcacccccttataaacaaggtatggactccacagcgacccccgtgggcttatctccgccacttcacagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaaatcttctcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagatgattattacgtcagcggctagggttcacggtggaccgggtgcacggcgggggctcacgaaaacgaacggccgagatctaaccctatccaaacagacggccgagatctaatgggtctaccgcgactcacgggaagcgacgatgatgacgtcggcgatgacgtcatcaccggcgacggctcggatggtgcaagctcgccggcgaactacggcacgacggcactaacgaaaggcatctaccggttgcggacaacacggcgaactcacctgtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccccagtcatgagtgggtaagaaagctcatcatttagtccttccaagaacttctcttggcgctcttcatcagtgcgcacatcttccggagcataatgagccagacgattgaactcgtgaagatactcagtgaccgtgcgagaaccctgagtgagcgacctgaactccttcttcttgagggacaccactcccgatggtatgtgcgtcttccaaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgttgttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcggagttgattgaaggctcgttcggtgcgtccccatcgtcttgagttggtccccactcgatcttggaatgggtgcgcttggattcttcttcatcatcatcactcacattgacgaccggaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccggtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaataggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcaaaacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactctaattaataagcgaataaaatgtcattacagaggtagatagttcctctcaatcaaaagaaacagcgtaggcgattcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaaacagttaaataataattaaacaatattaatccaacgctatacaacataccctgttgcatgggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcacgactattcgaatagtttaaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccgcatcataatcacccccttataaacaaggtatggactccacagcgacccccgtgggcttatctccgccacttcatagtctggtgctctactatgaaccatactatacggaaagtaaagccgttgcccacgctggcttgtggttggcacggttaatgtttcacagccgaaaatcgtgaaccggtccttaattgtcatgagcacaaccatcaaaaccatatgctcacaacccaccattatcaggttttggttggcaagttaattaattaatcaatcatgattaaccatcatgagctatcattaagccatcattaaataatagtgaagcataagttatcccaatagtgtgctaatgtttctaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgccagcgaactacggcacgacggcgctaacgaaaggcatctacgggttgcggacaacacggcgaactcaccagtgaccaaagtagcggtggaagatcaacggacggtgacggcgacgaggttgatacggcggcgaccttcggcttgacgacgacggcgatgctccggagacctacggcagcgacggaggggcggacgaggtcagccatggcttgtgatcacgatggcgaccttcccgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcggcccaaagccagaagagaactttttaaaacctttttcaatttaaattattcatgaaatgcaattccatttattaaaaatacttccttagctcaaataaatcccagaaaaatctaggcactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgtcttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttaaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgttccgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccgaaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggcgtcaacccccttggtaagttatcctgtcgtcagatcgtacagccagaagaattacgccttacttcgcatcgaccgtttttcaggcctcggacgcgtctcccccgcctccacgacgacaacgtcttgtgacgattggcgagaagtaagtagacgaatcttaagcttccgtgattttattcgagtgttgtctgaaccgtggtcgtctcacagggcagcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctacaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgacaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgtgtcgcccgacaatgtggaccagacccttgctacggggacggagatgacgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagctgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatatagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcttggttaatacgcacggcgagaacccttacacgaccagatcttacatggtctttcgtctctacaggatctgacaaggccttatcggctctgggcgtccccagccgaagatcccttaggttcctcggaggccttgtcaagacggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgatagccgactgctcgaacggcaactcgttcgcgatgttcctcgagtagatttacatcgacgtttcgctgttcctcctagtcctcgtaggagtgcttctgtactcatgtactcggatgtcgtagctcgctggggagcatggcttcggagtcgtacacgaggaagaagggtgtttccttgttgtcagtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcggccttgatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccgatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgtcggcaacggcgcgttctgcttttgtggcctccgagctaatgtcgggggtggccgagctgacttcgccgctaacctcttttactgatggcttcgtcaggatgtccagaaaagtgccgggctcgagcggttctcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgacttcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtttgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccggaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgcgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctaatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcccttcggtcccggcatcttgagcacttgatacgcgtagtgagatgcggccatgaacttcgcaagtgcagttctcccgatgatggcgttgtaagctgtatcgaattcagcgacatcaaaggtgatctgctctgttcagaagttgttggcttggccgaaagtcacgggcaacataatcttgcccaatggtctgtatagtccgactaggtatggaatgtgatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccagacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaatgtgtttttcaatacgaatacaacaattctatgtatatattactagtcatcaacctgtgcacttgcatgggctagaaaaattacgtgacatcaattaactagcatggaagctttattggtgcctccaattactaaatataagatttttcctttctttctcaattctttcggtcaaaaacgagcatgtgtgttattcatagaaacggaggtagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggtctcacatggcatgcaagctagccatggtactaactcgtctactacgccatagtatgctacaaacacaactaagttatcttatgaaggactactcaatagtacacataaaacaatgttactcgttgctttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtaatcatttgcctggtcatcttgagcctcactgtcgactccgccaccgcagcacagtgcggctgctgcatatcc

SEQ ID NO: 74944 - DNA, 1916 bp, Oryza sativa
attaatttcaaaatattaaaccttcgaatcaaattttatcataataaatgaacctatatgaaaaggttgtcgaaaacaaagttgtataacttattgagatatacctaacttatttttcttatttatacatctgagtttgattaacctatataaaatttgaatttcaaattatgacaaccttaaataatatttttaaatactaaatgatttcaactgaaaaaatcatcaacaacaaagttgtataactcatcaatatctacaacttttgttttggttattttgctacatgactttctttcaataatttgaatatgaatttcaaattatgacaacttcaaacaatattttcaaatactaaatgatttgaactgaaaaagtcatcaataacaaagttgtataactcatcagtatctataacttttattttggtcatttcttcattcggtaaagtaatagtatcattgttcataaaatgaacttatctctcttatagtttataaactatataagagatatgtacattttgtgaacaatgttacaaatcgctttgttggatgaagaaatgacccaaataaaagttatagatcttgatgagttatagagatttgatgttgatgaacttttcagttgaaatcatctagtacttgtaaatgttggtttaagttgtcataatttgaaattcaaattcaaattattgaaacggagtcatattgcaaaatgaccaaaacaaaagttgtagatattgatgatttatataactttgttgttgatgactttttcagttaaaatcatttagtatttgaaaatgttttttttaacttgtcataatttgaaattcaaacaacatgcttgcattgcttccagtcttaatgcctatcataagaatatgttgttttgcttcaagttatggccaagttatgttaatattatcttcaataaattgttgaccatatggggcaatctatagtggattcatctgttggtctcaactatatgtatgtcgtgcatgtgtgcgctcacaagcatatttaatttgtcttgctgcttttaataaggccatagcactgtccaatgtgtcattcgatggtctctgaccttagcaatttattatgaccttagcaatttattacgacatgattaatattatttgtgtatgcatgttctttacttaatttattcttagcggatttctgatgtttttgtgaggtttagactatgggacataattaagattgtcatgccaaaaagtattgcaaaacctagaaggaaagcaaaagaggcggggggggggggggggtgggaggaaacatagtcaatttcccggctgctatcccattcctcgttttctcaggtttgggagacatatagccacactaaaggcagtaaagctgaggaatgacaaccttactcacaaggacaaatagtcgttaaaaaactatgacatcactaaccatatcttatttccgtttaccaaacatacatttaaatttaggcagttttacggataactatatcaacaaacaacaatccatacttcattgtcaaaacaaattgccttctatgtacttcacaaattctcacaagatcatatttgcaatttttcctaaactaattaaccaatatcaaattttcagtggagcattccacatataatttcacattataagtatataatacactatggtataatacacatatgcatactatggcctaccgcaaaagatgcaaagatcaatgtgcatgctaacttgtgtataatacacatattcacagtactttgaaataagcataccaggacatatgcattagttcacaccattcattcttgcattcttgcactttcaacaacaatcagatctaccaagcattcttgcacattaaaccacaagtagatctaccaataaatcacaacctta

SEQ ID NO: 74945 - DNA, 23984 bp, Oryza sativa
tattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaaaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttctgcctatatataagagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgacttcaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaatttctcttgctgcttttaataaggccatagcactatccaatgtatcatctgttggtctctgaccttagcaatttattgcaacatgattattattatttgtgtgtgcatgttctttacttaatttattcttagcggatttctgatgtttttgtgagttttagactatgggagataattaagattgtcatgccaaagagtattccgaatcctactaggaaggcatagggtggggggggaggaaacatggtcaatttctcggctgctatcacattccttgttttcttagtcttgggagacttatagccatactaaaggcaatacagtcgaggaatgacaaccttactcacaaggacaaatagtcattaaaaaattatgacagcactaaccatatctgatttcagttcacgaaacatacatttaaatttaggcagtattacggagaactaaatcgacaaacaacaaaccatatttgcaatttttcctaaactaattaaccaagagcaaatatgcaatggagaattccacatataatttcacagcataactacataatacaatatggtataatacacatatgcatactagggcctacggcaaaagaggaaaagatcaatgcgcatgctaacttgtgtataatacagatatgcgcagtactttgaaatatgcataccaggacatatgctttagttcactccattcattcttgcactcttgcacattcaacatcaatcagatctaccaagcattcttgcacattcaagcacaagcagatctaccaatgaatcactaacttatgtagcaatggggggaatcggaggagaattaaaacctttcctcgtcagacgactgaaggacaggaggcggcggaagattcactggctgcacaccatgccgcgcgaatccctgaggtgtgggcatcgcatctatcagcaccaacgacatcggcagtggcaggggtggactagggctctttcgtagaccgatgtaaactagacttattggcttcgatttagggaggggagggaaaagagatagactttacccggctggcctttgggcctgcgtggagagggataggagttggcttggtttcagccaaaagataggaagaggattttaaataggttgcatatgcatgctttgtctaaagaaaattcctaaaaataaatgaatcagcaataaatcctaccaaaattcccataaatactaaacaacaccctaagctcccagcaattttagtttgaatttatcacatcaattgataacccaaataaatccttcaacacagctaaaaatctggaaacagcataccaattagcctactttgcaccttcaccgaaattaaaccataaatcctcttgcaaaatctcaaggtcagaatgttaaacatactttactctaccatctggtgcaatggcttagtctaattcgaaatgtaaccacatgaaatgagagccataaattacgtaaactttggaacttggcaccttgaaccatcaaatccttgtctaccttgccgtctccctgtcccccacaccccccccccccttaattctaaattaaatgtatgagagaaagagagtaatatagtttggtgtgatagtgccaacacatggaaaatttagagcttctagttctctccttctacatctctcttaaatgtgggaccaaatccttgtggggcccacatatcatacaaccatagccaacacatcatctgctcttctctcatttaaattttcttttatttctcaaaaggttagagaagggtttaaattcaatttccactcaaaatgccactctaccactccaagccttttaggaaagatctatatatgggcccatttgtcgtccaaacacagcaaccaaccttggtgaatcatctctttgatcctaaattattttttcaaagagagaaagaaagagagagagggagttaaagtccaatttacacccaaacttcaccatacctctcatcttctcattggaaacatctacatgggaccactacacagccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggcgcacctccacgggaaaaaaaaacctgaaaaaacataaattttctttaaaaatgaaaccctagaatctagtggtggcgccgccactcctgcttgccgctgccgcctcctcgtcgtcgtcatcgtcgtcagcggcggcctccgcgccgctcgcctcggatccgtgctcccctctggccgcactgccgccgacgcccctcccctctgccagatctagggagggatggaatgggaggggaggggagctggatgccacgcggggggagggcgcccggctgccggatctgtgcggggacgaccgccaccactggatttttgcgttgatggccgccgccgcaggatccgtgcagggacggccgccacccgccggatcccacgcccaccaccgccaccacgtggaggaggccggcgcgcgcctacgcccaccgcagctgtcgccgcgcgccaccgccgctgccgccatcaggaggagaggagaggagagtggagagaggagaggagaggtgtgagagagagaggactgagaggagaagctctgcgtgcaaattttaaagttgaaaaggggattgaggggaggggagaggagagaaagaggggaaattttaaagtgggtcagagggaaaagagggagttagtattttgcatgcggctctcttaataggtctgcacgggaaaattggctcattttcacgtacggtccatttaagagaactgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactgtgaacctcatctatttctcatagtgttccactatgcaaaccaccaaaaactacctcggaatctccaagaacttccacttactcttttcacccgaaggagtttcatccatgtcacgtattctctggtgagcttcaccgcactccaaccacgggaacatgaagttccttctctacctaatcaatccattttctttgtttctattttggcatagatcgaacacttggtggtatgctcgtcagcgttcccggtgtccagagcgccgccatcgccccacttcgtcgttcccatcgactcgaaccatccctggctgagccattgcgccaccgacgtcgcctaggtcccaggagaaagacgccaaaatatgatcaagccaatacgccgccgcgaacgccatcggtcgccgttgccctcctattgcctctgctccccagcaaccaagtcaccgacatgtgggccccggctatttagccacttcattaggcgtaaggtctttcattactagaaatttaaatcttgtaaggttctttttgtaaaattgctttgtatgccaagtgggcctatggacctaaatgcaattcacctaatgccaatggacctttttgtatagggtttagggtaggtcctaaaccctacatagaaattactatttcatgcattcattacttgatataatagcttgataagtatgttgtactcagccttgctttaaccctctctttgagaatcaatttggagtttttgctgaaaccgtgagtttaaacatataaattagtttcattccaacttagttcccaagtatagattagatagatggtttaattctatagagtttaaacattagagttggctcatcctatagcttctacagtaatagatagccacaatcttgtaaataccctattattttatgtaaagaaatctcctttggagccttgatcaaatgtatgctatgaagattcagattgttaaacctgtatcaatctactgatccagggcttgatacagtttaaacatgtcgattaccgaatctttaattttgggacctgacaaggtgtgtgggtgggcgcctagagcggccatcccgctcccccccccccgagccggccctgactacatgggccttaacaggccacatggcatcttatcatgatttctgggcttgatggtgacgaaaatggacgtcatagactgtatgacgacagaaggatcatcactagattaatgacgaaaagataagcattctttatataacgccattagagacgcatgataggtgataatatatatatatatatatatatatatatatatatatatataggacggctctttcatacacccaggtgtatgtacacccttttattaatggatgatccattagcattcaatttagctgtgaaaaaaattaataatattaatttccaaatgactgcatgcatgtggcatagctgcacaccggattgggtgcaaatttgaacaagatcgttggcatgcatttgctttcaaatttgataacgtaccttagatatccccaccttttctagtatgcaacagtatatactgttttttaagccgcagtatatatactctttgaagcgatgagcagtactatatactagttttttgtgtattagcggtgcataataaggagtaccttacatttttgttgtagcagtgaatatttctttttttaattagcagccgtatatactgatgcggacatcactacttcggatacacacaacaatcctccaacggtcattcaaggaccgataacaagagctcgtgcgcgacaattaaatttagaggtgagttcgttcctatgttcttctttgtatgaattcgagaatagaggggaacaatggaggggacaaggagacacttggagaaggacttagagccatggaggaccattggggacgtccaagtcaaggtggaggcccaaaccaagtcgacgtctggtgcaattcggagtctaggaccagtctgcactaaaacgggcgcccaggtcgtatacgtgttcgaattggggcgttctttatatggatggaaagctaagaagataacctttccaatggttttggtcccacgtccaaattctttctgagtcaacgggaattgaccgaacaacttaacgtccagaatctgtcccggtgctgcgtcaccgtatttgggcctttggcccgtgtatcgtattggaacccattagggttgcgtcgagaggggtttgcacgaccctaaactatatatatcagtacccgccgtcatctttaggtttttgggttttgcttagattaatctgtcaagaacagtttcgccgctagattggtttgtaagaccccaactcgtgagcttaatcattcatctgcaattttggttgtttttctatcttgttcttgtttgtgttcttcgattggcaaacagggattagccttctcggcgaggtcatccgtattttgacacgggtgataacctgaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgattagttttttttttcgcaattatcctagagtctacagaaaagccaaaaaaaaattagttgttagttaccttaacctagaccgtgtttagcctttgcatgattctctctcagagtccgtagtgttgagtttgagtcctagtttaagttcatgttgctggtctagtgtgtgttttagtctagtcatgtgtttgtcctttgtaaccctagccgctacctttcaccgtgtgttaggcttcatcctttgagagccgtttccgccatcataaacacccatccagataaccaagcatctccagaacaccctacaactccgctgccaccatatcccaattccaccgcaaaatagactaggttatatcccctctggaaaacctagccggaagccgaaacttcaaacagccataacttttgcatacggactcggaatcaggaaaaatttaacttttcggataagagaaaaaattttatatccgtttatccccgcctttggctggtttggcgaatccaaaattccaaaaattggcttgcaaaattgtctgttcgagctcacaagttcctgcaccttgtttatagtggtttcagaaaaatccataggccacatacctactccaattgagctttaacttggaggtgtgcctatttttgtgttctaaaaaaagaaaaaaaatatcaaaaaaataaaagaaaaaaaagaaaagttgatttccactagtgctttgagctcacgacgcgctccgttgagcttatctgccagttcggttttgtagtttttgctgaaactcgctgaagcttgcctgtcagtccttctttgctgtttactagtgtcatattctttgagccatctttgttatcactactgtctaggacacgagtagaccagcaactaagggcaagtgacttgggatttttattcagcattactatctgtcattggattgtgtaccactcataaacatatttttggccttcctagctccacatattacttctgaacagcacaggttcttgatcactgcaattgctgactacgccttccaggtatcctttgctttgctggtaagaaccttataagaccatggttaggaactccatattgctgagaatcgttgagaggcaccactacacctgcgtagtagattattagggataaccttcaccgttttgtttctgttttggtgtttcaatgtcaggtaacgaaggcgagaagagtccccaggattttgctgactgtgtcagccaagagcaactacgaactctccaacaaaatactcaaaaggacatcacggaggctgttgcaaagtctgtccaagatgccttcactaaaatcggcttcctaaaccacatggagaggttggacaagcggatatccactctaactgatcgggtcgccgtgttggagacaccttccaatgaggaagtggtgagtggtgacgacgatgctcatcctgaagacacggtgtatgattccagtggctatattgacgcaccggctacaaggcaagcatggctacgacgtcgtctacgcacaaaccgcacaggtatgggtggcactcgccaccaacaaggtaataataatgatcgtgtgcccgatgatccttatgctaaggttaagtttaaaataccatcttttttgggatatgatgatgctaaaaaataccttgattgggagatgacagtagaacaaaagtttaatgtccaccttgtacccgagcaacatagagttagacgagccagtagtgagttcaaggattttgctattatgtggtgggctgggttatctgatgagggggtactacctactacttgggaagaacttaaggtagctatgcgcgataggtttgttcctccatcttatcatagagatttacgtaagaaactgatgcgtttggaacaaggggataaatctgtacaggattactatggtgagctacagaagggtgtgagacgctgtggtatagtggagggggtcgaggatgctatttgtcgtttctacactagtttgagggaggaaattcagaacattgttgattataaggaatttaactctgtcaaccagttgtttcgatttgctatgcttgcagagaaggaattacaggggcgcgaccatcagggcaagagcaaggcaagcacatacactctgcgcacgacgtgtcgcgaccgagaaaattgtcttttctcgaacgctagtgtattaatccccgtcccaggaaaagccggggtacaccaaacaaacatgatacaaaaggcacatctttattatatcgataatatttgcattattacaaaggcacttcaggcctgacaatcaaaaataaacagcagcggactagcgggcctacggctccatcttcacaggcgcataactgggggtataagccaggactccacctaagacttcttctgcaaagcttctcttactgaaggggggaaagattgagcaagaatgagtacaaccacagtactcagcaagccacactggagatgcataattaatgcaagggagtacaaggggataataatctaggggttaagttttgcagtaaacagcatttaaaagtcacttagttgcccaaagctattttgtaaacacgatcctagagctatataatattattaatcaaggccgtggacccacatgaacctgccttaacccaaggcctacgatgattcagaccgaactggcaacccgaccctgggtcccagctcgtcccaagccaacccaggccaaccattccacattttagttattaagcaggttttaagaatttaaaacactaacttgggtacattgctaggcttgcccataaccgagggcacggctattcgaatagattatactctgatcagaggtgtacatctttacccacaagacacgtcttcctcacgtgtaaccacgtgccacataccaccacggcatacggacggaagacgcgacatagtttccaacccatcctagccatagacaagagtaccgacccaacccacctacggccggaacccccggacaggcaggcaaaattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaggggcccgaagaccggtccttatgtggccgaggtgctactaacaaaaccatgcaccccgagcccagcctaaaaccattttgagggttttgaatagagggggaggtgtgcatccaattccacaataatccaaccattccatagtgtccaagtgatatgaatattcccaaagtctagagttataaaaccacctaatgttgcctagttaatcagcgaagcatctacctaaattcatactagtggaaccatgaatagagtacccactagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaacctccggaacgacagaagctacgcgaagcacacaagcaaagctaaaccctataaagaagcaataacaatacataaaaagaaagcacacggttctttaggttataacaaacattaggagacttgaacgggtcgattcagagttcgtatgaccaagatatgatcatccgaagtttaatgatgttatatggagatttgcggattattatcattaagctttgcaactataaaacatgtgtaagcgctagcctggaaaagacaggaaggctgcgctgttgacatgcgaaccccacatgtcaacctaagggaccacggcagaccgggtacacagagacggtccacgggtcgacggaagtggatcccgtgtgtcaaccgaggcgagtggccgacaaacggactccactaaacaccacacgggttgcacacgtggaaatcacgcggctaccgagcgggcacactaacacggtcaccacacgcacaagcgaacgactaccgacaccggtacacgggtaccggggtcgacaaccgcacaacgggtacggggcgacaccgaaaggacgaggacggggcagcgagaagacggatccttaccaccacgcgacgaggcgtgggaacgacaacgatgaacgggcgcggcgaagacagctcggggacgacggaggcgaacggcgagggaacgacttcagcggcgatccttggacgaaggcgagacgcggctggcacaaggcttgatgacgcggagccgaggacgaagacgaggacggggctgccgcggcttgcttgacggatgcggacgacggacgagaacggctcgacggagggacgaacgccacgacgaccgggaacgacgagaggacgacgacgacgacgaccggggaacgatgccacggtgtcgaaggaggagacggcggcgtcgatcggcgcaccggcgacgccactggacgccggcgggaacgtaactccgggggtctccgcgggaaacggagggcaagccggggaaggggaggtgactgcgatgccgggagaggcgacggcacggccggacggtgcgcgggtgaggtggcacaggcggctggaggcggccggcggcgtgggagagagaggagggcggcggggagaggtggtgaggccacgggagaacgcgggagggggctaaaactggagaacggatcgagggggttccattttatagcggaaggaatcgagccgagcacgggagagggcggaacggcgacgggaatggcggccggcggccatggaaagccgccggagaagacgcgggcgttcccggcgattgggggcacaatccaagggggaaattggggggaattgaagaggaatcaatgggtattaaaaccccccaattaattttggaatccatggtttgaatgaggcggatttggaggagggagcgagctagggtttcacgggagagagaggagccgggcgggaggaaggagacgaccggcgcgtgggccccacgcgggcgcgcggcgtcagcgcgcgtgcggcgcgcgtgcgcatgcggctggctcgggcagggggtggcttgggccgggcggccggcccaggaggggagacctgggagagagaggggaggggagggagctgggccgggagggggaggagaggcccgggagagagaggggaaagagagggaggagagggagactttgggctgggccgagagagagagggaggactttgggccagacttggcccaaaggaggaaggaggattattttttttagtttttctttttagtaaactttgttaattgtttttggttgcttaataattatttccggtgctctgaaaattcaagtaaaatttgagggctccttttaaaccaaggacaatttaacaaaaattctccagaccacattcgaatttttctggtacgtattttagtgtttgccaatttcttttcgaattttaattaattctattattccttttagagaatgatttttaatttcaggatgaatttatcaggacgtgacacgacgccatctgcgggactgcccaaggccgtctcttttcgggcgtcccagccagcgggcaagcgaccagcagcatccggagcttctgcggcaccaaaaccatctccaccaccacgaccagcagagtcaagtaaaggttcctcgcaggtacccgccaagagtgcctcatctgtcacctcgacgggacgcattcagtgccaccgttgccaaggatttgggcatgtgcaaaaagattgccctagtcaacgggcctatgttgctacagaagatggctacatcaccacctccgacatggaagaggaagaggaggaagaagaagttgaggacgaggatggcgaagtttttggtcgtgatgacacaacggactacagaaccatcattgtgcagcgggtgctcagcacgcaggtacagcagcatgacaggttgcaacgccataatttgttttagatttttttcgtcatcaacaactgtcgtgcacgtgtgatcattgatggatgtagctgcaacaacttggtgagttctgatttggtcaataagcttggcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtccttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttctaaggttgagggaattaagttgaagggtggtgttatgcttgcaacgaaatgtgacattggtgatatttcaaatgatgatatgtgctatttcttgatatgcaaacaagccttggtttctttagatgatattgctagttcgatacctcctgttgttactaaccttttgcaggagtatgaggatgtctttccagctgagatacccccaggattgccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaaattagaatgaaacttggagatgaatggaaaacagcttttaaaactaaatttggtttgtatgagtggttagtaatgccttttggtttgactaatgcacctagtactttcatgagcttaatgaatgaggttttaaggccttttattggacgatttgtggtagtgtactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgcttcaatatcttcgctctcaaaataatttgaatcgtagacatgcaaaatgggttgaatttattgaatcttttccttatgttatcaaacacaagaaagggaaagataatgtgattgcagatgctttgtctaggcgctatactttcttatcccaacttgaatgtcggatttttggacttgaatcaattaaagaacaatatgcacttgatcctgattttaatgaagtgatgataaattgtaaagagggacgtacttggaacaaatttgtgatcaatggtgggtttgtttatagagctaaccgtctatgcattccagttggttccgttcgtcttttgttgatacaggaagcgcatggaggagagttgatgggacattttggagctaagaagacggaagatgttttggccatgtatttgtcacatcctgatttttgtttcaggatttataaattatttaatgaattattattagaatttatattaaatgttcattaatttacaagtgaagttaaatgtgggaaataaaattttctaaatataaagcatggatggatttaattttttattaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccgcctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttagttgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaactactccactgttttacttctcttaaaagttttgctaaatgctgcttttgcaaatgagcctatattatgccatcctttggtatccttgtgcacttgcatatttgctatgtggcttgttgagtatgtcatatgctcaccttgcaataatcaatcaacctcagttgaagaaaaaggatccagaaggagaagacgtttggcttatacccgagttgagctgcctgtgggagtggagccggagattcgctagattttattttccgctgcagttttcttcatggtgaggactaagtgcctcttaagtaagtatttagcgttttagttaatttgatgaatctgtatattaaattgtcagtttgtgtacctcggctgatttctggacgaggattttatgcacaaataagttcggaaattactagtgaatttctgggcgtgacatatttcttttggccaaggatgagaaaggatgttgacaggttcatggcacgttgcaccacttgtcagaaagctaagtctcatttgaatccacatggtttgtatatgcctcttcctgtaccttctattccttgggcagatatttctatggactttgttttgggattgtctagaactaagagggggagggatagtatttttgtagtggtggatcatttttctaagatggcacatttcataccatgtcataaaagtgatgatgctgttcatattgctgatctatttttccatgagattgttcgcttgcatggtatgccttctattgtttcagatcgtgatgcaaaattcttaagtcatttctggcgcacgctatggaacaagttgggtacaaagctattgttttctacaacatgtcacccacaaacagatggacaaacggaggtagtcaaccgcactttaggtaccatgttgagggctattttgaagaaaaatttgaagatgtgggaagaatgtttgcctcatatggagtttgcatacaatcgggcaacacattctactaccaaggtaagttcttttcaggtagtgtatggtttcaaccctcgtgctccaattgatatgttgcctttacctactagtgagagggttcataatgatgctaaggcacgcgctgaatttattttgaaaatgcatgagtcaaccaagttcaacattgaaaagatgactgaaaagtatagaattgctggtagtaaaagtaggcaagaggttaagcttgaaccgggtgatttagtttggttgcacttgagaaatgatagatttccggaattgagaaagtctaagttgatgcctcgtgctgatggcccttttaaaattgttgagaagattaatgataatgcatataaacttgagttgcctcccgagtttggggttagtcccacgtttaacatttcagatttgaagccatacttgggagaagagtatgagcttgagtcgaggacgacatcaattcaagagggggaggatgatgcggacatcactacctcggatacacacaacaatcctccaatggtcattcaaggaccgataacaagagctcgtgcgcgacaattaaatttagaggtgagttcgttcctatgttcttctttgtatgaattcgagaatagattgcaacctaatgattatattgtgcttaggaacaatggaggggacaaagagacacttggagaaggacttagagtcatggaggaccatcggggacgtccaagtcaaggtggaggcccaaaccaagtcgacgtcgggtgcaattcggagtccaggaccagtctgcactaaaacgggcgcccaggtcgcatacgtgctcagattggggcgttctttatatggatggaaagctaagaaggtaacctttcaaatggttttgctcccacatccaaattctttccgagtcaacaggaattgaccgaacaatttgacgtccaaaatctgtcccagtgctgcgtcaccgtatttgggcctttggcccgtgtatcgtgttggaacccattagggttgcatcgagaggggtttgcacgaccctaaactctatatatcagtacccgccatcatgtttaggtttttgggttttgcttagattaatctgtcgagaacagtttcgccgctagttcggtttgtaagaccccaactcgtgagcttaatcattcatctgcaattttggttgtttttctatctcgttcttctttgtgttcttcgattggcaaacagggattagccttctcggtgtggtcattcgcgtttcgacacgggtgataaccagaggagacgtggtgctgcaattgcggggctcaagagcgtgcgcgttcaagaagccggatcgatttgtgtggcgactccgcccaaatcgttgtttatcagaaccttttggaagatcgggaaccctagtgcacatcatatacttactccagaactaacgagtatatatatatactgattatgtctttttattggtacgcgcagtatatactactgcaacgagcgaatgagtatatactgttctttcacggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttcttttttttatcagtatatgcatttgttattatttgagtatatattgtatgcactacttgttctgtcagtatactgcatgtactaattgtcatgtttggtcggtatactgcatcgtcctcgctaaaggaggttatactgccttcttgtttgatcggtatatactatgtatactactttttttcactcagtatataaataagtatgtaccagtatttcttagataagtcgtatatttgctatccatggaagctggatgcatatgcttttcagttgaatagaataattaatatgcttttcacgtgcaaattcagatgtatgcctgaatcactggcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgctgaccgcacgccggagagaggtggacaagaatgtgtcttcctggattaacaccattagctaggaatcacggttcaatgccgacgacaatgctgtcgccgcacggccacacatgctgggctgttctgtcatcagcaccatctacgtccacgatacatgcatctcgcatttgcatgcaccaaacaaattcgatctgcatgcatgcattatcgatttgcaacgtagaaaaagcaaatcaagaaaatcggaagaaggaaggacttgcctgcagtatagtcgatgttccagttccggacgacgctcaacgtcgtcttgatcgtagcatgggcctgcatcgatgccgtcgccgcacggccacactgacttgcccgaagatcaacggcgtcgttgtctggtcatagctcttcggccagccagtcgcctgcggatagtcataccgaaggcattggtaatggaagacgccggcgtagacatcagcagatgccacgaccttcgaatagccgatgggtcgcgccgccgtcgccttcgaatcgctgatcgagataacctgcggatcgatctatcgattctgtttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggtgagactattctataccccccctccccctcaagagcccaacccactaccccctccttttattgggctcaaaacccacctcctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaacacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactgcatggcagatacacgttaccacaagtgtatgcagtaacactattcaagaattgcagtaagatgctttgttactgcaaaacttataaaatttaccacactttcataacaatgttatgatgggattgtagtaatgtacaatagatagtaacaacacttgtggagagttaaattttaaaagaccaatctttgaaggttctctctacccttgctgtcgcgaccgagaaaattgccttttcccgaacgctagtgtattaatccccgtcccaggaaaagccggggtacaccacacaaacatgatataaaagacacatctttattatatcgataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaaggggggaaagactgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctaaagctacacagtattactaatcaaggccgtgaacccacacgaacctgccttaacccaaggcctacgatgatt

SEQ ID NO: 74946 - DNA, 27084 bp, Oryza sativa
ataggggctcgagaggggcggacatggccgggaaaccccccgatttggccggcgacgtgggggggagagagagagagagtggggggaattctaatcgaatcccgcccatttgcaggcgcgcgcgcgggcgagaatggcggggagggcggcgacgtggggacgcggagcgggggtgcggatgtggaggaaacgggcggcgtggggaggtgggggcgccggcggttgcagctcggctccaaccggctggaggaggaagacggggccgacaggtgggccccacctgtcggtgacccggagagaggagggagggagacgtgggtcgggcccaacaaggaggagggcagcgcgggaagagtgggccgacggcctaaaggaggaaaagaaaagaggaaaagaaaaagattttcctgggattatttattgcggtttaatgtttttaattggttaaaattatttcgagagctctgaaaattccactaaaaattttgttagcgaatttcgacatgtagaactcaagaaaaattccacatgccaattccgattattatttgcatttattaattaaggaattagctctaagttaatcaaacaatttcttcgcgcaattcatttaaccatttttttaaagcaaggaaaaagggggaaacttcagggcgtgacaatacagttgatggatgtacatgtttgttgcacaatctctgaacaaactcttcatatctagtcctgcgtaccaggcaattttacatttgcacgctttcgccgatggacagaatagaagattttcagatacacttaggtcgtacccgtcaaatgaaggtaaaaggcaacgagtaacattgttttaagtgtactattgagtagtccttcataagataacttagttgtgtttgtagcgtactatggcgtagtagacgagttagtaccatggctggcttgcattccatgtgagtccatgttagtttagttaggctccccaacgtgagtaagtgaccgaataggtttagaaatggtatatttctaggtctagctagcttgcctatgtaggttaatatgtgtgtatattatcgcacaaggtcggaacttttttgaaattcgatactgtacttcttacaaatactacctccgtttctatgaataacacacatgctcgtttttgaccgaaagaattgagaaacaaagaaaaaatcttatatttagtaattggaggcaccaataaagcttccacgctagttaattgatgtcacgtaatttttctagcccatgcaagtgcacaggttgatgactaataatatatacatagaattattgtattcatattgaaaaacacgttgaaatgatgctaattttctatcaaatatctttgtaaattaaaactaattcttggtcaaagataaatcttaaaatacatgcgtgccatatttattggaatggatggggttatgttggtgctaatgaatcttattgttatcgaactaccgctcgatgcccttgtacatactgtacagtgcaagaagcgtgtagcatgagagcctttaatgtgttgtcaagtcccgatcctgcatgatgtctatttgggaggagcaatatgtacatatgcatgcatcacacttcagcatttttgtctttttaccttggagttttaagaatgctcacacttagggcatgcaagttgatccattggtatattcacaatattcgcaacgccatgatgaaggctatgaaaatgacaatgatacatgattggtaacataactatcaacatttcagagcaaaatatggagcatttaggccaatcaaactttcaattttcttcgattgctgctcccttgatgcctcagattcatctatcactttcttgaaggaatccaactcttgcaacaacagcagttttgtcgcttctattggggcggctgagtcaaggccggcatagaaaaatttaagagtaggtatggccataacaaaatcgtctagcttagatatagcataaatggtgaaagataggcatagaaaaattcatgagttaggtatatgtatatttggcataatcatgatgagacagcaaaaatcataaattagctatttacccacgggtacatgacatagcacatagcaagactagtgagatataggcatcacagatttgttggagctagacatatagctagttgaggaattttggaatagcaaaattcatgggtctacttctatcaaaacccactcccctccacagcaaaacaaactaacatttgcgccctaaccatgtacatttgctcccaaatccatctccaaacaaacagaacaaactaacatctatcctaactatgtatacccagtaatagtactcgccatatctattcacatgcagagatcgccatatctattcacaagcagagaacacatatatagcacactcatcctctgtgaacactgcacatccgttttaaattttattaccgttccactgctgcagttcagctagcaagcacacactgttcgaagatctcaaggagagtccagtcgtggtcgagatgccctgcgcgtggcgttttaaattttattactgctccactccactccgcatttccactacatgggtccatttattgcgactttttaagctcatctccctccatcgaggagagcctgcccatcaagtcgtcaactcttcttcttttttttatagaaaaaacaaaactgtcaatatttcagtgctccacgcataaaaaagaagaaaacatttcacagctccagtttttctatggttcgaggtgtcaaacgtcgaatatttcactacgacagaaactaaaattggagacatcactacaaacgtacacactcatgctcgtccggtgtatataaggcgcaccccctcagttctactataaatgtacgcactcttgctcgtcgttgcaccgcacaagtacatagagcacttgcatgtgtataataggtcagggggaactggacaatatgcaaataatctctctggaggattcatcaagatcaatgctttgctttgcttgcccggtctcctagctagctaacagtctccatttgattgatgcttttatactaattaactaccgctactaatgctcttataccaattaagtatatgtgtatcaacatagttaattaattcaccttggagactcttgcttatgggtggtttatatatatgtgtctcatgagatgatcaaaactgtgaaggcagattgatgtttatttatccttctggctaatatgttatggccgattgagaggcacagttggagaagattacctaccacaatcctctcatcttgcgatttttgtccgttctcgtaggccaattagggatgcaaggaatcggggacttaatctaattaattaatgaaatggcaggacagtagtagacccttgctaatcccggccctctggccaattattcattgataattttgatattgacacaatccctaaaatttaactttgagacctgatcgagtgtcatgatcattgtattgtggaagtgttttagacaaatctactagcactattatatttttcacatatttccatcttcacatgtatgctcgtgtatatatatatatatatacacaacaaattaaaatgaatatttgcctgtggttaattagcacctcaactctcatggttcattttctcgcttgagataaaaattgggaataaattaaccgatattttccataccaaaattaagctaatatcgtcaacaatttttaaaatgaaaaaaatcatcaaatattgcgaatatactaatggatcaacttgcatgccctaattatgagcattcttaaaactgcaaggaaaaaaaagacgaaaacgctgaggtgtgatgcatgcatatgtacatattgctcctctcaaatggccgggagtattaatttagaaccgaaagatatcatttttgtcagtctcgtatttttcatgtaaatccgacacgcgattacggttggtgaattgaacttggtcatctggagcacttttcaaaaagtttcatttctgtacagactctaaaaaaactagttggcaagtgaaattctttagtttcactattatgaaaaggattattcctactgcacctacatccgaccacatcaagcagcatggtccagaccacgttgagcacatttgatcctaacgtatataggtccgataaagggaagcagcatggtcgacgatgtgccagactctaaaaaaaacctagttggcaagttgaattcttttatcttctctaccccggaaaatataaaaactcatgcagacagtacgaatccacacagcatgcacaatacttttgtaacaaggcatattccatcggtttctctctctgacaaaggcatgcatgctagtagtttggaataaaaaaaactaaggataaattaacactaccaaagtagttaatagtaaattcacacatgcttaattaattaggtactagctggcaacaagttaattaattaaatcagctccgtgaatgcagcctctgactcatccacaaaattcgcatgcatgtcgacgtggccggacagcatccaagaagcagatcatttgaacaaatccaagtagcttagtccatgttgcatatgatcaccagaaacccaagtggatcgccgatcaattagctctgtgtgttgtatgtctcaaactgtctctctaatagccaaacaagccatcactacaatagatcttattataggtgacgctcatttacgtcataaaaattgaatttcaagtcatgttgtgaaatctgtgatattcgtgtgacgaatatcattcgttacctattatgcgtcactaatggcattctataaagaaagcttatctttttgttactaatctagtgacgatccttctgtcgtcatagagtctatgacgtccattttcgtcgccattaagcccagaaatcatcataagatgccatgtggccttttacggcccgtgtagtcagggccagcttaggggggggggagcggtacagccgcactaggctcccaaatcgcaggggcccccacccacacagcttgtcgggtcccaaaattaaagattcggtaacctaaatgtttaaactatatgaacccctggatcagtagattgatacatgttcaacaatctgaatcttcatcgcatacatttgattaaggctccaatggagatttctttacataaaataatagggtatttacaagattgtggctaactattaccgtagaagccataggatgagccaactctaatgttttgctatagaattaaaccatctatataatctatacttgggaactaagttggaatgaaaccaatttatatgattaaactcctggcttcggcaaaaactccaaattgattctgaaagagggggttaaagcaagggtgagtacgatatactcatcaagctattatatcaagtaataaatccatgaaatagtaatttctgagtagggtttagggcttaccctaaaccatatacaaaaaggtcactgggtattaggtgaattgcgtttagaaccatatgcccacatggcatacaaagcaattttaaaaaaagaaccttacaaaatttaaatttctactaattaaagtccttagcgcctaatgaagtggctaaacacccgggctcacttacggtgactcaacggctggagaagcagaggcaacaaaagggcaatggcgaccgacggcgtttgcggcggcgtattggcatgatcatatttgggtgtctttctgctaggaccttggcgacgtcggtggctcaatgattcggccggagatggtttgagtcgattggaacgacgatgtggggcgatggcggtgctctggacaccgggaacgccgacgagtgcaccaccaagtattcaatctatgccaaaacggaaacaaagaaaatggatcgatcaggtagagaaggaacttctcgaatcactaatatagaaacgattttcctggacagggacccttttatatttcgtgcgggcggtaactcgttgcttctaggaaaatcggctcattttcgcgtgcggttcaattaagaggacggcatggaaaaatctatttttccatgcggtcctcttaaatggactgtatgcgaaaatgagccgatcttcccatgcggacctattgagagagccgcatgcaaaaatactaattcctctttcccctctcaccaactttaaaattttcctctttctctcctctcccctcccctctatccctttttccactttaaaatttccacgtagagcttctcctcagtcctctctctctcacgcatctcctctcctctctctccactctcccctcctctcctctccttccaacggcggcagcgccgtcagcgcgcggtgacagcagcggtgcggcggcggtgggagtaagcgcgcgccggcctcctccacgtggcggcggtggagggcgtgggacctagcgggcggcggccgtccctacgcagatccagcagtggcggccgtcaacgcaagaatccagcggtggcggccgtccacgcacggatccggtggcggccgtccccgcgcgagatccagctcccctcccctccccttcctttcgtgcctagatctggcggaggggaggggcgtcggcggctgtgcggccggaggggagtgcggatctgacggcgggtggcgcggaggccggcgggaggcaggctgcactatggcaggcgggcggcgggcgaaagcctaccgccggattctagggtttcgtttttttaaaaaaaattatgttttttcggatttttgtgttcccgtgggttgcgccacccgcacacaaaaatcgtcatgttcccagacccctaggtgcgtgcaggccgcctacccgcacgcaaaaatcgttttagccctcacacaaaaatcttggttgtagtagtgaatggtgaaagtaaaggtggaaagtgagagctagttgtcaacatgaggggtagaaacgatttaaaggagttggcagtggtttgagcctgtgatcccacttgtacttcactcaaccaagtatgagtggctgtctagtggccccatgttgatgtttcctaggagaagatgagaggtatggtgaagtttgggtgtaaattggactttaactccctctctctgtttctttgtctctttgaaaatataatttaggatcaaagagatgattcaccaaggttgtttgcaggtatttggacgacaaataggcccatatatagatgattcactatgttgtgaactctgtgacattcgtgtgacgaatatcattcgttacctatcatgcatctctaatggcattctataaagaaagcttatctttttgttactaatctatgacgtccattttcgtcgccatcaagcccagaaatcgtcataagatgccatgtggcctttcaaggcccatgtattcagggcaagcttggggggggagcggtacagccgctctaggctcccaaatcgcaggggcccccacccacacaccttgtcgggtcccaaaattaaagattgggtaacctacatgtttaaactatatcaatgtcacaccctgaaaatcgcctaatttaataattcagtttttaatgcatttttagaaattattttaaaaacctacaagctaaactcctataatctaggaaaaatttcaacataaaattgaactagataaaattttattaaatactttgcttgtttatctattttctagatttttctgggaattatttgagcaagggaagtatttttaataaatgaaacatcatttcacgaattattttaattgaaaaagtctttaaaatcctcccctaggccgtttggccgtttccagcccaacatccttctccctcgcacgtggccgtgcagcccacgccgtgccaatccaagccgagccgcccctcgtctcctctagtcgtcgacatgtggggcccacatgtcggggtcatcccgtacctcgggccgggccgagccgagcccgagcgccgccgcctctcctccgattcctcctcaaccggtcgtccccgagtctgattgcttaaggggaaatcatctcctccttatcctctccctttcccctagagtttcggaggtcaattttgcccgaataaaccaaatcgaattcgttttgagtttatctctccaaactaaccctagtttttcccagctcgattcctctcggttggagtccgatctctctaatccaagcctatataaagcatcccctagtcgtcctcttccgtttgccccaagtcccgcgtctcaccgttgctcgtagcgccgccgctgcgtagctcaagccgccgccgtcgccggcgactctccagtgacgtcgcgcggctgctagcgtcgtcgccgtcgctgtccgtcgccgccgccgggttcgcacggtggaggagtaccttggccgccccttcgccgtcgtcgcaagccgctggaacgccgccgccgtcgtcgagctgagccgcgccgccgttggtcctcgtcgccggtcgccgtacgtcgtcgtccgtcatagtttcttgcaccggtgagttcgcgtcgtcgtcctcttcacgtaggtgtcctcggatagcccaaccgagctctctatcgccggtggtcgcgtggagccgtgccatggccggcgatgatgtcatcgatgacgtcataaatcctttttattagttgaaaatcgattaaacttcggaaattcataactaaatcatcgtaactcgtattcgagtggttcaagttgctaaattcatctaaaatcaagatctacatgttaaaaatatccacatgtactgtttattcttgtttttgtactgttttgttgattttgtttatttgctttagtttccgatgttccggaggagagcgtttacgttgaggaaggttcagaagtgtttgaagaagctcaaggcaagtcacacagatccgaaacaaccctttgagcatgttgaacccgtttaaagctaatattttatttcaacttatgcattattttcgaatgtcgtcgggtggtgagcctttcccagttaattaatggccgacaatgactttattttcctatgggtaataaattgaatagctttgaccttatatattggtttgctccagctaagtgctatataggtataattgcttagccatgcttagaaacattagctcattaatggggttaatcatattacgatattagttatggttatatttagtggtagctcacgatagttaattgtgttatgataattaattgatacataaacctgattaaaggtgggttgtgagtatatggttttgatggtcgtgcttacaacaattaaggaccggttcacgagctactgttgtgaaacatttaccgtgccaaccacaagccagcgtgggcaacggctttaccttttgtatagcatgattcattatggggtgccagactgtgaagcggcgagaagtccgtgggggtcgctggggagtccattgcctctggttatgagggggagattatgatccaggaacggtgcactgtggtgagttgtgttgtgtgagaggtattgtcacagttcgtttccaaggtaccgtggtggtactgaggcgcatggtgacatgtggagttgtgtcttgtgggtacagtggtacatctctgatcagagtaaaactattcgaatagccgtgcccgcggttatgggtgggtctaacaatgtttttcgtaccaccataaatgaaaatactatgataactaaattgactcctggtttggaatggtatattcctggtttggaggtttgatttgtacaaccaggggttggttgttcagataaggttgggcctatgcaacatgggtgtgttgtatagtgtttatttaatattgcttaattacttaactgttttgctattctctcaaatgtttattaaatgttgtttatgcgaatgagcttaattatgccatcctttgttatcctgtgcatttgcatatttgctgtgtggcttgttgagtatgtcatatgctcattcttgcaatattcattctttagaggaggagtgcttcagtgaaggtgatgatcaggaggattaggctttgttcaggtcgagttgcttgtgaagtggagtcgccatagatgtttagtcttttgctttttttccgcggcgtagaactttattctttgagaggaactatccacctctgtaataatttactttgcgcatattaattagttatttgatagtactctattatcaatttgttattatgtgcctcggctgattcctagacgagggtttaacgcacatgtaagcgtttggaattttggatagaaattccggacgtgacaagttggtatcagagccaccttgaccttaggacaagccaaatggtaaaccttaagttgccttctaattattttggaaaatagaactgcccttctctattctcttataaattaattaagttggcagcacatgcaaggttatgtacaaaatttattaaattctactttaccaaaacagaaatttgttcttttattttgaaagaaaaaaaactttactgttcagggtattaaatagtttaattttctgaatttcattggttagtcggcactgtacatctattatggtatcgattcaatcaagatggcatcagtactactcatccctgttaatggtgacactgtaccgtgctcctggtagatcctaaatattttagttttaatttattcatttgtgtaaagttatttgtctctgttcaaggttgatttatgttccaaaaagaaaaaaaattgagtcatgtttgttccttttcttttattttctttttctttgggtccaatttaattaagtctagtttgtgcagctaacttaaaaatatgcattaattccttcctttccatgttgctttagatgcccatccgccgaaaaacttgatcgaggtgctaggattcgtcagggagctgagaatgatggcatttgaagtaggttacgaggttgcccccgagtatcgccagattccccatgaccccaacgaggagaagtgtcgtgttcgcgtgacgttgactagtgatcgtgaagaccttccgtcgataaagtttgaagctgagggaaaaaagtacagccatgtttgtcaggaaacagccttggtggccattggagagctacgtcatcgctttgatgaggagttagagtcatcagctttccagtatcacccacacaagccacatggtcaagactatagaacttacaactgtcccgaaggtgaaggtagcgccactgtgatgcacgccgtgtatatgcttagcgccatggatgcagtaggcgtggagcgagagaaagcagctcatgatagggaaaactggaaccgtggcaggatttgtaagttggagagcaaggtgtaccgtctgcagaaggaactagctgagcttaagggagaagcaccaccgccagcacccaagcttcgcctcaccgcaaggaagagaaccagtctaccacctcgtctccagttagcttcgaagactcgtgtggtgggagacgctgtgcctgatcatgctgaacctgtcatccatgtcttaagtgatgaggaagaagaggaagacccaaaagaaagagagccagctactccagaggaggaagatccatctcttcgttccgacgcaaggcgagagtagttgtctagttagaccgttgccgtagttcgctgtgttagtttgcttgcttaagattgcttgtgcgtgtgtgggtttagcatgttgcttacatcattggtgggatgtaactacataagtttagttcttttgcttgtcagagagtaagttagctggtgagatagtgttaattcaatttaaatgtaatcatacacaattaagagcaatatagaatttaaattaactaaagttctccgttctaagggtatctctctgtcattctttcattttgcccatgcttttcttcagatggtgaacacccgcactggaagtgaaagtggaagtggaaatggtcacaatgaaggagatcccacacttgcccaagttttggcccagcaaacccagttgattaatctattagtgcagcaagcgcagaaccagcaggcaaataacaacaatcaaccaccacctccgcagaacaagttggcagattttctacgtgtgagaccacctaccttctcaagcaccactaacccagtagaggcaggtgattggctgcatgctgtgggaaagaagttagatttgtttcagtacaccgagcaggagaaggtttcctttgcttcacatcagttgcatggtcctgctgctgagcggtgtgaccactttcttctaaacagagccgagggacagcctatcacttggcgggagtttactgctgctttcaagaagacacacataccatcaagtgttgtggcccttaagaagagagagttcagagcactcaactagggatcccgttctgtcagagagtacctccatgactttaatcgcttagctcgttatgccccagaagatgttcgcactgatgaagaacgtcaggagatgtttttagagggactgaatgatgagttgtcttttgcattgatggctatggattaccgggatttccagtagttggtggacaaggcgattcgccaagaagacaagtataataggatggaacagaaaaagcgtagtagccagaggccgcgcattgctttgggacctcaagctgcaccatacccacagggaggatcctcttcagttgctcgccctcaacgccagttctacaacaacaacactagtaatcacagcaacgataatcgtaatatggtcactcgtcatgtagcagctccaactcagaatcatcctgtcaggaaggaacagggaagcaagccaggggtgtgcttcaattgtggtgatccaggacattatgctgataagtgtccaatgcctcggcgtgtgaagaatgcacctgttcagaacaactccaatgctccagcaccgaaggctcgtgttaatcatgttgcagccgcagaagcccagaatgcacctgatgtggttttgggtacgtttcctattaactctatacccgcaactgtgttttttgattccggtgctacacattcctttttgtctaaaagttttgcgggcaatcatgggatggaagttattagtcttgggagacctttactagttaataccctaggcaatcaagtatcctcaacgcagtactgtccttccgttactatagaaatagaagaaatacctttcccatcctcacttatctttctagaatccaatgatcttgatgttatcttagggatggactggctaacccatcacataggagttatagattgtgctaaccgtaatgtgactttaacaagtagcaatgggcaaacagtgtctttctttgtgtcatcccctaaatctcacggtttgacattaaatcaagttgctttgcaagagatcccaatagtacgagactatccagatgtgttccctgaggatttgccaggtatgccacctaagagagacatagagttctggatagacttagtacctggaaccaaccctatccataagagaccatacagaatggcagctaatgagttagcagaggtaaagagacaggtggatgatttgcttcaggaaggatatatcagacccagtacttcaccgtggggagcaccagttatcttcgtggagaagaaagatcatacccaaagaatgtgtgtggattatcgagcgttgaatgaggtcactatcaagaataagtatcctctacctaggattgatgacttgtttgatcaactggaaggtgctacagttttctccaagatagatcttcgttccggatatcaccaacttcgaatccgtgaggaggtatacctaagaccgcttttacaacacggtttggtttgctcgagtgtaccgttatgtcgtttggactcactaatgccccggcctttttcatgaacttgatgaaccaagtgtttatggaatatctggataagtttgtcgtggtgtttattgatgatatccttatctactccaagaataaagaagagcatgaagagcatcttcgtcttgctttagagaaactacatgagcatcagctctatgccaagtttagtaaatgcgaattttggttgcccgaagtgaagttccttggtcatgtcatctcaactggaggagttgccgtggatccaagcaatgtggagtcagtgctaaattggaagcaacccaagacggtttcagagattcgtagtttccttggtcttgcggggtactaccgcaggtttattgagaacttctcaaagattgctagaccaatgactcgactgcttcagaaggatgtgaagtataagtggacggaagagtgtgaacagagtttccaagaattgaagaaaaggctagcggctgcgccagtgttagtcttgcctgatccaaggaaaggttttcaggtgtattgtgatgcttctagacatggtttggggttgtgttttgatgcaagatgggaaggtgattgcctatgcatctagacagttacgcccccacgagaataactatccaacacatgacctagagttggcatctgtagttcatgcattgaagatttggcgtcattacctttttggtaaccgtacggagatgtatacggatcacaaaagtttgaagtacattttcactcaacctgatttgaacatgcgtcaacgacggtggttagagttgatcaaggattatcatccaggtaaagcaaatgttgtagcagatgctctcagcaagaaaagctactgtaagatgttagaaggtcgacacctaccttgggagttatgtgaggaatttgaaaagttgaacttgggaatagtcaacaaagttttgtgccgctttagaagctcagcctactctttttgatcaagttagagaggctcaaatgaatgatcctgatatccaagaaatcaaaaagaacatgagaagaggtaaagccatcggctatatagaggatgagcaaggaactgtgtggctaggagaaagaaattgcgtgcccgataataaggagctaaaggatactatcatgaaagaagcccatgaaactttgtattccattcatcccgggagcactaagatgtatcaagacctgaagcaacaattctagtggccagcatgcgacgagagatagcagaatatgtggctctatgcgatgtgtgtcagcgagtcaaggcggagcatcagaagccagccggtctgctgcaaccgttgaagattccagagtggaaatgggaggaaataggaatggattttatcaccggtctacccagaacatcggtaggacatgattctatttgggtagtggttgacaggcgtactaaagttgctcatttcatacccgtcaaaacaacctacatgggaaataagctcgcagagctatatatggcaagagttgtatgtttacatggcgttcccaagaaaatagtgttagacagaggtagtcagtttacttcgaagttttggcagaacttacaagaagggatgggtactcgtttgaatttcagtgctgcctatcaccctcaaactgacggtcagacaaaaagagtaaattaaattctagaagacatgttgagagcctgtgttctagatgtcggtggaagttgggataagaatctgtcgtatgctgaattctcgtataacaacagttatcaagctagtcttcaaatggctccatacaaagcattgtatggtcgtaagtgccgtacaccgctcctttgggatcaaactggtgagcgtcaagtttttgggacagatgtattgcgagaggcagaagaaaaagtgaagattatccaagaaaggttgcgagttgctcagtcgcgtcaaaagagctatgcagacaatcgtcgtagggatttgactttcgaagaaggggattatgtatacctacgggttacgccgctgcggggagttcatcgttttcagaccaaagagaaattggcaccgcgttttgtgggaccttttaagattgtgagtcggagaggtgaagtagcttatcaagtagagttgcctctgtcaatggagggaatacatgatcgtttcccatgtgtcgcagttgaagaaatgtttgagtgtacctaccgaggaagcagatcctgagcgtttagagattcaagaagatttaacttatgttgagaagccagtcagaattttggaggtgagtgagagaaacacccagaatcgcgtcatacggttctgtaagttttagtggagcaatcattcagaagaagaagccacttgggagcgggaggatgaattgaagtcagctcatcctcatctttttgccagttcttctgaatctcgaggacgagattccgtttaaggggggtaggtttgtcacgccctgaaaatcgcctaatttaataattcaatttttaatgcatttttagaaattattttaaaaacctacaagttaaactctaataatctaggaaaaatttcaacacaaaattgagctagataaaattttattaaatactttgcttgcttatctattttctagatttttctgggaattatttgagcaagggaagtatttttaataaatgaaacatcatttcacgaattattttaattgaaaaagtctttaaaatcctcccctaggctgtttccggcccaacatccctgtccctcgcgcgcggccgtgcagccacgccggcccaatccaagcctagccgtccctcctctcctctagccgccgacatatggggcccacatgtcagggtcatcccctacctccggccgggccgagccgagcccgagcaccgccgtctctcctccgattcaacctcaaccggtcgcccccgagtccggttgcttgaggggaaatcatctcctccttatcctctccctttcccctagagtttcggagatcaattttgcccagataaaccaaatcgaattcgttttgagtttatctctcctaactaaccctagtttttcccggctcgattcctctcggttggagtccgatctctctaatccaagcctatataaagcatcccctagtcgtcctcttccgtttgccccaagtcccgagtcccgccgttgttcgtagcggcgccgccgtcgccggcgactctccagtcgcgccgcgccaccgctagcgtcgccgccgtcgctgtccgtcgccgccgccgggtttgcacggtggaggagtacctcggctgccccttcgccgtcgtcgcaagccgctggaacgccgccgccgtcgtcgagtcgagccgcgccgccgtttgtcctcatcgccggtcgccgtacgtcgttgtccggcgtagtttcttgcaccggtgagttcgtgtcgtcgtcctcttcgcgtaggtgtccttggatagcccaaccgagctctctatcgctagtggtcgcgtggagccgtgccatggccagcgatgttgtcatcgatgatgtcataaatcctttttattagttttttctattagttaaaaatcgattaaacttcggaaattcataactaaatcatcgtaactcaaattcaagtggttcaagttgctaaattcatctaaaatcaagatctacatgttaaaaatatccacatgtactgtttatgcttgtttttgtactgttttgttgatttggtttatttgctttagtttccgacattccggaggagagcgtttacgctgaggaaggttcagaagtgtttgaagaagctcaaggcaagtcacacagatcccaaacagcgcttttagcatgttgaacatgtttaaagctaatgttttatttcaacttatgcattattttcgaatgtcgtcgggtggtgagcctttcccagttatttaatggccgacaatgactttattttcctatgggtaataaattgaatagcttggaccttatatattggtttggttcagctaagtgctatataggtataattgcttagccatgcttagaaacattagctcatcaatggggttaatcatattacgatattacttatggttatatttagtggtagcttacgatggttaatcgtgttatgataattaattgatacataaacctgatgaaaggtgggttgtgagtacatggttttgatggtcgtgctcataacaattaaggactggttgacgagctactgttgtgaaacatttaccgtgccaaccacaagccagcgtgagcaacggctttaccttttgtatagcatgattcattacggggtgccagactgtgaagcagcgagaagtccgtgggggtcgctggggagttcgttgcctctggttatgagggggagattatgatccacgaacggtgcactgtggtgagttgtgttgtatgagaggtattgtcacagttcttttccaaggtaccgtggtggtactgaggtgcatggtgacatgttgtagagttgtgtcttgtgggtacagtggtacatctctaatcagagtaaaactattcgaatagccgtgcccgcggttatgggtgggtctaacaatgtttttcgtgattagtctcacattactcattattaatgaaaatactgtgatgactaaattgactcctggtttggaatggtatattcctggtttagtcttttgtttttttttccgctgcgtagaactttgttctttgagaggaactatccacctctgtaataatttattctgcgcatattaattagttatttgatagtactctattatcaatttgttattgtgtgcctcggctgattcctggacgagggtttaacgcacatgtaagcgtttggaattttggatagaaattccgggcgtgataatcatcccctgaatcagtagattgatacaggttcatcaatctgaatcttcatcgcatacatttgattaaggctccaatgaagatttgtttacataaaataattgggtatttacaagattttggctaactattactgtagaagcaataggatgagccaactctaatattttgctatagaattaaaccatctatctaatctacacttgggaactaagttggaatgaaactaatttatatgattaaactcctggcttcggcaaaaacaagggtgagaacaatataatcatcaagctattatatcaagtaatgtgtcacgtcctgataaattcatcccgaaattaaaaatcattttctaaaaggaataatagaattaattaaaattcgaaaagaaattggcaatcactaaaatacgtacaagaaaaattcgaatgtggtccggagaatttttgttaaattctccgtggtctaaaaagagccctcaaattttacttcaattttcagagcaccggaaataattattaagcaacaaaaacaattatcaaagtttactaaaaagaaaaactaaaaataaatcctccttcctcctttgggccaagcccagcccaaagtctccctctcctccctctctttccctcctctcccaggcctctcctcctcctcccggcccacctcttctctccccctcccagcccagctccctcccctcccctctctctcccgggcctcccctccctccactcctcctgggccggccgctcggcccaagccgcgcccaagccaggccgagccgagccagccgtgcacacgcgcgccgcgcgtgcgctgaccacgcgcccgacagcgtggggcccacgcgccggtcgtctccttcctcccgcccggctcctctctctcccgtgaaaccctagctcgctccctcctccaaatccgcctcattcaaaccggggattccaaaattaagtggggggttttaatccccattgattcctcttcaattccccccaatttcccccttgaatggcgccctcaatcgtcgggaacggacgcgtctaccccggccgctttccatggccgccggtcgccattcccgcctccgttccgacctcccccgtggccggctccctctcctctcctataaaatggaatccccatcctccgttctatcgttttagcctcatcccgagcctccccgtggtcgtatcacccctccccgccgtcgcccttctctttcccccgcgccggccgcctccagccgcctctccctcctcgcccgagcgccgtccggccgtgccgtcgcctcctccagcgtcgcagccgcctcctctccaccggcctgccctccgtttcgcgcggtgaccaccggaggcgcgttcccgccgtcgtccagtgccgttgccgccactgtaccacctccagccgcccctgccgcgccgctcaggtgcgggccggccgcgccgtctcctccttcggcgtcgccgcgtcgacctccaccccggcctgctctttgattcgtctggagaccgccgtcgcccgcgccggcctttccatcctcttcgtcgccggcgtccctttggccgccccttcctcctccccggctcgtcggcttgctgcgccacaaccacgtccggcatcgcaacggcaaggtcgccctcggcctcgcctcccctttgtccaaacccctcctcggtccatcgtcgtcgtctccgttcgttctcgtcgtcgacgtcccgtcgatcgcccggcttgtcgtctggctgcgctgccaccatcgtgggcatcgctgcggcgtgtcccacgccgtcctcacctccgtgcagctgctgccggctgccctcatcgcctccccgtcggtcgtcgtcttcctccttcctcctcgtcgtggcgttcgtccctccgtcaagccgatcgcgttcgccgcccgcgtttcgtcaagtgtgcagcagccccgtcatcgtcttcgtcctcggctccgcgtcgtcaagccttgtgccggccgcgtctcgccttcgtccaaggatcgctgccgaagtcgttccctcgccgttcgcctccgtcgtccccgagctgtctccgccgcgcccgtttgtcgttgtcgttcccacgcctcgtcgcgtggtggtaaggatctctctcctttcgctgccccgtcctcgtcctttcggtgtcgcccgtgcccgttgtgcggttgtcgaccccggtgcctgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtggaccgtctctgtgtactcggtctactgtggtcccttaggttgacatgtggggtccgcatgtcaacagcgcagccttcctgtcttttccaggctagcgcttccacatgttttatagttgcaaagcctaattataataatccgtaaatctccatgtaacagcattaaacttcggatgaccatgtcttggtcatacgaactctaaatcgacccgttcaagtctcctaatgtttgttataacctaaagaaccgtgtgctttctttttatgtattgttatttcttctttataggcttgtagctttgcttgtgtgcttcgcgtagcttctatcgttccggaggttccagaagcgtggttcgcgggtgtcgccgaaggttcggaaggccgttctctctgagcaaggcaagtcacatcatccttgagcatattgaatcccagtttataaaattattttgatttaaattaatgcattaccgctttatcactgttttatttagccatttatatttacctttgttaagacattattattgctattgttattattacctatttcaccctagaataaacaaaaccccaactagtgggtactctattcatggttccactagtatgaatttaggtagatgcttcgctgattaataggacaacattaggtggtttttataactttagactttgtgaatattcatatctcttggatactatggaatggttggcttatggtggaattggacatacccctctcttcctctttcaaaacccctaaaacctgttttctggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggatgaagtcggggctcgatggacatctctaggacaaatgaaggctacacgagctgtggcccggtagtcgagatgtcatggcacagggttggtgccctgctgctaggggctcagtcctaccgacctgtcccggaggttccggccgtaggtggggttgggtcggtactcttgtctatggctaggatgggttggaaactatgtcatgtcttccgtccatatgccgtggtggcatgtggcacgtggttgcacgtgaggaagacgtgtcttgtgggtaaagatgtacacctctgatcagagtaaaacctattcgaatagccgcgccctcgattatgggcaagcctagcaatgtaccaaagttagtgtttttaattcttaaaacctgcttaacaactaaaatgtggaatggttggcctgggttggcttgggatgagctgggacccagggtcgggttgccagttcggtctgaatcatcgtaggccttgggttaaggcaggttcgtgtgggtccacggccttgattaataatactgtgtagctctaggatcatctttataaaatagctttgggcaactaaatgacttttaaatgctatttactacaaaactaaacccctattattatctccttgtactcccttgcattaatcatgcatctcccggtgtgacttgctgagtacggtggttatactcattcttgctctatctttccccccttcagtaggagaagctttggagaagaagtcttaggtggagtcctggcttataccccagttgagcgcctgtgaagatggagccgtaggcccgctagtccgctgctgtttatttttgtttgtcaggcctcaagtgcctttgtaataatgtaaatattatcgacataataaagatgtgccttttgtatcatgtttgtttggtgtaccccggcttttcctgggacggggattaatacactagcgttcgggaaaaggtaattttctcggtcgcgacataatgaatgcatgaaatagtaatttcatgttttagggtaagccctaaaccctatacaaaaaggtccccgggcattaggggaattgcttttaggtccataagcccacatggcaaacaaagcaattttacaaaaagaaccttacaagatttcaatttcaactaattaaagtccttagcacctaatgaagtggctaaacagccgggcccacatgtcggtgactcggcggcaagagaagcagaggcagcaggagagcaacggcgaccgacagcgttcgtggcggcgtattggcttgatcatatgtgggcgtcgttctcctgggaccaaggcgacgtcagtggcgcaatggtacagctggagatgattcgagtcgactggaatggcaaagtggggcgatggtggcactctggacaccgggaacaccgacgagcgcaccagcaagtgttcgatctatgccaaaaaagaaacaaagaaaatggatcgatcaagcagagaaggaacttcatgaatcactactacagaaacgattttcctggacagggaccttttagattccgtgcgggcggtatctcgttgcttctgggaaaaccagctcattttcgcgtgcggtccattaaagaggacggcacggaaaaatcaatttttccgtgcggtaactcatttcttctgggaaaaatcgatttttccgtgcggtcctcttaaatggacagcacgcgaaaataagccgattttcccgtgcggacctattaagagagccgcatgcaaaaaatactaactccctctttcctctctaacccactttaaaatttcccctctttctctcctctcccctcccctctatccctttttccactttaaaatttccacgcagagcttctcctctcagtcctttctctctcacgcctctcctctcctctctccactctcctctcctctcctcccgacggtggcagcggcggcggcgcgcggcgacagcagcggcgcggtggcggtgggagtaggagcgcgccggcctcctccatgtggcggcggtggagggcgtggattcggcgggcggcggtagtccctacacggatccagcggctgtggccgtcaacgcaagaatcctgcggtggcagccgtccccgcacggatccggcagccagcctccttctccccacgtgggatccagctcccctcctctccccttccttccctccctagatccggcggaggggaggggcgacggcggcgttgtggccggaggggagcttggatccgatggcgggtggcggggaggccggcgggaggcaggtggcactatggccgtcgggcggaagcccaccgccggattctagggtttcgtttttttaaaaaaatatgttatttcgaatttttgttttcccgtgggggtgcgccacccgcacgcaaaaatcattattttcccagacccctaggtgcgtgcaggccgcctacccgctcgcaaaaatcgttacaaaaatcttgcttgtagtagtgaatggtaaaagtaggtggaaagtgagagctagttgtcaacatgaggggtagagacgaattaaaggagttggcagtggtttgaggctgtgatcccacttgtacttcactcaaccaagtatgagtggctatctattggccccatgtagatgtttcctatgagaagatgagaggtatggtgaagtttgggtgtaaattggactttagctccctctctctctttctttctctctttgaaaatataatttaggataatgagatgattcaccaaggttgtttgcaggtatttggacgacaaataggcccatatatagatgtttcctagaaggcttggagtggtagagtggcattttgggtggaaattcaatttaaacctttctctcaccttttgaaaaataaaagaagatttaaatgagagaagagcagatgatgtgttggctatggttgtatgatgagtgggccccataaggacttggtcccacatttaagagagatgtagaaggagagaactagaagctctaaattttccatctgttggcactatcacactaaactatattaatctctttctctcattcatttaatttagaattaagaggggggtgacagggagacaacaaggtagacaaggatttgatgcttcaaggtgccaagttccaaagtttaattacttttgcttttaccatggtttgttgtcactaatgactccatttgaaccaggataataactatgttattttatgcatgtggcaatttaattaacaacataataactatattcatcgatcttaatttgtatttctgaatgtcgccgtagcgttagcacgggcagattactagttaataataaattaacacacatgcttaattaggtactactccctctattccataatataaggcatgcatgcaagcatgcaattaactatgacatcttcttcattaagttattacttttttaaatcctttactctcatgttatctaatcctattggatgcatgcattatatttattaggatgattcaaactacaagatgataataattttttcttggtctttgagttaagggtggttatactttatattttggaatggagggagtagctgtcaacaagttaattagggcctgttcactttgatgccattttcaaccatatcattttttgccaaagttaccaaaaaatatctacgtttagttgttgccaaatctggttaatacataagaaatcctgccaaaattttggcaatgcatgaagaggaagtacagaatgatgccgattattattcaaggccccaagccacttgataatgacatcgatgtgtacctaagaccactggtcgaagatctgaaactgttgtggaagaaataaggtgtccccgtgtgggacgaggacaaacaggaggagtttaacctactagcgctgctattcgtaaccatcaacgactggcctacaattagcaacctatccgggcagtctaacaaggggtacaagacttgcactcactgtatggatgaaacagaaagtacatatcttaagcactgtaggaaggttgtgtacatgggtcatcgtcgattccttgctgcaaaccaccctgtacggaagaaaggcaagcactttgaacataaggcggaccaccgtacgaagcctaaacatcgcagtgagaaaatagtgtttgctatggtgaaagctcttaaagtagtgtttggaaaggggcctagcagccagcctattgatagcgaacatggtcacgtggtgatgtggaaaaagaactctatattttgggagttaccctattcagaattcttgtacgtcctccacgaatataaagcgaataataaacacgaaggagaagaagttcacaaacctaaagtctcatgactgtcacacgtgtggatgacacaactgctaccagttataattcagggtatccttccagacaatgtccgggcaacaataacaaagcaatgtgctttcatgaacgcaatttcgcagaaggtcatcgatccggatagattggaagcccttcaaaatgaggtggtgcaatgtcttgtcagctttgagttgatatttccaccttcatttttcaatataatgacgcatctgctttgtcaccttgtcaaaaagatcggtattctcgggcctgtgtaactacacaacatgtttcctttcgagaggtacatgagcgttttgaagaagtatgttcgtaaccgtgctcgtctagaggcaagcatcgccaaggggtatggaacagaggaggtcattgaactctgcgtagaatttatcgaagaccttcgcccaatcggggtgcctgaatcacgccatgaagggaaactacggggaaaggggactctcagaaggaacgcagtaatgacggtatacaacaatttattccgtaaagcccatttcacggttctgcaataatcttcattggtggctccttacatcgaggagcacttggctctagttcccgccagaaacatcggtaagtccgatgcatggattacacggcatcacattgataaattgcccgtgtggctgcgacaacatctcatgggtaacgaga

SEQ ID NO: 74947 - DNA, 3992 bp, Oryza sativa
aggcgcagaagatgcgcgagcgcgagcagaaggtggcgctggcacagaagaccgcagacgtggagtcagcggcgccttagtttacaatgggattgtacgtgtctacttgggtgggtcgtatacatatttacgggtgtagtgaacatgtttctcagtgtagttttacagtacagtggcatgcataaattttgtacgagattgtttcaaattctgtatgacattgtttcattatatggtactagcacgcagaaaaagcaagtgctatagttgtatcaacaaagagaatactagcatatacattcacaagttcttcacttcatgacttcttcccagtgctggtaaaacctttatactactagctagtctacaagataacaagacagaagggaagattgtaagccgccatgaaggggttgcatattaaaatgccatttcacttcatatagagcacacagttgcttggcaacatgcatgcctgtgcagaaggagcatgtgctgatatgcacacctggagcagaaaagagggatgggactacggaagcacaagcatgcatgcaagaaacgacagggataaaatagtttcatagtataaaactagtaaaaaacaaaacaaactaatccctccaactccatgtctccatgcatgctgggcagtgcatcttggcatgtggcgacggtcgccggcgtcgtggtggccgacaggccgccatccggtccaacggcccagcaatgacttacaagaccaaagagggcatgggcccacaagaccgtcacgcacgcatgctacggcactggatgatggaccaacaaggtgatcgctgtcgtcgcctgcaccaacaccaagttgaatccgaatccactgcaatttttggaggctgtgcgctcatccagtcaccctgagcatagatgacaaaaacgaacacaccaaaagaaaaacaaatatgggcccaaacatcatggaatatattcacattgtcatggaatatggaattcttgtacaagatacaggggaatgacactttttttcaccaactatcaacttattctgccgtagtactgtaacatgaacctaaaacacagtgtctgccaactgccattgacggaggtaccaactaacattttactcgatctctcccttttgtcaggtcttggtgcttcatcatctcctagagaacttggacacgaggtacactagaaagaagcagacgagagcgaagaggattacatgaaaaagatggttcgaaccattctgtatgattttcttgtttattctcctcatgttattcttgacgcctgcctgggcctttgtcagagtcatttgctgcaaacaagtgcaatatgcacattagagaccgagcacaaagcgtatttcaagttttcaacacaaactagtgtacatcttattgcagattctagtctacacatgttctcgacaaacagagaaaggaatatgccagacaagtaattttggatgatctagggcattttatagagtaaagcctcatttcgatggaccttaatctgggtccatcaaattcctggcctataggtgtgctaacatggaaacttctcatgtatatgtggcctagtccccttttctttttccaaaaactatcgaccaacaagatgacaatggagagaagatcagaatgtgattccatttaggcacgaacatcctgctaagccctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggctgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagatgaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagtattgcggcattctggctacacaataacaagggaagacttactcgtggctgcaaccctactagctcaaaatttattcacacatggttacgctttggggaaattatgaggggatctctcagtgctaagcctgaatgatggttatagtgtacttttagagttctcgtacaaaggtttcagattttaaaacgagcagacatcaaattccaaataatcaattatgattaaatgtacgattctacaagcacttcacttccagaaactactattttatgaaattttaacatgatgccgctacagatagactagacaaagctcacaatgtaagtaatacccaggataccaacatacaaggccgaattcatggtaacttttagacatgcgttagtgcataatgaatcaactacagtgcatgggatgggatgactgaacatgactggttaagtgacaagagattgaggatcagcagattgtgtttgaagaaacattacactaggaaccttgcgatcagtgataatctatctgctaaaaaatgtccatgtgaggtacaataggcgtgccatatcaacattccgataactcaatctaaatgctattcaggatttggcccaaactgtctcgcagacaagttacttaccagctgagagatgaaatcattttggtacttggcctctgtttggatctcttgggcaacctgcagcaccaaattaatggcttgtttagaatcgattgaaagaatatgaaaaaagcttatgaacataagtagatcatggttcaattactcccacatagcatcacgcaatttcacaacaactctagctcgccacaccggtttcatttagacaccaaattttgactaccttccacaacagagtttgctcatacagattcataacaatacttacccctcttagcttacggacttgcccacgaagtccgacaatatggtcatccaaatcagcggtaattgggtcgatctggagcgaaatctcgctggagcttgatgatgcagccggcctggccgtcagcccttccctgcagaaccgaacattaggatcaggataaccgagacaaaattggaaagtccaagagggaaaacg

SEQ ID NO: 74948 - DNA, 1552 bp, Oryza sativa
atatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaatgaaagaagggcagagggcctgatgagcctaagcgtcaagtggttctcccaggcaaaaaaaaaatcgtcggagttgaggacaagactgacgaggattacgatcagttggatgggcaaccccctttcacggtgacgattgaccctagcatcctcctatcaaatgaagacactccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggaaaaatttttaaaagtattaaatttaatatatttttaaaactatcattcatatattagagtttttcacaa

SEQ ID NO: 74949 - DNA, 756 bp, Oryza sativa
tgtagttacatatatatatatatatatatatgactattcaccaatatttaaatccgtgtctaaattttgcgcgcatgcacgtacattttctatagactctaataacaatctccgtaaggaaagaaacattgtgtttggtgtacacgtcgtctttcattaaaaaataattttgaagacaaaaggttgaaaataaacctgcactactaattttaatttaaatgaaaaaaaagaatcttctcatgagccatgcatgatccctctttattttttcaataaaataaaataaagatccatgagccactccaccttagctcctataaagactccccccctctcccctcccctttcctctaaaccccttccaataatccctcaccaacccatacccccacactccctctcacactccactctagctagctaagctaccttcttactccatttgagcaaaccaaagctcatctagagagagagagagagatctagagagagaaaccagcaaccactcttcctccatctccatgagcaagagaccagatcgttcgttctagattgttctagctagatagcttcatcgtcaaccttggcaacgccaagaaaattaaccagcaagaacacaagaagcggcggcggcggcgatggaggtggcgacgatgctgacgctgacgctgctggcgtactcggcggcgatgctggcgcggctgctggtggcgcggtcccggcggcggcggtgctacctcctcgactacgtgtgct

SEQ ID NO: 74950 - DNA, 9821 bp, Oryza sativa
cgtggttcatctccctccctgtaatctctctcttctccttccttagggcaccccgattctcgtccgccggttgccgtcgtcctcccgtggctcgccgtcgccgttcgcggtcgtcttcctccgcgccggccaccctcggtgaggcgccctctcccctctattcccctctctctcccttctagccgccgctttagcgccgccgcccgttagccgccgctctagcaccaccgcccgtcggcgccgcctttgcgccgccgtctccgccgccggttaccgtcactggcaacgcgtgtgcgcgcgccgtcgccgtcgccgtggccgcttggccggtcttgagccgagccgggtcgccatcgcccgtccgatcggccccgggccgatccaggccgtcgatcccgtggaccggcggtggaccacccgcgtggtcccggtccacggtagactgaccactcgtgcgccgctgccgagtggggcccgcttgccggcgccccttttccctctctcccgagccgctgaccggtggggcccgcttgccggcgccgcgccccgccttgatgacgtcagccctgggatttattgcgcaataaatgatttaaggactttttgttatagtaataaacacagtgaatcttctaaaattcataactaattcatctgagctccgtttaagcccattcaagtctcagtaaatcaagaaaaatgtgtagaatccattaaaaatggttttgttccctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttttcttcttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggaaaattctattaatgtttagactgttggttctaatggtattgttggattagtgccaccgctttggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttacctctagctgacgcatccaggcaagggtgggagtgatggagcggggcgggccctgcgacggcctctgtcgcttccggattcacctaggcacgagaggggactgcccgctgccttgcgaggagtgggggtgaaacctgaggtgtggtgtgcttggttagaggggttatgcgaagggtcctgtcacggcctctttccggtatgtcgtggtggcatgtcggcgcacggaaacatgtcgtggggttgtgtcttgtgggtacagttgtacacctctgatcagagtaaaactatttgaatagccgtgcccgcggttatgggcggacaaccagattcaccgtgattagtctcaccctagtttagtcttttgaaattggatagtataggtggatggttgggcctgtcgcaacgtggtatagcgttggacagtggatgattaatattaattaattattatgactgttttcttctttaaacttctgtttattaatgctcgctttatgcaaatgaaccactctagctctcctttgataattccctgcatcatacccctattccggtatgacttgctgagtacagtgggtagtactcagtcttgctctatttttcccaaccccagagtacgagtttgtgtcagatggaggtttctctgaggagtaggcttcgtccgtgccgtcgaggatgcctgtggagtggtgtttccgctgcagttctagacaaggcttagctcctgttgtctttcgttttttctgctgcatttatgtaagacttttatgatgtttgtaagacgtggatctgaatgtcaacattgtcgtttgtgtaccccggctggtcctggacggggattttaatgcacattctgcttggaattctattcggaaatttctgggcgtgacatatatgcccacatatcactgcacatgtaacacatgctcaaatatatgcaaaccagcggcacattcatgaccttactaaattcttgttggaaagctatttacatgtatgtaatattcatagaccccaatatttgcatgtgatgagtggagtcatgcgtctacaacttcgtcataatatataccactcgtgttttcctcagtatctttccatcttgttttcaaggttcctctttattttcatctttcatatattattttctgtttttagtttattatctagttttatatctttttccttttctctaactatattttacaccttttcagttcattttgattttctgaaatttcatggtgggatcaaacaggagggagtgtgatcaaccccactataaatattactacttatgttaattctctcccttttttatcatctaagcatgcataagattgataataaatgaggttcctttccaaaaaagttgataaataaggggaagagtagcatttgttatacaaaaagagacagataaccaacatattagtgtctatatgtgatttagaatgaaacagacttatggctttaaattgacaaaaaaattatcagaaagaaatggaatttgatagaggcttcagtcatatggggctaaactagccttaatatcggtagaggtcgaaactggtcgctgttaatagatgtagggttaccctttgtccattgttcccatgcaactttttttatactgatcgatcattttgctagtcatcaatataatcttttatgcttatagagatggttacctgaactttgactgataatatatatttcattggaaaaagatacgaagctgcatgaaaatgatatgtaagatttgctcataacagtattgatcaaagggaggttctggacttcaggtgatctatcaacaacagctagtttgttgctcaactataccgaacaaaatacttctttcattccatagtgtgtaactattgtcttaggagtatccatattaaaacattgttagttgaggacatgacaaaatatttacaaaatttgaccctaactgaatgcttttgaaagagacactgctcctcactccgtttcatattataagtcgtttgactttttttttctaatcaaacattattaagtttgaccaagtttatagataaaattaggaacacttaaaatatcaatttactttcattaaatctaattttgaatatattttgataatatatttgttttgttttaaaaaaaatgatactatatttttctataaatttagtcaaatttaaataagtttgactagtaaaaaaagtcaaacaacttataatatgaaacggagggagtacatggctggtggtcaaaatcaatcttacaggtggctggcctgctgcctgtaaccaaaggttagataaaatcgtggattttgacaagcggaaaaccaacctagcaaaaatcgacttttgctagcggatctcataagtcactgccaacgaagagatatttggggccgaaaaagaaataaaaacattttccacaacaacatgatttgattcaaatccatatttttcacatggacatgcaagcatcaacatcgtcataatcatcgccacacacaaagccaccgcggtcatcatcttgtcgagcttcatcggcaaaggcgtatgcggtccttctttcttgactacggatccgggccatgccgaggccttcacgctcgtcgccgagccatctgtcgtcgagacccgccggcgcatgatctggccgccccgaggtccgtcgtcgccagatctagtggttttgaggctggctcacccctgccatcatcgtcccaaggctattgccatctctgtttgccgtacgtcgttgaggcccgtcgacaccagatctggtggccccgagacccaccattgcgccgttgttgtcccgaggccgccctgtcgtcgtcgtcccatcagctgctcatggagctgctgggggagagagtggagcaggagaatgagtggagaccgaccgcctttgccaccccgtggccgtctcgccatcgcaggtgataggggagagagtggagagggacaactagtggagaggagtgagggagagggatgagaaccggtgaggatgagtataggtgagggatgagaatgagtataggagagtgtctcctaaacttgtatattttacttgttgatatcccatgctttgatgtaggatatgtggatgaatgcatgctataaattacagaaaggatagatgtatatgtttaataatgtttaaaatttattttttagtagtgagatatgtatagtagttgtactatgtatttccttttttgtcttgaaaaaaaaggtgtactatgcctttgtgggtatactgatggtcgtttgtcattaaatttttctccttttctgctcacttagctcggtctatcaattacagaatggatcgtggtggttgaataatgcgaaatacatcatgatctgtaaagttcatacatacacttgtttatgatgtttagcccccatcaggatttgatctccaaagctcagatgcacatgtttacttgtacacattcttttagttctaaatttcagttcttttctcttcacgcctagtataatttacctaaataaaaatgatctttcactgctggagaaaccctttttaatcccggttcacaaccccctatagtcccgtttatacaaccgggataacgaatccgagactaaagatgtgtatttttagtccggttgaaataaacaaccgggactaacaaattactcgtatacagtacataacaaatctaatcatagctattttcttacatttcgacagacctcctggtctcctaaggaagagtgagcttccctttacagtgaaaatatcaccaatcaaaagatatgttgtacaaatacaaaaaaattgggaaatacaagaagtggaaactcagaacaataatgttagcagcagcttagcacttgctaataattttacagtcctgtcaagtaataagtaatgcctcttaataggaacttaaaactgtcatctttgctaccgactaaattcagctgtagttgcaatttgtaatcaagtgataggtcacactaggcctcaagctgtgtaatagttcataaatctaggcaatacttaaacaaatatatgagtcaggaaatctgcttgcctaaatatcattctgggacacattttaaatgcattttaaccttgctacagtcaactaatggtccacagagttgacacattctgaaattatttttagttctgtaaataaataaattgtcaatctcatatactcaaactaaaagaagctgataaaaacagatgtgacttgaagtcttgaacaacagagctcattcagcccaagtcaaatcttgagcaaacttatatacagtcagtcccattggggatccctacggccctacccactggatgaacacatcaaggacatgatatgaataatatatccgttagctaattgcttgatcaacacaacttcataactactccgacagtggaactacttttgacacaccaaaaaaatgagataactcgtaaattgctacagtcaagtcacatagataatccctggacaccagtcgttaaacttacatatattttagacaagtttgtcaaataagtattacttgctaaatgagcagaacaaggtccgccaaataccagcatgagtttactggagacgccttccaatacacttgggtacataagacctatctacatcaagcgaaccatgataccagtatggctcgggcacaggccacctgtcatccaagataacttttcctatgtaaattgatcgttgaatacaacaatctaagatgccagaaacaagtggcaatgaagaatccaaaaataaataaataaatacctgtttttcttcgttccctcaccgatatctatgggcataggattgttacatccactgcgaataaaaaaaatttcagtctaaattcttagaataagcattatgcctactagctatcatcaagatataacaaggaaaaaaatcatacctttctgatggtaaatcattcactctgcttaaaacttcgacaatcttatgccttggtaggaaaggagttgcttcacttccatcatagaagttcatgccaacaaaactcccatcaaaattaataagagggcctccaatcccagcctaatacaaaagaaaggacccaatgttactggaaaagttgaaattcctgagaagtcatgtgctgtgattatagagataactcagattctcatgcaactatctatatgggctactacgtaacaaaaaaagtaagagaaattcaccacaccttcttgattttacatgtggacagcttaagatctttgcagtcaagtttgcatccctttttaccacgcttcacattaccaattgtggccatcaatggtccaagtctagtgtcacgtcctatagctactactttttcagatggctcttgcaccgttttactaaaaatatcttctaggcgaacagcattgaaattcttcttgagactgacaatagcaatattatagtttaaattatagaattccaatgtcccacaacaacgttggttcggtgggagaaacacctcaatctgcaaacataaagtgagttcagctagcaatcatataataaagataaagataaatgactaggagaaccaaccgtcaggttactatcaatcttgtcatcattacaacgattgaccaaacttgctgaagtcaagatgacagtgcgcgtagctttgcttccatgccactttataatcaagcctgtgcatgcaaaaaacctcacgaaacctacacattacaactttaatcattagttagtgaaggtaaaattgcatagaaaagtaatgaacatattgctgtcaaaatcaccattgaatgatgcaagggagacaacacgacgagatatatttgtcacaacttctttcggaagttgataccagacacgattcctacaagacttggctggatcaccataagggtaccctttccatgcaagtaattcaccaaagcgttcttcaaaatgattaagcaattccccattcactggttaaagaaacaagatcagaaattaactacaaagaagtgcacaagggagatgaaagcaatatcaaaagcaacgacttacattcaagcacaagtggtggtggcatgggatacccataggattttaaccggtaaatagttttcataaatcctgatgcaattaggagatcattattagtactcagatgatatgtgacattagcataataaagaacataggtaacatttagaatgatgattcgcagtaattgttcatcacctgaaggcacttatgcttgatacacctttaggcaacgaatatcctcggaagtggagatgtttaggactgagagaacacagtacacttgttatgacaaacaaataaatacacacgaactagcccaaccgcaaaaacagtcataccaacacaggaaccaaactgtatgaaaggaaccaaggtatgaaaaatgtactaaaaaaatcaggatattaaatattcaacataagacatgagaggactgagcatattcaaatgtaagaaatataagttgcactatccatatggccaaaacgaattgttttgagtttaaacacttcctcatttaggaaatacattaagcatgggcactaatttagtaaaggacatgtggcaccgatgttggtaaccataaggtagaggtatcaagaatccaaattgtttcaatccaaagattacagtgtgaaaactctgaaggctccaatgctgctagaatcaaaagataaccatgtgaaaactcctaaggtcccaatgttgttagtataaaaatggcttaccttaaacaaagggaatatgagacgaatttggaacagctatcaataagctaagtggggaagaaaaaactcaaataaaggatgtgtaaaagacatacttcaatatcccaaaatgctccaaacgcttccgaagcaatttcgttggtaggaaagcatatgtcaaagttccatcatcatcatggcaaatgctaaagttcatcccaataaatcccttatcctttccaagaagcggccctccaagtacagcctaacaaaagcaaattggtaggataaaggaaaaaatgtattgttttttttttacttcgttgcaaacaatgataccttaagaccatcaatattaatgcaattatttaattcaagttttccatcataccaaaagtaacaaacagattataacaacataccttagagatatcttgactatctggaacccaggtgttgttgcagcgaacaaaaccatccatagccattaaattgcctgactcgaaggcacgcccagcaactagtgcttgaataccatcaggacaggccttaaaacttataggacggacctctatgagcccaaagcacgtgacaatagcaatatcatggtcatatagtcctaagaacccatcagtaattctattattaggaaggcgcactgcaacctatagtgataaaagcagtacatcagcatacaatggccacaatcagtttggataaataaagcaaaatggagggcgtaatgaaggccaaataaaccagcaaaatggaggacaatgatttgcagcaccaaccctcaatttatcatctctatttctcttctcgtcgaatactctaaccaaagcagctgatgtcacaaatctcgttaggtgttctctagttgtcccatctggtagaggtattcccgagcatgcaaataacatcttatctcctgggcaagatcatggtttaaataattaagaagtgacaactaaatacaaattacgaaaatccataagcatcggagtgcactcaccatcaaacaaagcaagggagacaacaatggtagacaaatctacatcaacattagcactgattcgataagtttgttgaccgggattgacaacatggccaaatgatttctcttcaaaagcaatgctcgaaacttctcgatcacgaagatctttgtcgaatcgttcctcctctatagcacacagattgttgtaataattagccactgccttccgaatctcttgatctgattaacgaacatgatgtatacacaactatgagtgttttattagagcaacatgtaccagaaaaacaagaaccaaaaaattcaaaatcaatgacgcacattttctcatattttttaagccgcggcttggcttgtctttcttgtcatcacccctacttgaaagcaatgaggaatcaagtttgttccttctgtttatggctctttgctccctactcacacctcttgtgcaatcaatctgtgcctcgtttctcagggtctttgcagtcctgaagaagaaaggaaatgcaaatggttagtcaaggtttgatcataatgcatgtgtgtcacgcccgaaaattcacaagtaatttccaaactaatttgtgtattaaaaatcctcgtccaggaatcacccgaggtatacaaactgacaatttataatatatagattcatcataataactaaagtgattaaatacttacatatgaggcacttagtcctcaccacgaagaaaactgcagcagaaaagaaaatctagcg

SEQ ID NO: 74951 - DNA, 20152 bp, Oryza sativa
  unsure (1)..(20152): unsure at all n locations
tacgttgtatacttaaacatgagacatcgtacactctggcgatctaaaaattaattactagtgacagtgctggtcaacagtgacgaggattatttgggaattaaggatggtataaaaataccattgtattctctatttgcagctgaaaaaaatcacaaaagtacaatgcatttgattctcaatttacaaactgaaaaaaaaatcaaaatgaaaaaaataccgggatcatcataaattcgctgcaccgctggatcgatcgttcttgattgatccaacggccggtacacgtgtggggatggtttgaagtacatggttaatgttgtgcaggtagctcaagaaagccttgagttgggtttacctgtcagtaaaaatggtccctacaaacaagtgatcatcagtaatttctagcgatgcttttgtctactgtgcatcatgttctctggtcacacgccattcaatcggtccgagctactaccacgatcagatcgaagagttattgcatgcgtttcctttttcttttatttgtcatgggtttttattttttcttttctgattatatatatagaataacacaacaaatatatagtaccaattatatgcatgcactttatatgctcacaagtacacaaccatggttagtcagtgatacagctgtttagataatggagctagttagtactactgcttaattaagttaggtctctttctgttacctttctattttttgtgcagaaaaaagaaaagagctcctgaccaattttagctatcacttcccccaaaaaagcgcagtactgaaattaattaccagtggtggttaggaaattaattaagaaactgtgtgaaagtaggaataaaatgaagaaaggagccgaggtaaaaaaaagagtacacaccaaattaattagatgtttacaaacattttacaaattaatcacaattctcaaataaaagggagttatcccaactatccttattaaatctacttcatatggtgcatattagtaaactataaagatgcttgtgcatgtactattatcatttatcatacagcatgctacccttattaaatctactacaagtagtgcatattagtatactataaggatgtacatgcatgtaccattaccatttaggcattgtttagttccaaactttttcttcaaacttccaacttttccatcacatcaaaactttcctacacacataaactttcaacttttccatcacatcgttccaatttcaaccaaacttccaatttttgacgtgaactaaacacacccttattagaaggcacgaattttggtccattatatatatatacatatagagagatattcgttttgaaaatatcgtattagactgtttccgatcgtcaaaatattaagatttaattatgggcaaatgcataatagattttcttttcaggctttcagtctctccaccatgttttcataaatttcataaaaacctataataacatgaaggagaatacagtgatgattgttgtagtagaacagtagaagtacacactctttggtactacactccaatactccatcgctcatcgacagagaagtaaatgggatcgtgaagctagagctgcgctgcactggactgagctttcaaccacactgcatgtgagccagctgctctgctccatactgcccccatagcttaatactaacagctagctagctccttcttcttcctcctcctccattaatggcggctcagcaagtttggtttgcctttataagagcagctaccttacccctagcctagccaccctgtaagcagcaagcatcaatattgtactgacgtggatcatgtcttcttcttcctcctatggaacgtaggagtggtacagtacgtagtaatggtagatagacactgcctttcaccggtttgggcctttgggatccatggttgccggtttcagtggtgaaagccagtggcttttcagttggagaaaaatcggagagtatggttaccccaccgaccgtagtccgacctgacaggtcagcaaaagcgggcggtgaggtggcgcatgcgtggaaatggtgtgcccacgtgtataaagcatgggccgaggtttggtctaggaataacaactgagatctatcaattgacggagtaaaaaaaatatagaggtcaacagtttagatcgattgtccgtttgatctagttggtcaatatatttaagtttctaagtaaatgcaaggatttttatttttcttgtggagaaggcatttttctaaatttatttacatttagacaccaatacattatgtattggaatactattatgcctctatccagtctccatctctccgatcaattaacggatcaaccgatattgcaacaaaacatacatggcttgcattttaggattcatggtgcataatctccatgcatggatgaagtagtaatttggagtgtaaactttgaacatactctatctattcagacatatttgacatttagcataaatttcggttgaactaacaataacttttaaaatgcctatttttttattaaaaaaagtatatgtagattcaccatagaaatgtaagcagtaacattattataagctcattagattttgtaaacacattgtaataaaaaaatccacagtcaaattcttaaaaatctgactaattaaatcttattctaaacatgagatttgttttcttgggaacaaaataaaaggcccacccttttgcttattcctggaataagcgaaacgaagtgatctttgaataaacctttatatacatgttcttaacgatctaaaagcaaaggttgaagaataaacttcgatgaaaaaaaccttaaaatcaccttcaaatttaaggttaaaaatttaaattttggctgataagtagtataagcatttgttggaatgcatatggcaggacgcacgcgaacaaggtggcgctggtgatgacgtcggagtcgatcgccccaaactggtacgccgggaacaagcgcagcttcatgctgggcaactgcctcttccgctccggcggctgcgcctacttcctcaccaacgacccccgccaccgccgccacgccaagctccgcctccgccacctcgtccgcacccacaccggcgcctccgacgacgcctactcctgcgccctccagatggaggacgacgccggccgcccgggattccacctcggcaaggacctcccccgcgccgccgtccacgccttcgtcaagaacctccgcctcctcgccccccgcgtcctccccctccccgagctcctccgcctcgccttcgccaccttcctctcctccggccgccgcagcggcggcaagaagacctcgccgtcgcagcagccgctcaccatccgcatgaaggccggcgtcgaccacttctgcgtgcacaccggcggcgccgcggtgatcgacggcgtcggcaaggggctcaccctgacggagcacgacctcgagccgtcgcggatgacgctgcacaggttcgggaacacgtcggcgagcagcgtctggtacgtgctcggctacatggaggccaagcgccgcctccgccccggcgaccgcgtcctcatgctcaccttcggcgccggcttcaagtgcaacagctgcgtctggaccgtcgagaagcccgtctccgacgccggcgtctggaaggactgcatcgaccactaccctcccaaggagctcgccaaccccttcatggagaagtacggcttcgtcaaggacatgatgaacttgtgatcgatccatcaaattccccaattaattcctcgatcgatctctcaagaaccaatataatcaatcgatattgcatgtgcttgcttgcgtgcatggattaattaagcgatcggttagttaattaattttatcgccatttgctgcagctctgttgatgattaggatgaacattatatttacagggagggggaagaagaagtaagaacaatcaatgagttgaacaaaaaaaaaactaaggattcaattcataggtacatatagcagcttgtgattccataattttcttttcagcatggtggtagtatatggattttatttatttatcttattttttttgttgttgtttgtaactctctgtatgttgctagctacgagtgtcgtcctagctggtggcaggtgttgtgtctttcattaattgttcatggtgatggactatttctattcaaggatcaaattaaattatttttttttgaaaggaggattatttatcagttcatggtcatgtgcaagtctcatgctgcaataaatatcatataccctgtaaagatacaaatagtatactatgtactagctactataaggagtatatgttttattcatatcttttgagaaccaattcagacttgattaaggtttatccttttttcattctaagtatttttcctaaaacacaatatacatatagaggctcatatataaacattagcacactcttattcagagttagagcatcccagcaactcgtctaaatttgatcttccatatagctatatagatggtcataaaaaaaaggaaaaagtacgaattactccctctcaactattgcacgcgttcaatttacccccctaaattacaataccagatatttttaaccctaaacttttcaaaccggacaaattacccccctaactcacctcgaagcggttttgatccaacgtggcgcacacgtggcggtccagtcaaccaaaaataatactcctaaaaaatagtggctcccacttgtcagcatcttctcctctcttctactttcttccaccttcccctcccatccatctctctctctctctctctctcaccaaggagcaagggccggggaacggcagcaacggcgtcaccagcgtgggaggagacgagcagcaggcagcgcgcgtctcgcgaccgcaacggcacgagctaggggtggcggaggacggcgcgacagtctaggctagggcggcggcagcgttcccggggtggaaacgggtcggcggcgggagacgcttggcagtgcggcaggcggcaatggtgtgcgaaacgagggcggcaagatgggacgcgaccttggcttccatcgacgcacaggagggcggccggacgttgtcgtcgtcgtccttgatgtggccgagctccatcgccatgccgaagacttcctgcaacctgcagatgctcctgaggaccacctgcatcacgatctggaccacgcagtactccatggacgccaccgactcgatccctcatcaaacagaaactatcctaccatgatccatccagccagagatcggtcaagaaccgaatccagtgctatcaaagtaagatcgcaacaagcaaccatgaattgattctagaatgcaaagtaccgattatcagaaaagaacgagagcaatgcaatagattaaaagggaggctagcagtgacggcaaagatgccaggtcggcggctgcggacgagtgtggcgctggaagcgcaggtgcttctggtgggggaggatgccgccacggacggcgcggggacgacacggggagtcggggacatcaccactccggctccgacgaggtaggcagaatgggctactgttcctcgacgtcgaggcacttgcacttgcgggcggagggtgaggggtcaacgaggacgaggagcgcggcagcggcggcgaggtggtgagtgagaaggaggaggaggaggtggatggtgggagatggagcggcgtcatcggtggccgtggcacatggtggtggagactggagagaggtaggaggggagagatctgacgatgggccccaccgacttttttttaatgaattgctgactggattgccacgtgtctgccacgtaggaccaaaaccactccggattgactaagggggttatttgtctagttttaatagttgagggtgtaaattaaatatctggttttcgagtttaaggggataattcggtcgaccgtgatagtttaggggggtaattcgtactttttcataaaaaaaatttcctcctttatatttctctccacttctacagatcatccatattacatcatctatatcacatcctcaaatattttaagagtatcttttaactaccatcaattaatattaatttttctttttttttcaccattatccttctctttcactcccttctctttcactccagaagtccagagagcttgagagaatgggaggacgcgagcgaaggacggaggagcggaggggcacgagcagctcgccgccggtgggagcggaggggcggcgcgagcggctcaccgccggccagagcggaggggtggcgcgggcgaaggggcggcgcgagcagctcaccgacggccaagcaaagtggcggcgggagtggaagggcggcgcggccgaaggtggtcgacggcgggagcggccgacgaaggtttgcctcatcctctctccttgatctaccttcattacttcaccctctgcctcgatctcgattcggatgggatgggagaacggatgggagcggtggttgcgggatggcatgaggagagagaactctgggaatagcgcatgcgccatctatggaggcctagagggggggtctaatgggcgatcgatcgctagggcgatcgcccagtgatcggtccacccccccagctcctatagacactcctcccacttccccccttcctcctccccttcttctcttcctatcagagtacaccacaaaaaaaattaaaaaaacaaaaagttagaaaaatttatgtataaaaaatttgaattcaaattcaaatttgaatcaggtatgtaaacttttgacttgtagattttggatctataaactttaggtgtataaactttagatgtatagaaatactatatatgaaaaatatttgaattcaaattcaaatttgaatcggatatataaactttaggtctataaactttagatgtatacaaatactatatatataaaatatttgaattcaaattcaaattcgaatcggatatataaatttttgacttataaacttttggtctcaactttagatgtgtaaacttgaggtgtataaactttaggtgcataaatttactaaaataggaaagtaatacggtgccaaaaaaggaaaccaggtggaggaagggagggggaggagggagggaatcgatcgctcgctcgctcgcccagtagcattcccgaggcccagatggcgtatctgttggagccggattttctccccccatacactattttctggatggaagatgggatgccggaattgatgggaatgctcttagatcgcaagttttattttttattctagtattaagtaagtgatgcatcattggttgatagagatgcaactcaatatgaatcattgtgggcagcacccatcagggtttcccaaaccgccggggccagggttaccgcgccccggcggtaagcacggttaccgcgcagtaaccgcggtaaccgcaaaaaaccgtacaaaaccgtgcaaaatttatcaaaaatttaaattattttttaaatttatttgaatttaaggaggttacaacggtatttatattaccgtacccccgcggtaagcccggtaaccgcgataacctcacggttaccggcggtaaggtaaaccctggcacccatacgacctaaccatgtcaagattcgatcggtttttcccttttagaaaaaagtaagagatcaactacacttcatttcattaagaaagaaaacaaaccgcccatatttcattttttaaaaaaacaaaccgcccatataaccaaggcctcacgagccattcattaaaaaaaaaggctcacaagcacttcgtcaagaacttatccacaatgagcatcacacaagacgacacataattattttctttttttagaaacaacgcagacactcaccttacccctataagcatcttcaaagactgcgcctcactgttgacaggtacgtcgcctatcactaaaaacacagcgccgttaaatcctataaaattcgctctcatggggagtcgaacctaagacctcaggtgctactgaggcttttgtaactattaggctattaggctacagtacggttgtctccgctatagacccgctctcaatcctctgggctatgataaattgataatgggaaacagctagcgccgccggaccggctggcctgcatcttatgatagatgttccatgatccaagcacatctacctgtagttactgtacaaacgaaatcattaggttatatagctcatcgccaactagccaaatccctactcatcttaaatacacaattactccactaattaggaccatctaaaaatatcttgagctagccgcaatgccaactcacacacagagaatatagtccctctgatatttagaagggctgaatcagatgttcctaatgagactgcatccgcattattaactaataatacagcaaattaatacaagtacagtgcgacgtcccattcgcaaacaaacagcagtgctctgatcaatcaattaacgaaaaaggggatatatgatcccaattgatgtgctgttgatatgtgctgctgtgatgccacgtggagagggagagccagacggatggtgatggtgacacattcatttcaagcctaatcctcattcatttcgtatcatatataatcacaattgctgattgatgacaagttaattaactgtactatgtatgttgccagcatcgatcgtagacatgcagatcgacgcggtccccgagtggatgcaaattaatgcctgcgccattttctttctgctatggtcatcgtcgctacttcgtgttttaggtgtagttgagaggagtggaaattagacaattgagagtgtcattaacatataattaactaagtattagttatttcttaaaagataattaatatgaatatttaaaacattttttctagagatttttaaaaaatatcatttagtaatttagtaagcgtgaacggcaacgggtaagtttttcctatttttgtgctattggcgaaagcagccctatagttttgtctgaaaagttaaataactatagctggtaagtctatacaaaatcgtgacaaacatatcaaattagtttaattaaaatcaacgataacaatacctatttcttgatatatagtgtattaacttaagtacagtagatgttaactatatatttatagatttgctccaagttaattttttttgacgtagttcaagactagaacaacttgcattttggaatgaagtatccggtttcttactgacattcgtctctctaattaagcatgtgcgaaggagcacatttttttgtacatattaatttgatgtactttctctgtcataaaataactttatttttcacataccctatatatatatatatatatatatatatatatatatatatatatatatatatacacacacacacacaaataaaacaaataaaattttctttattttataaaatcctaatacaattttcttatgtttatttttttggttttttgggacggatggagtaagttgctggtgcgcacacgccctgctcatgtgcaggttcacctggccctagccctggagggaggaatggggcaaaacttgtaacgaagaaactgcttatccatatattatgacaccatgatttaaatataattagtatactatgacattaataatagacacgttatgacaccaacgaaacgattttctggatccgccaatggcaacgagacagcacggcgacgagccaacgactgactaggtagcgacgaatcaacgaccaacgatggcagtgcggagacgatgcggtgcggccgcgaggcagcatgccgacgaggcgcgcggccggcgacgagacaacacgatgatgagggggaccagcgacgaggcgagcgggagggagaccgacgccgtcgtcgtgttgtggtgaggaggccacacaacgacgcagacgagcgagcgaggggagtggacgggaggttggctacggcgcgggtggcgcacaacgacgcggatgagcgaggggatttcgctggatatgcaccattgagcatgtatcgatgtataagattgattgatgataaggcatatgattgattttaaatcataaggcataggtttccttatatgtgtacatcccttcatccgtttgggcctatggagtaacgggccatattaacatagacatagacttttggggcctcatagggtcacctgcgggtcagctttcatccccgccccggccccggttatgttcagggccccgacccgatcgacccgcgggttaaaaattgtccccggccccggtccgcccccaccggcacgtcagcacgcatgcagtttgctgtgccatatgggggttattatcaggtctcaaagaccgtgtttagttgttttggcaaaaaaatttgtatatacggacacatatttaaagtattaaacgtaaactaataacaaaataaaatacaaattccacctgtaaattgtgagatgaatctattaaacctaattaatccgtcattagcaaatgcttactgtagtaccacattgccaaatcatgatgtaattaggctcaaaagatttttctctcgtaatttacatgtaaaaactgtgcaattgatttttttcatccatatttaatggtttatatatatgttcaaatatttaatatgtaacagaaaagttgtaagtttaaacggaactaaacacagctatagccgcgccgcgtcttgtccgttaacggccacggcactgaggctttttgcagctatagctgtcgtggcggccgtacatataggagacggacaaggggaataatggatgcgccggccagtggggagtgaccggcgcaaggacagcaatggccaatggttttgatggatcactccactgtccgtcacttcatcggtatgtggttgtggtgtactgatatattagtgcatttgtgtcaggattattgataccacatatctaatattagttgactaaatatcggtaggacccaccacataccatgtgttatacggaaacaaccttcggatgcataagaaaggatgaatagagttctacatgaaaacgacaaggactactcagattgtattcatattgttttccctagttctacttagacaaagtgacatttatgggtataaatacaaggccccataggaggagaggggacacggaacaatagatcaagacacaagatcaacatacaagccaacatgcgccaagacaagacgccggatatcgacttcagagataagcatggctagtcccctacggtatctacggatactgtcaggagagacatagcgctgtctttgatctcgccggatgcagattcgaggagaaagactaccttgttgtcgactacgagtcacacttcagaccgccaaatcaacaacagttagataggctaccccaaatattgtactggtgtgattatggtgaataagagcaacgaccggcttcggccaacaggagtagggttattacctgacaattcagggggcccaaacctgtataaaaatcctcgtccacatctcttttattataatctcgcatatatcctagtaccaacgatccctatactatgtaaatgaaattgcgacatcaaacgtcggcaatatgaatcgaaaaaaaaaaggagggtttggcttacttatctggactgtttaattagctcttgcgttgagatatatgatatcatgatcgaacaagagaggcggggctagctgtaggcatgtatggatgcacgttatctatggtactgtttactgatatgtaagtctcacttgcactctctctctctcgactgcatgtaccaagatgcatgcattcccttcatgagttgatcatatcaaaatttggtcctgccaaatgattgttactgttcagtagttagctgttgatttgagctggaattggagcttatgtacgtcgaattgaatgtgaagaggcggccggcgtcgcgtgtgtatatatgctcactgctcaacaccgtctcttttaatttcgttctgctgtactagagttatgagagactgtacaccgtactcatacataggctgtgtttagttcacgtcaaaattagaagtttagttataattgaaatgatgtgacggaaaagttagaagtttgtgggtaggaaagttttgatgtgacaaaaaagttataagtttaaaaaaaagtttgaaactaaacacagtcatattcccgtaatgggcagcaatgatgggcgtggccgtatttggttatgaggttgatcagtaatcaggcttaagacaaaattgtcattaaaattttttttgtcagcattcgaatattttggagtaatcacgagacagagcatcaccgggttcgatcttcacgtacctaaattgcaacaaggaaactttgaaaaagacgtgccatcaacaatcccatagccccatactctcgattcatagcccccacaacccactccatcttcttcctctcgtcgctgccccatgccgtcttctcccggtttgtgatagctcatgccgtgtttttttcattgagttgaaaacttatcttccgcgcacttaaaatagagcgactcactgacacatatgattgattaagtattatctggagtaacttttttaaaaaataaaataaattaatgtgatttttaaagcaactttcctatataaaatttcttataaaaaacacaatgcttaatagtttagaaagcatgtatgaagttgagaacagtgagaaaaaaaaacacatccgtcaccatctaaccagttctttcttttattacttatttctgccatcaccaaggccgtgtttagtttcctccatattctcaatttttcatcacatcatatcatatcaaaaacttttctacacacataaacttttaactttttttccaaacttccaactttctttcaaactttcaacttttttcaggatctaaacacggacttttaggtacattctactgctagtatatactactagtatatttgatctaatggtgtaaattcatccgatcttcctcccaaatatcctgcagtataaattatttagagtatatttgtctttttatctatttgcgtggggggtaattttttaaattcgtgtttcctcacttggtcagatccgatcgatagccacccacctagtcgaagcccctttttttctcgatgctgcgcgcatgggcgatcatcgctgctaatttcttctgcgagctgccgacgaccacaatctgtgccgccgcgccgccgttctttcttaattaagttcaatgaattaaggactgtatgtgttatggattcagacacttagaaactgatcgaaccaagaatgtatgagataatccacttcattgctatgaacagatcaaatctatttacactattatgtggttttatccctgaccagttttttccctagtgttcttatgcaaatcatgcccattgcaaactcaatctactagattaaatccgatcgtcgaaggaatcgctatgcctccactcacgccgtcgccacgcgcgatgggagcgctacaacacccggacaacgagatccaggaactcctgattgaattaaatcgcaagaaataaatctcaatttcaaattactaaacaacccttttcagagttttaacaaataacaaatctaccctttcacatactactagtatatactagcaatagaatgtactataaaaagtcctcttcgtaaatacgaggaatcaatcgaacaaacccttagaaagaacattttctcactttacctgctctctctgcttagtatgtgtttggatggagggttttgggtgtataagacatggcggtctatattttttttaggtgtttagttgctgggcaaaagtgggataggacggcccggaggagaatattcccccagatgcagccgcccaaggctcgggcgagccgggcgagcgaccaaaggagggtcgcgtcacccctctccaaaagcgagaacgacggcgacgcagcggctggtgcgtgcggcgagggcggcgaccaacgcgagacgcgagagccatgacggcgggaggtgagctcgacggcggcgggaagaggggtcgacggtgtgcccggaggcggcggcggcaggaggcgagctcggcagcggcacgggatgtgagctcggcggcggtgggaggagagcgaggcagccaaggcggaagaggggccgacgacgagcgggaagaggggtgacggcgagccggcggcggcggcaggatgcgagggcggcggcggcgagctcggcataggcccgggatgcgagcttggcggcggcggaaggcgagcttggcggccgacgcggaagagggggcgacggcggcaagaagcgagggcagcggcggcgtgcttggaggctctctttttttccccttttttctttgttatttttctttttttttctgtgtggatttgtaatcgggttttgggtctcgccccactcacgttaggagagaaggtatccactaacccaccgtggcagaaaatcaaatattgatttttcttattttgcaaaatatgttcactgcgcggtcttggtggcgctatgttctgcatgcaaggccatttgaaagttctgcatgcaaggcttgctaatccgcacgcatacaaggccgtttgatcaggaagttgttagtgttgaggttgttaccaagatatctatttaaaacggcggcgaggtaggtcagaagaggagggatttgtgagcagaagcagatcagttctgcggaaatttgatggagcataatcttttgggggtagagggcagaaactcgtcagcaagttcagaaggcggaaccttgtcgacacatgatgtcgcatgcagaaggcggcgatagccgttggttcgtccttgccggcgagttcaggcgagcaccacaagccgacggtggaagaaggtggaaccgcgtcggcgtctcggcgagtggtgacatgcagcagaagccggcggtggcgaaaggctgatccttgccgacgagttcttttgctcagcacaagcgggcggtgcgggaggacggaggtctgttgaatggacacgagtgtgtgcagaactcatcaactgattggtacatatcgaagattcaaattggttgatgtctgtttataattttcctcttgtttgtgtgtttggttctgactgtgtgttgcgttctttggtcaggaatggttttgtgcaactgtgcattgcatggctactggtgataggagtgaagtgatgaatcgctctctccagaaatatgacatccatttccagaaatagtcacacagtttgcaacatgaatttcagaagctgcggagaacccccggcgccgcagaagttgttccgatcgaacatctaaccaaggagaacatttagccagttgtttaatgagcagatcatatggaataatggcttgctttctgcatgaccgttgattagtagtacgaactatctatagttatgtatgatattttctatgagagaaacgcgactaatatttgagttgagttttctgtaacttctactcgttggagtgaaataaaaataagaagttttccttcgtttttttttggctattttagcttattgtgttatccaaattctctattgtcatctttgtccgctatgccccatctttttgtttcgtagttgctgactgtcgtgtgaattggagcagtacaagttcttctgcttcttctgcggatgtagcagaacatggatcgtagttttctgcttgtgtttgtatttgggtttagagatgtagcagaacatggcgaacagcagaactgggagcagaacatgacttattatcgtccagcgtgttcgtttctggtgaaaacataaacgagagccaccaccacctaatacattcgcacctgctgcaggactgcaaatgcaaaatataaagaaaacgaattaggaacagaaacgatcaagaaaagaatccaaaagatgaaaaaataagcagcaaaccttagaaccggaattctccatatgctagagctttcatcgttatctgctacacagccgccggtgaggctactaatctgagctcagttcggttatgaaccatccaaacgtagagaacgattttagatcgataatgttctgctcttccttcacgacgggagaaatatcctgctttctcgctgtggataaacaaacataagtgcaaaaaaaccacccggatatatctcttgttagctcgtctccgatcaaatctcatatctacaaactagggaggctacgttcaatttttgaatctgctgtagaagataagttaaccaccgagaaaactaaaaacgggtgggaatattcgattcattagacccgttaacagtcattagcattatctagtgctagcgatcgaattgagggaggatagggagggagtagctactcccggtagtagtttctaattttcatatatatatgaattttttatttgttgggaaatttgtgaattgcagtatatatatgaatttgatggggtatactcaccctctctaagtgagaggtgaccacatctgctcatccaccctactccctcgaaccaaacaaaaaattagatcaccaaatccaccttcatcactgcaaccaaacgaaaaactgtatcgccacattcacccaaccaaacaaaaaactagattgccatatccaacaaaatatggatcaccatatcccatcctgtcttgaccgtgaaccaaacacacccttacttcctgcaaccgccgctccgatcactctcttcccctgttgctggttctacccgtggctcaattatgtttttttacccaacttgtcattattgtggattattattataaattgtacatggagcgttatttatgatctttatcgtctatttatatgtgtttagatgcttaacatatatataaatgtggtctatttatatgtgtttagatgcttaacatatatataaatgtgggcaatgctagaaagtcttataatatgaaatggatgaaacggaataagtactattttgtaatgttcaaattacagcaaacgtcacaccaattattttccctctgctacaaaatttttcacacttcctaactttccaaaatttgtttgcaatttttcaatcctaaaaataccttctttgtgcgaacatatgaaatagatcgatatttgtttggctactgtcattgctaatttgctttgaaattttttttttgggtccaaaccgtgtagttttcgccagaaaccaagcatttgcacggcttcgtcatatttcaaattgaattggatctcttcaacaacgaaaaccacaattcagacagccagttcttccctcactgaaccgaaaatgacactgccgtagaataaatccctcgcttaacgattatattacggaatgtccattgtaaaatctatatacactgtgtttctcggaattgatacccgcaaagggaagctcagacatcagttaaagagtctgtaaacaaaactttttgacgcagagcaaagatgatgctgacgatatgattttgtagtttactgtacaattatacaacaagagctcttttcgagctgtgagagtgtgagctactgagcttagtggttccgtagatttatatgccctctgatttcaaggaaaaccccatgaaccccactgaaacttgtaaggggccaaggaaaagccgaaaaggaaagtatatatatgtatgttactactcagttgttgcattttgcttctcttttttttttgtggtcagcattcacaacgaaatgcagagctagggaaacatctattgtcgggtgctatctttctaacattaatctcgttcattgcccggatcatttgtggggataggtgtatcctgtccatcaggtttaccttgggggcatcaaggattgccttgggtggagaacgtgcccattgcattgcccaaatggcgagaggccgcatgtagatgagcgacctgtagtgcccgtctatggtccagccttccggtgtttggaaccaatacctgcaacacagcaagaaaccccatgttatctatatcacaaagcaaacggtggttgaaacaagagagcatcaacaatatctaattagtatttttaatgaaattgtcagtgagaagtagaacggtattcataagggagtggtttaagagaggtgcgccagagcaaaatcgatgcgaagcaagttgcattgttgtgaattgcgaaatatgagattattcgaagaacaaggtagtgcttacccatatccttcttctgaccaaccagcaataaaaattccttcggcagtggtgaatccttgatgctccattccatggagcagcatgtttgcagcaacaccgtatgtaacaccggtccagatttcccgagattgcatgcatgtctcatccactttcccattaggagtcataccatttacagctcccaatcgtcctcctttaaccttcattacattgaattcaaatattttctgcagagcacttcttattttattctcatcgaaaagcgggggcaagcctgaagaagcagcataccactgccctgccagctgatccgcctgaatagatcggctattactgcttgtgccactgtcataattgaagtaagacccattccataacttagcctcatatactgctttcgcttgtatgaatttgagcttgtatttttcagcaaatggccgatcaccaagccgatgagccattgtagctgcagcctgaagtgcagcaagccagagaccgccacagtaagcactaattccgtgtacagtccaagcatcataggtttgatcaggaaacccatcattcattcgtcagatgagagcgcatcgacacgtgcacggtcagacagttgattgcagtaatagtcgcatgcatctgcactagacggtcaggncnccaagacattctgctacgcaaaatgagcatatccacctggtagacagcgaaagtcctgctgtatactctggagccacaaacttttggatttaagatcttctccatttgctgtgtatcagtgtatgttgtacgncattcatttcagtgccnatggacctatgtgttctnaggtcatgcggaacggcacctttgaccttgcgaattccagaagtaccatcagccaaaaatttcattcttcgtctgtcttcatagagaacagcattggcaaaatcacgttggatactcaactctattttgggaaacagatcaagcagagcaaaagaagcatagaaatgcacatcataggtgcaccacatgatgtattccactccttccaggtacaaaaatttgccaacattttcagggccattcttggaaagcaagtatggaattggctcttgtgacccaagtccgttggttgccttagccatttgtggtccatgtactgctgcatactttgacacactttgctcttcgccattagccaggtcaccaccattagtgacttgctctgctgtcagtttgacatggttatctttaactgattcctgtttagtgtctctagtgcccctttttgaagatttctgttgattagaaccaggacttggtttttcatcgataactggtggttggccatctacaaaggtgatgctaaactcaggtaccgcaaagaagtttcaagagtaaaaggtgcaattttaaaaattatcctaacgacatccagattgtaatttatgatgtacaactgaacaagcacaaaaaccacaccattacaaagttgaatgaagcatacctgtccaaacagtacccccagctaccagaaagtaaagctcattaaaaagtgtgaacttgtacctgcaagcaccatgaaaccccaaatattctagttaagattttgtttttctttgggagatttagatgtttactgccaaagttctttactgaagaagtagaacacatcagttcagaaagaaatatagaactaaggttgtaccattctggaagtttttcattcttgagtatggggttttgccacttctcaatctcctcttcccaaatcctatattctgcaaaaaaacatagaaggaacatccaacagcgtaaggtcagaaaccaaggaccaacattgcacatctgtccctatcacagcatcatttaactttgttgagaatgtgtgaattacgacagcaacaagtaattactgcattgtgtgtgaatgtgtacaagattaagatgtctaagtgact

SEQ ID NO: 74952 - DNA, 923 bp, Oryza sativa
  unsure (1)..(923): unsure at all n locations
ctgactgggccaagcacttgattggatgaggcctcaggcagctgggtaaaggccgctggcttcaccgtcgtccttttccccgtcggcgttcgcatcaaccttggtcggggtcggattgggccccaccccctcccaccgtcgacgttttgggggtcagcgtcggcatcagcctcggtcgagttcgggctcaccccccctcccccttggcgcacaagtaagccctcggtcgagtttggcattacagtagcttttttagcaaaacatttgacaaacccccggcgcttgcagttgcaggttgcgtcccgcggcttcctagcgcaccctgtatatacaagggacaccggcctctgccttaccccaaccaccacaccaatctcctcccatttgaatcctatctaacaaatcgcatcgcccaatcggatcggatggcttccgctgccaacgtgaaacttgaggatctcggcgccgccgtcgacgagctcgaccagatcaggcaagtgcttctcctcctctccccttcaattggttctagtcagcctcgtacgtgaccattatttcatccccatttccttgttctgatttcccacccgtggaagttatcctccccggtacacagccaaagattttnngatgttaatggtggtggtgtttgcagcagcggatcttagagctcatcacctcgtggagcacacttcaagctcgagcgttccaagctcggtcatggacgttcaatcactgcttccccaagccatgaccatgagtatctccacgcctgagctgctcttgcccctcggcgaggggactctggacgacgtcgacgacctcctcacgcgcgagctgcgcgtgccgttcttggctctgggcgccgccgccgcgccctactccggcaacggcagcgacggcggaaaagcgcgcgagcacgg

SEQ ID NO: 74953 - DNA, 613 bp, Oryza sativa
aagctttggagaagatgtcttaggtggagtcctggcttataccccagttgagcgcctgtgaagatggagccgtaggcccggtagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgagcgggaaaaggcaattttcccggtcgcgacaggggtcgatggacattctccagggcaaatgaaggctacacgagctgcggcccggtagtcgagatgtcatacggcagagggttggtgccctgctgctaggggctcagtcctgcctgcctgtcccgggggttccggccgtaggcgggattgggtcggtactcttgtctatggctaggatgggttggaaactatgtcacgtcttcggtctgtataccgtggtggtatgtggcacgtggttacacgtgaggaagatgtgtcttgtgggtaaagatgtacacctctgatcagagtataatctattcgaatagccgagccctcggttatgggcaagccgagcaatggacccaagtcag

SEQ ID NO: 74954 - DNA, 8045 bp, Oryza sativa
ctttgagtgtgctgggccgttgttgcccgtgtaataattttatatacgcttccgcttgttaaactctgtattgtatcaacttttggtgtaccttgcctcctgggacaaggaataatacacgcacgtcgggagcgcctgttgggtgatttccggtcgtgacagcatggttatccgactggttataggggataacttatatctatgaaatatgtaacggatcatgacttgggtattacgttttcttgtatattatggaacggcctaaagtcctggtttgataagattgtaaagtagatttaggaaaccaataccgtattggttaaggtttctatcttgtaatcctaccccccatcttatataaggtgggcaggaggcactctagggggcacatgccacaacctgatcgtcagatcaatacacatccggcggattcaaatccccaaacaggagtagggtattacctctcattgagagggcctgaacctgtctaaatcttttgtctccgcatccatccacttttaggtctcgtgcgctaccccttttattattgccgaattcatgttttgacagttggcgcgccaggtaggtgtgcgtcgagtttttctgtcaagaagtgtgatggaatcatcctgagtcgccggcatcatcctcgctttgagtttcatggattctgccgccgtcgacaccatcttctgatcaaaaatcaatctaccaaagagacatcggtcgagatgctgggcgaacacgccggaaggactatgctcaagttctattcatctcggattcaatttgattttcgacatcacctattcaagatcattaatcagatacatgccctgtcatcggaatctgatcactatcaagccaagtcccacacgacggttatacagtgcaattcagccgtcagcaattcagttcctatcttggacgtgaatgtttgactggctttgcatgtcgctgtacataccagcaagaaccacattaatttaattaaatctggttggatccatgcgtatacatgcacatgcatgcaagcaggagcacttcatcaagcacaagcaatttttcaaccagatcaggtcaagctgtgcagataatacatgctacaattagttcggactttgtcgccgtcgccgaaaatacaagtctcatgaacggttgagtccgattcataaaaggacacgttttcacaactagattgcatgagcatggattggtcgggtgatgcgtggatgtatctagggttcgagctacaggtaaatgtacccgcgccaattgcctccgtcgccgccgactggtctacccgcctacacagttggttggtcacaccatcattgttgggcgtctaaatcttcaccgccggctggccttcgccgctgcggactggtgtttctgcctccacggttggcctattatgctgccgttgttgggcgtctatgacttcactaccggcctacctccgtcgccgccgactggtgtcctcgcctatacggttggttggtcacaccaccgttcatgggcgtcctcgtcttcaccgaccggcttgcctttgccaccgtcgactggtgtttctacctgcacggttggcctattatgccgccgttgttgggcgtctacatcttcaccgctggcttgccttcgccgccgtcgactggtgtctctgcctacgcagctggcctattatgccgtcgttattgggcatctacgacttcaccacggcctgcctccgtcgccgccgactggtgtcctcgcctatacggttggttggtcacaccaccgttcatgggcgtccatgtcttcaccgaccggcttgcctttgccgccgacgactggtgtctctgccaacacggctggcctattatgctaccgttgctagatgtctacgtcttcaccgaccggcttgcctttgccgctgccgactggtgtttctgacaacacggccggcctattatgccgtcgttggtgagcatcttcgctttcaccgtcgaccgcttttgtcgtcgccgactggtgtgttcattgttattgatggacgactttgttcccacattggccacctctgccatcaccaaggggaatattacaaagctaagtcatcattaattttcttcatatgatattttccttttcctctgcctcactacatcaactggttcgccgttgactagtgagtcgggggctacagatgttatatcttatttttcaataattttcataatatttatcttgattgcttgcgaaataatccagtaacagtaaagtgcctatcgagttatgaagttctatcttcctatgctttccgttgggtttgtcaatggatagttgcctttgggttgattccaagcacccgggggctcgttggatggaccgagtaacacaaggtgctaagtattactcggaataaatcaaaagcattgtcgcgaccgagaaaatttgcattttcccgaacgctagtgtattagtccccgtcccaggaaaagccggggtacaccacacaaacatgataccaaaaagcacatctttattattgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcttaatagggttccatttgcaaaagcagcttttagcaaacatttgaaaatttaacaaaacagttaagtatataattaaacaatattaatccaacgctatacaacataccctgttgtataggcccaaccattctgaacaaccaccccggctgcacagttctatctccaaaccaggaatataccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaataacccaaggtatcaaggaataaggtaatcaatgtacaaaagggccataacaaagaataggtcaattccacccaatgacattcaaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgcgaacggacggccgagattgatccgatccaaatcggacggccgaaatcgatcggtctacgaccggctcacgggataggatcccgatgacgtcagcgatgacgtcaccgacgacggcggcggctcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcagacgaggacggcggcgacttggcgatgacgacggcggtcttcccgagcggcggcgacagctggagcgacggcggagcacggctgaagcggcggcggcgacggcgaagctagggcacacggcgctagagctcttccgacgacgagaggcgaaggcgagggtggcggcggaaagagaagagcacggggatccttttaaaggggctcggaggcggcggcgaaggcccacggcgacggcaacggcgaaggaaactttcggcttggagagggggaaaaccgatccgattcgaactcgaatcaaactcattccaaaccgattgagccaaagattccaaaggagaaaaagtagaggagatcccggagattgtttcccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggccgaggagagagagaacggttttgggccgactttcggcccaaagccaaaagaagactttttaaaacctttttcaatttaaattattccttaaatgcaattccatttattaaaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaattatatcgataatatttacattattacaaaggcgcttcaggcctggcaatcaaaaataaacagcagcggactagcgggcctacggctccatcttcacaggcgctcaactggggtataagccaagactccacctaagacttcttctccaaagcttctcttactgaaggggggaaagattgagcaagaatgagtacgaccacagtactcagcaagccacaccggcagatgcatgattaatgcaaggggggtacaaggggataataatatcggggttaagttttgcagtaaacagcatttaaaagtcacttagttgcccaaagctattttataaagactatcctagagctacacagtattattaatcaaggccgtgaaccctcacgaacttgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccaagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttcgcaacagaggctcgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttattctagggtgaacaaggtaataataacaataacaacaatgataaggtcataacaaaggtaaataggcatggctagataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctctggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaggctttgcgactataaaacatgtggaagcgctagcctggaaaagacaggaaggctgcgctgttgacatgcggaccccacatgtcaacctaaaggaccgcggtagaccgggtacacagagacggtccacgggtcgacggaagcggaccccgtgtgtcaaccgaggcgagtggccgacaaacggactctactagacaccacacgggtttcacacgtggaaacaacgcggctaccaagcgggcacactaacacggacactacacggacaagcgaacgactaccgataccgatacacggataccggggccgacaaccgcacaacgggcacgggcgacaccgaaaggacgaggacggggcagcgagaggagagatccttaccaccacgcgacgaggcgaggggacgacaacgacgaacgggcgcggcggagacggacggcgagggaacgacttcagcggcgatccttggacgaaggcgagacgcggccggcacgaggcttgacgacgcggagccgaggacgaagacgacgacgggggctgcagcgaccttgacgaaacaccgaggacggacgaggacggctgacggagggacgaatgccacaacgaccgggaacgacgagaggacgacgacgacgacgactggggctggcgaggaggcgacgagggcagccggcagcagctgcacggaggtgaggacggcgtgggacacgccgcagcgatgcccacgacggtggcagcgcagccagacgacgagccgggcgagcgaccggaagtcgacgacgagaacgaacggagacgacgaagatgg

SEQ ID NO: 74955 - DNA, 3993 bp, Oryza sativa
ctcaacggcacccgctgattacgcacgagcgttgcaagaattttctgccgtcagtatggtgattcccggccaggcaccgccacgtgtcagtttcctttccaccgggcaccgccaattgtcagttgcctacccccacacaacacacacaaatcccactccccagcacaccaaaagcccaaaagaaacggttttctcctccgcctctgctcgatcgaattcaagcgacggatcagaagatggcggtggagtccggcgagttcgtggtcgtgcccctccttgcgcatccccaggacagcgcctccgagccggggcccttcaccgatcaccgcgcgccgttcgccaaccgcgacacacgggcacgcttgaccgtggccgtggccgacaccaacggtgccgacgtcttggcgcgcgagcgcggcgtgccctcccgcgaggccattcgggttcagaaccgcactccgcctagctgggcgtacgtgtccgagtccaacatcctcgcgcgtgagaccggcgagcccctcctcctcctcgacaagcaccgcactgccggagtgggcgtggccgtcggcttcacgcgtgagcacggcatgtcattcggtgatgccctcctaggaaaagaatctccccgccaggctctgcaacccttctatacaatttcttttttttttcttttacataaaacataccgtttaaccgtttgaaaaacgtatcaacggaaaacaagaagtatgcaaactcgattagctatttaggtaatggtggtcgccgccattgccttcgtcggaagccggtaacggacaacatgaaccgcggcggcggatcggatgagcacaacgacgtcacctggtacggatgggtcggggcagaaatctccgaacccaccgacatctctttgacatagttgggctgctcggcggagttgggccaagcggtaacaggctatctagggggatgcccaccaaagtgcgggcctatctgcaaattatactgggcttgttttgccagcttaattatcgattctcctgtaaatcctgccctaggtggatctgcctacaattagctctatcttttggtttactatgtttgtaagccaattttcaatacttattttaagttgattttgtggatttttcatcatagtttattttacagtatttgcttgtgaatcactctgtacacatatataaagatcttaataaattatattcttagttgataatagtcatttagacatgcatatgcataagcgaaaatataatagtcccttcgtaccataatataaggtaatatactattccctccatctacttttgatagtcatatttcatcttgacacacagaccaaggataagtaattctacttatcatccatttaaacatgctattagtcatttctaataaacaagcgattcattaatatttacatttctcgatgcccatgtagccaatcttgtgtggaagaatggagagtcacgcattaaatccgagaaagttattaagatgataggttgttgaattgaaatatgcccatcaaaaatattttttttttcagatttggaaatatgactatcaaaaatagatggagggagtataaaatataagggattttgcaatcccaagacatcactttattcttaagggtagctatatttatgacgtcatatttctcactaaaaaaatagtcggcatgaatttacattgtaagtccctaaattacatacataattttaatgtatttataatataagtttcaaaattatatatgtaagtagagtgtaagtagtgtgtaattttattttaaatcaatgaataaacatactgaagtctatgagatgcaaattaattcattatattaactaaattaagtaggtggtcccactgctaatgaccgtacgtacatattgattagataagctatacatgcacaaacacgaatcgaactgaagatcgggtggccaaaatattcgactgtgatgggcaacaaaatgtgaccccaaatatgttattctttacctaccaccttttatactagtttacttaatccactacttttttactattttattcccccgcctatcaccttccgtactactttattctcctattcatcaccttttgtaccatgtcttgtccttttaccacttccttaattttgtaaaaatggcataattccttatattattagacggagggagtaatagcttggttgtgcttgctcatgtggcgtaatacaacctagcatctccaagcttgaccgtcaaaataaaaacagtccctcaaatcttttgctctatataaaatcagttgttgccaaaatttaattttagaacttgattttaaagtttttttaatcaaagtttagttttcaatactaacttttaaattgctaatgtcatatatatatatatatatatatataagttttacctataatttttattattttgctaatatatatgtcgcacgacgtattttcagcagacgcccaatcgatgggcccacaaaccgtcggtgctagtagcaggtgaagtggtaagaaatactgctaccactattttcaaatgtatgatggtaattagtaccgccgaaccaaaagattgagagattacttggggaaggcaagtgcgcaaggaaaaatagaaaaagaaggctatagtaaagaatatttttcacaacccatgcattggatcatgggcttcttccctaattaagagtttgggacaaaagttgaggatctttttctcgatctgcgatcacatgaagcgccaaaagaataatcccaagcatgactcatccatctttgatttgctctttgttgttcctcagatgactcagcggccgtgtttgtgaccagtcgtgagtagaaactagtataacgtagagtactaagtaaacaattggttcgttttcttggggagcaagagtactatactatgataaaatgattaatgcacacgcttctcgaatttacaagtagtgtggactttccatatatgagtataattttaaattaattttgtaatagttattatttattggttctctaaaattatcaaaaactattaatctattcaccattcatcatagaacaacaccccgtagcgctaacttgtgttattttaacactactagaaatgtattattgacaataacgcaaaccataggtcagcataggtcagcgctgatgccgatcaggtatcaaagatgtaaagcaagatgtctatctacgatattactgaacctgaagaagaaaagaaaggccaagatactaaaactatgaaatatactacttcttttcccctacggttataagctactatgaaattttgaattttaaaacttaattttttatgtttttttatcaaagtttattgcttaatgttgacttttaaatcggtaaggaaacatgtataaaagtttattcaaaattattgctaataagctgtaagggttatgatcaacatatggccactaataggagcctttgtttgcttgaagaccgtaagcaaccacttaaaaaatatttataggagtataatatgtacgtgcgtaggttgttcaaaaatcaattaacaacttttctgcaaggaaaatcaatttgcacttccttgcaaaaacaaagggaaagtacaaccactctagaacaaccaagtagtacatttcttttgcatgtatacaaaaaagatcggagggagtatctcggtggtgggtagagtagtaagtgtgttgtactcgtactagctagagtatatgcttgcttggcgccacgcaagctcggtaacgaaaacgacatactctacatgcaagaggttagactattgtgcagtgttgcctagctccttaattgtcatttgcttttagcattagccccttggaatcgactcaaaccgcgggaagaacagatcgatcgaccgcggtttaatttggcggcaatttgcacagatcagaattcagaattgaattgaggggatgcttcccgtccaccgggggacg

SEQ ID NO: 74956 - DNA, 2189 bp, Oryza sativa
ataattacaaatgtaaatacaataatcttattttcagaaaataaaacttgtttcatattaaaagatttgttggtcaaacatttttaaagttaaattttatgcacgatctggcaggtattgtaagattaatttactatatatacgtacaaccgtgactaacttggattttgattgtatatatttctctttagtctcgaaatgtataccaactttaatgagagacctccttttcactcgctcttgtggacacaacaaatagataccaacattaaactgtttcccagctgccctattaaaaatgtgaagttcaattttagtcaataacgaaagccctattgttgctccaaaaaaaagatttgcggcttccttaattaaaaatgtatatgaagtaacttaacagttaagattaaaccatttatgtggctgcagctactggataaggatatggatttagagagacaaattttattttaaaaagatcctactttctactgaatttaataaagcatatattaatttagataaaaaaacttacaaaaagaaaataacaaagagaaaagaaagggaaaagtccatttgatctggacagctggcagttaacaatgccctctgtactaagtacgtactgcccctaactacagagttgaagttatccttgtggaattatatggcatgacgacagacatgtgaccgtccactgaaggggattgctgctgcgcgcgtacgcgccagcaaaaaaagagctggcgagcactccctatttttagtcttaactacttaatatacttaatattaataatagtaattagaaaagattttgaaaattctttttgggagctttttttattaacagattaaaattttttgaagttagatttgaaaactttcgatttaagtttcaaattttaaaaactttcaactagattcgaaaactttcaactcgagatttgaaaactttcaactcagatttgaaaactttcaactcgagaatcgatattcgaaaactttcaagtccggatttgaaaattttgaaaacttttaacttgagatttgaaaattttcaactcgagatttaaaaactttcaactcgagattcgaaaactttcaagtccggatttgaaaatcttgaaaattttcaacttgagatttgaaaattttcaagtcgagatttgaaaactttcaagtcgagattcgaaaactttcaagtccgatttgaaaaaattgaaaattttcaactcagattcgaaaattttcactcgagatttgaaaatttcaaggccagatttgaaaattttcaagtcaatatttaaaaactttcaactcaaaacatttgaaaaaacacgtgctaaaagatttaaaaaagtaatatgaaaaaagcgcaaaaaaaagtgaaaagaaaacacgaaaagaaaaaacacagaagagaaaacggaaaaaccggcgctagcggaaaaaaaattctcgcgcgcgcgtgtgggccttgtgggccgggaatgcgctccggcaacgcacgcgcgcgagttagtaaaaccgtccactgaaaacctgtaaactatgaatttataacaattctttcggttgccccgtttctttttatttaaaaaaatcttgggaattcattcatgggcaggtattaataattaatgtacaccagtaattatcacagggagtggaaccatctttgtcgtccctttgtttctttggtaccaaatcatgaaaaggatatttataataggtaaaagtacgaattacctcctcgaactatcgtggtcgtccgaattatcccctctgaaccacgaaatcagacatttttcaccccaactatgcaaactggacgaattacccccttgacccaatccgcggtggctttagcctacgtagcgtatacgtggcaatctagtcagcattttattttatttttaatggtgggacccacatgtcagacccctctttctctctacccctctctctttctctctctcttcctctctctctttctctctctgcgcagggaggtggaggggatgggggagaggcgggcgtcggcgggtcgacgagctcggccggctccggtggcagcggcagcggcggcgatggcgtccgcggcgggacgtggagcaaggcggcggcggcgacttccttccccaccgtcgcggcggcgtggagctcaaacacgccggcactgtggc

SEQ ID NO: 74957 - DNA, 4729 bp, Oryza sativa
ccgctcgctagcccctttataaggacccccgagctctcctctacccgtcgcctcctttgccttagcctgccgtcgcgtctagcgccgcctccgcgtagccctagtcgccgccgtcgttgccgtcggttcagccgtgtcgcgcagccgttgcagccgccgtcgtcggtcgccgtcgccaccatcgggttcgcaaggtcgtcgccgtccccgtccaccgcttcgccaccgccgaagaccgccggagcgccgtctccgtcgtcgacccgatctccgccgccgcttcttcctcgtcgccggcgtcatccgttgttcttccgccgccgttttggtcaccggtgagttcgccgcgtcgcgctctacgtcttggtgctctccgtttgtgccgtagagccgccgttcgccggcgagcgtgcgccgtccgagccgccgccgccggtggtgacgtcatcgctgacgtcatcgtcgccctctcccgtgagccgccgtggacccaatcgatctcggccgtccgttttggatagggttgatctcggccgtccgttcccgtgaaccgctgccgtgcacccggtccaccgcaaaccctagcccgctgacgcaataatcctcctttttcttttcaaaaataattcattattgcgtcataattcaattaaaatcaatttaagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaatatgatctacatgtttgtttactttttatgtattgtttatttggtttttattagtcttttccttgttttgcgtgttagcttgtcgtttccgtcgttgtgaaggttcgcgagtgcgccggaagtattcaagaagattaattgaagaccgattattgcaaggcaagtcacacagatcctaaacccaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgggctttatatattggttcagctagatattagatatgattgcttagccatgcttagaaacattagcacataattgggataactaatgtttcactatcacttatggttatatttaatggtagctcacgatggtcaatcgtgattggttaattaattacttgccagctaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatattgaggctgtgtcttgtgggtacagtggtacacctctggccagagtaaaactattcgaatagccgtgcccgcggttatgggcgagttgagcaatgtttttcgtgattagtcccacacctctcacaataagtattgatgttataactggtaataatttgcttagctcctggtttggagttagatctgtacagccgggtatggttgttcaggatggttgggcctgtacagcatgggtatgctgttcagtgttgattaaaatttctgattaattactccactgttttacttctcttaatgctttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccggaaggagaagacgtttggcttataccccagttgagctgcctgtgggagtggagccggagcttcgctagattttattttccgctgcagttttcttcttggtgaggactaagtgcctcttaagtaagtatttatcattttagttaatttgattgtcagtttgtgtacctcggctgattcctggacgaggattttatgcacaaataagttcggaaattactagtgaatttccgggcgtgacatcctccaccgccgttgcctccctcttccgtctctcttgctcctccttcccgtcctcctcccaacgccgctccaactcccgacgcgcgcctccgtctgccgtcccccgtcctccccccgacgcttccggccatggccgccgacgcccgcctctcccctatcccctccaccttccggcgcgccgcgtgcgcgctgattgccggcccacccccgcgccgccgtccattgcccttccccacgccgcgccatgcgtgccggccgccggcgtgagcgccgctgccgctgaccgacgaagagagagaaagacagagggaggaagagagaaagaggggtctgacttgtgggtcccaccattaaaaataaaataaaatgctgactggattaccacgtgtacgccacgtaggccaaaaccaccgcggattgggtcgacgggggtaattcgtccggtttgcatagttgggggtgaagaatgtccggttttgtggttcaggggggtaattcggacgaccgtgatagtttgagggggggtgtaattcgtactttttcctttacaatatgcactatcaagtgcagtagtaagcatatttattagaaccggaccggcgggttgcctagaaaaaaacctgaaccaggacgttggccggttcggcctagctaaaagatcggtcagcaggcggtttttttgccgaaccgcacaaaaacccggaggtggttcgaccgctgagggggcgaggagcagaaactacagccatcacgtgaggttagagaaaataaggagaaaaccgctgcctcgagggatcgaacccaagacctccatgttcccgtgaaaacactaatccatagcctgttgatgtagtattgtaacacacatttatttaaacaattttaaaccggtggtttgaccggtcccacctacagaccagtgaaccaagtgccctaaccgttcaatcaccggtctggtcttaataaccatggtagtaaggctgtgtggttaactccaaagtttcgtgttcaattcctaacacacttatatttttttcttagaaaatgtttgaagcgacgtctctccttccaaatctcctttctgaaaggagctttacattattttttaaaaaaataatggaaattgatgaaaaggagagaggtttaaatggtttagttttacataatagcacaaattagagaatacccattggcttctcccactaaactagtactctttccttttcttttctaatatatatgacattattgatttttatcataacagtagaccatttgtgttatttaaaatattcagtatgaatatataaaagatataagtaatgcttcaagtttctttaataataaaccaagttacaataaaatataatatatttagctaaatatttgaagtatgacaactaatcaaatgtatgttaaaagtcaacggtgtcatttattagaaacagagtgagtagttgttaaaaagaatcaattacaacactctttcactcattcatgtgcatgtggcacacatatgcctattcatgttatactaaaaccaatatattgacatgatgtttgattaattcttggggcagaaagaaaacgaaaggagtgttgctgcatcaacgtgtttgaactaacggctcatagagataaacttttgcttttaatggtagctagttgtatgcattgttcaggaattgatcagtgaatgggcgggcccagctcaattcaagggtattcaaatgaatacccaagatttttagacaaaaaatacatatacgaggtatatatttcttatgtacgcagagaaataaagaaaaggaaaaagtacgaattacccccctgaactatcgcggtcgtctgaattaccctcctgaaccacaaaatcgggcattcttcacccccaactacacaaaccggacaaattacccccctcgacctaatctgcgatggttttggtctacgtggcgtacgcgtggcagtccagtcagcactctagttattaaaaaaatgtgggacctacctgtcattctcctcttcctctctctctcaaacaggtcagcggtggcggagcgcggggaggacacggcggcagcgggcggcgccgaggagggggacgcggcagcaggggaggacgcggcggcggcggctacggcaggtgacgcagaagcggcggcggtggcggcgggggacgaggaggacgacgaggatggcgacgaaggagtggagacgacgctcgggcgctggctgcggcggccatggcggagaggtagaccgcggggaggaagc

SEQ ID NO: 74958 - DNA, 5030 bp, Oryza sativa
gatccgtttgagagagagagagaaaagagagaggatgaggagtatgacaggtgggtcccacatttttttaagtaactagagtgctgactagactgccacacgtaagccactagatcaaaaccaccgcggattgggtcgaggggggtaatttgtcgggtttgtatagttgggggtgaagaatgccttgttttatggttcagggggtaattgagacgaccgcgatagttcggggtgtaatccgtactttttcctaaagaaaataaacgttattgatcaaaagaagcccaaaaaaaagcctagcaggctggctcgctcaaatccgaacccaatttgtatggttgcctaatttgtgcattaactgtgttgtgatagcatgatgctaatcgatgtatactttgttggtagattgtacttcatatgttttttctcaaagtatatcacaataaatcaagaaaattgctaaaaaccttgtcgcaagttttaattcaataagcagtactaaaatactatattgttgatcatacataccaaatattatgctcgtgttgtaaaaattttttttaccctatttccatttcgaatacccaatcttaaaaatcctggacccgccctaataatgcattcaaaacgtatatgcaggtccatgaatgcacggcaaaatggcaacatgccaggttttgtacacctggtaacttcaggtaaattggtaaccttaagttggaatatatatttttttcctttctctttggactcgaaatgtacactaattttcttactttaatgagagacctccttttcactggctcttgtggacacaacagatagaaaccaacatcaaacggtttcccagttaccctattaaaaatgtgaagttcaattttagtcaataacgaaagctctattgttgcttcgaaaaaggttttgaggcttccttgattaaaaatgtataaagtcactcaggcccctttgatttgtatgtaaaatataggaattttggaggattttaatcctatagaaaaatttcatgcgaaatcctttgaaacaaagggttaaatcctatcatatcctttagaattcttatgtaataatgtaatggacaatcaaatagggatttcagaggaaatttagcaaaaactctaacctcttcatttttttagtctctctttcattcgattcctatatttttctatatttttcttgtggtccaatcaaatggctatttttcttaatgtattttatacattttgcaattctctgtttgcatttgaatttatatcagaatcctttttaattgccctttttccattcatacgattcaaatgggcaaacaattacgattaaatcattggaatcgattgacatttatgtaggctgtagctagcaagctactggataaggatacggattcagagaagactaaatattttaaaaagatccaactttctactgactttaataaagcatatattaatttacataaaaaaacttaaaaaagaaaagaacaaaggtaaatgcaagggagaagtttttttgatttggacaaccggccgttaaagaagacaatgcgctctgtacagtactgcccctgactacagagatgaaatttatccttctggaattagatggcatgacgacagacatgtgacgttaacgaccaaatttggtaatatcagtatcggaaaagaagattagatcgaagtggaatcagagacagagatcaatctgggaacagaacgggaatcggctagagtccggatcggctacagtcaggatcggtagagtttgagtcagacagggctagccgatacagccgatttcaagaatacgacttggtgtacatcatcgggttgagttattatgcttcaagatgattgccacgcatggatagagtcctgagaaagcaattgtatctattaattaggatattttatgtaatttcattagagatatgtttaggcaaaagtctaccgcaaagacttatagtatcttagggttgttagagacaatagtcatgtccggtatggacatatcttgtaattctcgggtataaatagaccctgagccctatgtaaaagaacacacacacgttcaatacaatttcggcgcatcgccaccctttttgcttttgttttatctcgacgagttattgctttcgggttgagctgcattggtttcgatcttcaacaagaggtaaaacttgttttgacggcttgtgttctcgaagattagtgcttccatctttatgatactctaatcttgtttatgtaatccgtcaagttatcatatatcttgcataatccttgacaatatcattatttaacctacaatcggctaacatctgctaccagaaagcaatcagttaggttaaataacgatgttggcttagattatatgagatatccaccactttatgaaacatccagcagcttgattgtctagatgttgttcttcttttcatacttaatgttgtatcagttgagtttgatctattaagtcgtgcttagaatttcaatctctagcctgcctactggttgccgattagggtagtatcggagtttcagccgatcttatctgatctaattgcttttgctctatatgctcaattaatatgttaaatctgccattcatattaagatcttgttgcatttaagtatattagatttctgtttagtatattctatttgctttaatatcttaatataaagtagtatcggagtattagccgatacatgctagatatatttgatcggctatgctatgaatatgtataatctcattattaatatatatttcaatctaagtgatttatattgtctcggcaaggtgaccgatgtatcccaatcacttgattcaagtatatgtcgatataaggattatatatcattgatatctacagccgatcgagcagatttagttctgatttgtttccttaacaattaccgatagatttacatatgacatcggctcaaagataaatgatatgtcatcggcatttagccgatcggctatcatttatggatttaatcacggtttctttgtctttgtttcttgttgattgcaggatcaaatcaactagcacgctcatacatccgaaggcgagttttggacctacactggagttaagcagatctcccaggcctcgtgttttccatcaacacgcttttggcacgcccggtgggactgatcagaagtcagaagaacagcttccttcatggctgagaaaccaccactgtctccgtcgtcggccagcctgggtagtggtaaggaaaagacccagaaattcggtctgactgacgtccatgaaggaaacgttgtacccatcgatccagagaagttcactcctgaacagaagaaagacttcaatgcaatgatgcagcaagcacgagatcaattttaagttcattcatgcaaacttgtaagggcacatttattcagaagtacaaggtgaaggtggttcctgaggattttgggatcggttcttctaaagagggagaaaagaaacaaattccagacggatcagcccagccgagtaacaaaggtgctactgatggctctccaggaaatcaaggcgatgaccctcaaggggtccatagagtgcaaggtgacggagttcacggagttcaaggtgacggcactcagggaccgcaagggggaaatcttaatcagaatgacaatgcattccaagattttttcaataactttcaagatcgagttgactatgctgtgtataatgctttgattaatcaatctggagtgttgactaataccttgtcaaatatgatgaaatcggtagccgatggttcaatagctgaacatcaagctgcaggcctagtttacttgcaaggcggtacttttccaaattattgaactttgatcaccgatgttcatccacttactcagggagttcctcctgttgcatcatcagctcagccgacggcgccagcatcagctccagcacctgcagcgccatcgtcggctccaggccaattaatcaatcctcaattattggtaagagagcaatcacagtatcctggaccgaatgtgactcagctaacacaagaccaggttgcatctatgtttctacctcctcagaatgccattaattcggctcagcagcagccgattcagcaaacaccgtccaggcaacaggttgtgcagcctattcaacaagcatccccaattcagcaggccgtgcaaccagttcagcagacgccaccaaagcaaccggatttacagccgattcagcagacaccgttgagacagcaggtcattcagccgattcagcagcaagcctcaatgaacgcatcggctgggtttacaatgcctggtggccagcctgtgcagtacattgcaaatcaggtggtcccggaacacttggttcatcatgtgcaaccggatggttcggtggtgcctcaagttattcctgagcatttggcgcgtggtattcggccgaaccttcacaattgccggggggtaatttgagttatcaatatcagcctccatcaccccaagttcagtaccaccaggcaggatcggtgcagcctcaattctacaaccagtttgagcctacaccacaacaaacacctcagcagcgaccatgggctgacgtgatagctgatgtaatgagggagcaatttgggcttaaaccaaaagagactgggaatttgtaccgacaaccttatcctgaatggtttgaaagagttcctttacctaaccggtttaaagtaccagacttctcaaagttctcaggacaggatactacatcaacctatgagcacatcagccgattcttagctcagtgtggtgaggcatcggctgtagatgctttgagggttaggttattccggttgtcattagctgggtcggcttttacttggttttcttctctgccacatgggtcgattaacagttgggctgatttagagaagcagtttcacagttatttctatagtggggttcatgagatgaagctgtctgatctcacgtcaatcaagcaaaagcatgatgagccagtgcatgagtatattcaa

SEQ ID NO: 74959 - DNA, 720 bp, Oryza sativa
ccctaaaccaaaaaatggatattttcacccctaactatgcaaaccggaggaattatccccctcaaaccaattcagagcggttttgtccaacgtggcgcacacgtgacaatccagtcagcgtttttttaataaaaaattgtgagacccgcctgccatactcttcttcctctctctttgtattctctctcttgctcttttctctctcgcggatcatgcagcgtgcacagcgaggatggttagcgaggacggctcgaatgtcgacgcgaaggcggaggcggcaaaggcgacggaggggagtggcgacacagacggagactgaccgggcgcgtgcgaacacgtggtgggtgcctcctcatcgtgggcgcatggggacacgtggtgtacaccacggcctcggcgggatcgtcctcgtcgtcggtgcccggtggtagcccgtgccctagccttaagctccaacccccgctcgcgtcgccttgaacagcgcgagctcccggcgccaggacgggcatggctggagatggactgaattttcccatggagaaaggtccggggtcttcccgactagcaacacaagctgcgagctagccggtccgggtttgagcctcacccccttcttaattcaaaatcaatctagtcctttctagattggtctcatttgtgttcgcgaaaaaattttccatggacgaaaatgcccctctctaatgatgtttgtcatgtaaa

SEQ ID NO: 74960 - DNA, 3945 bp, Oryza sativa
tcaacgcctacgtccaggcgcgctcctgggcgctagacgccgccgctccccacagcaccgccaccgccaccgccacgcccgcggccgtcgcccgctgcctcgtcgggctagccctcttcgcgtgggggatgcggaccaacatcgcggcggacaaggcgctcctgaggctgaaggaggccgggaaagggtaccagattccccgcggcgggctgttcgacgtggtcacctgccccaactacttcggcgaggccgtggagtggctcggctacgcgctggtggcgtggacgccggcggcctgggccttcttcctctacacctgctccaacctcgggccgagggccagggatcaccgccggtggtacgtcggcaagttcggcgacaagtacccggcgtcgcgcaaggcgttcgtcccgtacatctactgattcctctgttattgctgatggatacgtatcggccagggagtgatgcgcattgtgcttcacctcgaaacagcttttgattcatactgttggcatgcgcatgtggttctgttggattggaataaaaatgagccgtatcgtggctgtttgtcccgcatctatgtctggttctaccaattattttgtatgagcaaagctgcaacggtatattatgctattttaacgacgactcaaacatttcgtgattagtttgctttgtatattactcgctccgttctaaaatataaaaatttttaaacctcggcacaatcttcgagatgctgcttggatcaataatatttatataagtaagatgttttaaagaaaaagagttacatattattatgatagtttgtttaataataaatctagtaacatcaattttatatgattgattttttttattttttattaatagttaaagtttaaaatgtttaacttgatactacgttaaaaatatttatattttaggatggatggagtatgctatactgatatttaaatagtctccggggccagcgaaaaattgtcaaaacgactacgtgaagcatgaatagatcgttgcttcagaccttcagtgctgtcgacctgtcgtaatctaacacagctttggtctaccgcaggccgcagctttcgtctttcactagcgagtagtgatagtgatattgccgaggggtcgacgagagatcagaggagtttcctcactcccacgggcggtggacttatcaacataaacagtaaagaccaactgttagcagcataaacagttgccaaatggcaaagtgcatttaggctatatttggataacttctataagatacagcttctttcagattctccgactcctcaaaacagtacgtacctgttcagattaatgttaaaatcaaccttaccaaaatttagcgatactaaatttttgataagttgatataattactaaattttggtaggatggaataaaatttaaaattttctacgcgcgttaccaatattttataacaaactaaatgcagctatatatttatcaattttattaaacaatggtatgatttaaaatgacaccaatctaaataggccctacatattctaagtcagaggctaggtttctcagatcttacctagattcttatattttgtagttataaaatctaaaaaataaacaagaagtagaagctagatactaagtagaagctagatactaactagttgtttctcaaaattttaagccccgttgaaagggtatgtaacctggtggttaaagtgacctgagtaacacgccaaggtcctgagtttaaatcgcgaattttaaattgggttatttaagggctaagtttcctatttgataggctaagttcctaatttaaaaaaggaatttcagattgggttatttgagggctaagtttcctatttgataggctaacttcctaatttaaaaatggctgcatagaatttcagattgggttatttgagggctaagatttctatttgataggctaagttcctattaaaaaaggttgcatctatttgataggctaaattcctaatttaaaaagggttaattagatacatccattaaaaattcaccggttttgaaatatactattactatttgcgtatttggaacgatgccattgatatttgtttataatttcagtggtgccactaagacacgtattttgcatgtattggacgaaaatgccatcatcttctacctctctcccttctctcatcttcaagctctctctccccgctgcttcaactccggcgccgtcaccgccgctgctgctgccgctgcggcgccgttgctgctcgacgccgctgctgctcgccgccgctccgcaatgctgccgccgccgcaccgccgttgccgctcaccgctgccgtcgctccgccgccgctgccgctcgccgctgctgccgttgttactcgccgccgctccgcacgctgccgccaccgctccgccgccgccgctcgccgcccgccgctgccgctcgccgctcgctccgacgctgccgctgctgccgctcgctccgccgccgcctgttctctgagctgtggaagaaaggagaggggagaaaaagaagcaaagaagggtaatttggtctaaatttttttcgtaaatggtagatagtggcatatcttgaatatgtgtaaaattgtaatggcatggttccaaatacacgaatactgatggtatatttcaaaactgataaatttttaatggtatgtatctaattaacccatttaaaaaaggctgcatatatccaacaaaaatacccttctttaaaaaaaattaagctccatctaaatgaagcttaagctattttgcaacaagcatgttttggtaacaaagaaagataaccaaaaatttgaatcgttttattttgtgacggaagattccatccagtacatctcacaagtaccttgttccagaccaaatacatatatattagcataaagcaaaagagggttgcgttttccagcgcacttcaaagtgccagcttcactcgttgctgggttctccgcgctccagcttacaacggaagcaagtgttattcaccgtggatcgttatctaatccttattattgcataatatagcgtccatcttgatgagcttcgtcttggtgcatctcgtatttaggagacagggctagcagtaatgccccatatttcctttgcatactgagcgatagtacggtcgctgctgaatttgccacttccagctgtgttcagtatagacatcttgatccattttttcttatccctgtcagagaaacaggatttaatcaaagcattcagtgcaagaacagatagcaataagagcgcaatgttcttgtgtttggttgtctcacataggttgtgcagaattacatactggttgagttgtcatattaattgattgctatttgctaaccatattacgggtcgtggataaggctgagccagagcagtaggccctcaacagaagaatgcaaactgatcacattttgattactatagcaaattcagagcactaagagtacattaaaatttcccatagcattaagacctgttggagcatggttatgtttgttcaagaatttgcaatgtatggagtaagtaaatgcaaatagcatgtttgttatccttacttgtaggcttcatcaacctgggcctgtgcatcaatatagcttgggaaatcatagccaacgaggaaataatcaccacgaccaaatccagaatttccttcaagagaatccaagaggggagcatagtcataggtgccaaaagcaccactccttataagctgcttggcttcttcaaaacgtgggtctggtttgaactgttggtaacgtaagcaaggttaatgataattcatccacttgtgagaaatatataccagatcaataagctaacaataccaacaaattcaatttagctatttgcaagtcaagctcatctaataatggttgtatatcacttatctactagaaaatatcttac

SEQ ID NO: 74961 - DNA, 3749 bp, Oryza sativa
gtggaaattatctcttttttttttacttttgttgtaaattgcaaaaagaaatttctaatttcctccatttaaattttagcatcagttatatcattgaactattttagtgtgtttgctggattgttctgatagttaagtataatttcatcacttaattccgcacccttaatagcaaaatcctgaatcggcgactgatgtgacagatgagcatggatgcatatatcaatgataaaatttatttcgaggcgtctacaaatcaggcgttcgatttttttttcaaaaatcggacgatgtttcaccaagtagatcgaacatgtttcactaaatagataaaaattttggaaagctgaaacacaaccaaatcacctcatgaaacattttgctacaacgtatgaaacaacggttttcaaaaaaaaaatcgagtgatgtttcaccctatataaaaataatgtttcagcaaatagcgaaaaaatgtttatattcactgcaacatttgatctatacatagtgaaacattatgagtatactgggtgaaatatttttggtggaaaaaaaaaggaacggattcccttaatagaggttttccataatatgtgggtgatttgttgcaaaaaaatatttcaattcactgcaacattttatacatacatagtgaaatatcatgagtacactagttaaaacattgttggcggaaaaaaataaaacggattttcttaatagagcatttccgtaatatgtgaaggatttgttgtaacaggaagagagtggggggacacgtggggggcgcccgatttttcttacgcgtgtcgggctcccgatcccggcgttttccaacttatttagttgtgatgttactagaaaagatgttcgtgcgttgcaatgggtgaatactattttaatcttattattgttatacggtttggctagggtgaaattcactgtgggaatttgcttggatatttttttctagaaaatattgagctgcaattaggagtccaaaattcataaattagcatgcaagtgtttttaaagagattttttatatgacaaaaagaaagcgtgggtgaatcgcacacgagattgtttgcgcgggcttgctctctgtttcgctgttaaaaaaaaaacaaatccgatcattgcggcatggatcaacgatctgatgtgttagggggtaaattgatacggactcacgatgcaaaccaaaaggatgacgtactaaatttattggcaaaaatattttcaatttttataatagtaaagaaaagaaaaagagagaagtcgtgttagtacacttctccttgcatgctggaccaaatctttccgagattatccttccccaaacgattaaaaatcctgaccaactttatctccacgttgctgagcagtgagcagagctagtatatctcggatgagcattgttgtttcttctttgcgagttgtgaacgaagttttggagccatcgactcggacaacgaatcggacaagtgcgtatggtgctatggtcatatgaacttgagaacagtcaagtggatagtgtgatcaaagtgatcatgagctcacgctaacagaggtggtctcacatggctacacggcctgcaccgctgaggagtcggggcacattaataacgattaaaccagatcatgcaacgcgatgccatcagttgcctttttctttctgtgctcctttatcactttatcagtgatgtatcgtaaactaatccttttctttttttccctgtcacgacacatctcttgttcgtcgtgtagaaaagaaaacgttatttacagaagtataacaaaaaaaaaatatagatggattgtggatttgttatgctgaggcgtgatgatcagagttttagacatcaaagtatcaaaacaaatatccagtgataaggaaagatataattttatcatatcgtattaaatctttagtttagttttagtaatccactgttaacaactacgatcgatgtcatgtgccgcatcttcaccgtccatcttctttcgagaaaggaatgaaaacggccacggaaggtcctaactaagcaagtgtcattttcatataagtgtaccatttctaaccatttttttattatagtactatataaattttgattttcctaatttgtttagcgttgttttggtattgacactgaatagttaaattgatgaatatgctctattcccaaccggctgagaatcattttgaatatatgttgcaccgtttcattcctatttctatatgcatttgcctatgcctctttatcctcgctgccccatgaaagtccctacctctttcctaatccatactcgtcgttgcccatttctctacaccttcttgatttgcatgttctcctttgttccctcttcgtttgcaatgtctatagattgcagttgatttgtggacagtcgttgatgccattttgtttgcaccaagctgttgtcctccccacccagttctttcccaccatttctgcaccggtaaccacgacggggctcctatttgccgctgattatgacaccggattgagaaggggcacatggcattgtgttcgtcaatggtcatatggactacatgttacgttaacgagtccaacaacggccgggaataatgttgtatgtccagattcataatattataaaatatcttatttggttttagatttttatattttaggactaaggggagtagtatttgattgaatgtagagattcttgtaataggattctttgtttggtttgcttgtattcttaattcgccgagctagatttgtccgcttcacctggtgcttgctgcagagtgcagaccacctctgaatcaggttggttatctgtttctgcagatgctttgaccaaaggattgtgcacagtaattgacaagacatttaatcagttattagtcaatattggttatgaatggttcaacttcaatttttagtaatatgttgtagtagtcagatactcccttccctccgtccttaaaaaaacaaacttagaattgaatatatcatactccagtttatactagaacgtatctgaaaagatctatctaaatttagtaggatatgttacatcgagtcttaagttttttttttaaagaacggaggaaatagttctcatcgtgttgttttatttattatcctgcgggttaatgacttcagatagttctcctggtgctgtttttatcgtccaggtcttggtacaggtttagtcagcaactatgatgatataattacgccctttgttctcctttcatgtagaagatgtagatgcacataataagaagggttaattggatcattgtaaatttgcttattaagaaaaatgacaatacaattcgtctattcatagtcatgccactagtattttataaaattaaaaccgtgccattaccgtcacgttttctatcaactccttccatacaacaccgatgagaagccacctgcggatctgccccaatgccacagcatcatcaccgtctctagccagagccgcgaaggccgcggcgtagctgctcctgcaccagggacgctcccatccacgaatcgtgggtaacgcaccgagagcggcggcgcacggaagccacggccatgggcggcggcggcggcgacgacgcgctgtacgcgcgatgcctggtgatcctgtacctgatcagcccgatcaccgtgttcctgctccggttcgtgtcggcgccgtacgggaagctctcccgccccgggtggggtcccgccgtgccggcggcgctcgcg

SEQ ID NO: 74962 - DNA, 3822 bp, Oryza sativa
tcgcagaagaattaataattatatatgcatgcatgcatgcacgcacttacttgtatctttgcatggcaagtagtgaagtacgtaacatgaaaaactgcaacctgccaagagaactcttgtcgacgtttacaaaaagccctctcacccaactatttcccacatgttgttaatttaaatgaacgtgcaactatggagtaaacagatgtagtcacatagtatttctgtaacttctcaagaagaaactatacatcaatatgcaatctccttcatcatcaccacatagtacttacattgttgcaacaaaaacctatgaacatattcctaactagcaaagttgtgactacaaaaaggaatcatgcaaatgctgatgtctaggataaatataaacccttcatattacctaaccatatagaaaggtttcaattaaaattatatgattttatctgcatttgagaacaatagtgtgggcaagttcctgtctcagacaaataaacattccttaccatcctcaacatgataacatattgaccactatgctataaatcatttattatttggaattccggaagccatctgagaatcttaaactagaatgtaccatcaacaacatgatacgtcaagcaaaccccccaaaattcgaacctacaagcctacagacaaccaaactcatttcgacaacaatctcactaacttcgaggttataggcctacaggcaaccaagttcatttcgacaacaatcttgctaaattcgaagcttacaggcctacaggcaacctaagttcatctcggcaacaatctcactaaccaggacgacagaagacaagcgaaaagaaataaataaaccccccacgagcgtggatggcggagggccatagacggggcaagccaacctggatgctgaagtctcctccaagggagacgttgtgggagccctcaccctcggcgaggaagtcccccgcggcggtggtggcggcgccggccgcgccctcggacatgacctggcgctcccgctggtcgaggtcgacggcgagcgcggagaggtcgaactcggagaagaagggcccctgcagggtggtgttcacgcagtgcacggcgcagagcttcccctcctgcacctcgtggtacagcagccccccgttgctcgccgccgccgcctcctccatccctctagaatcttctcgaaccctccggcgattcccccctcttctcttctaccctccctctacccctaccactgtgtagcgaggtagattcgaccaaccaaccgatccgatgggggaaaggttagagagagagttgagtgctgtacgggtcagtgcgcgacgcagattctcctgcggggaaaaaaaaaaccatcaaaaaggcgtcgccacgtcgaccgcgatcctctcaaccgtctaccacgtggaatttgcccccaaaaatgaaattgatatctcgatgcaccaaggctggtttagataaaataatttgaacaaaaacatcaaatcaaatgtttgacacatacattaaacattaaacgtgggaaaaaacaattacacagtttacagtttgcatgtaaattgcgagacaaatttttttagcctaattacgccataatttaataatatgatgctataataaatatttactaatgatggattaattagactcaataaattcgtttcgcagtttacaggcaaaatctataatttattttattattagtctacgtttaatacttcaaatctgtatctgtatactttaaaaactttacctctagacaaaaacacaccccaaacaaacaaagcctctatagtctatgctccatatgtatttgattcatgagtgaaatatgccaaggttagtatttcgatctatttagagtgcgacgtcaccgtgaaagaaaaggaaaaggcatcgggtgcgtggctccaccagatgtttacagctctctccacattggtagtccgtatactgtatgtaggacagtaggagtgtagtctatttcttcgctttcttttctttttctccctgagaagttgaaaaataatgtcgtgggcctagcccatagatgtccttcctctcaatataagtcgtgggccgtttcagtttggtgcgtgttgattgagctgtcattttgtttgtattaggcacatttccttgcaacagtagattgctatactataaatagatttaatttaagaaacagtagctatatgttttcgtgtacgaaattgctatttttctttcgacggattttttggggaaaatatttaagttttagactgttagatttactctgaaagatggaaaaaaaatcactaccactggtgaagaaaacgagcacaagctcatccctctaattgaggtacagtaacacaagcggatccaaggaccaccggaaaaaaaatcctaacctaatacatatatacacatatatttaaaaaattagaaaaagtaaaaaaaatactaactcccttattaatatattgttatgcatatttgatcaatttatacttatagctttgttatatttagggtatttctaaaaaagtataggttcgatcacccatataaaaatcccagatatgccactgtgcactaacacctatttctaatctcgagtccaagttgcacaatattgacataggagttacgatgcaagtaactccaatataattacactataattatatatttatatttgaaagtttttctcttaattttatgtggaaaattatatagctacaccaatgatgtgtttggataatgggaaatgagaggtaggattgagattgggaaatgaataaagggttaggattaaatggatgagggagaatgaatggttaagatttaaagaggggtggaaaatcatttccattagacatttgccaaacactgccttgtggtttattggttccagaagtctagcctggcaagcgtggcccatcgtactatatgggccagtttggcccaaacattagagagaacaaataaagatccaacaaatttctctgtgtctttgtcctggatgcctggtgcaacactctttctccaattggtggattgattcctctaatgaaaaataaactgaagtgggttgatgaatgatgataacctaaactatggacttgtgatgcagtgtgcgactgcgcactatccgtgtggtccgcggccgtcgccatcgagcatcggagcatggcgcattggcgcatctcatgcccccgcaccgaactcgaaagctcgaaaagtaggctacgctacataagatataaaatataagaatattttatcttttttacgactaaaatataataaatttgaagataaaatttcgcatgtagctacaatactattggaatatatgggtctaatttttttataattttatgacatttgctagcttgcgtgcacggattgtgtacgggaagcttatgtatataaaatatgttccttgtacacatataaatatataatataaataatagtgttataaaacttatatatactccctctattgttaaatatatgatgatgttgttgttttctgggtatgatgtttggctattcattctattcaataaattaatgtaagcatacaaaatatgattaaagtacttattaaataataagataaatcacaatggaataaaacatacataactataactgtttaaaaaagatgaataggtaaacgtcgtattcaaaagacaattgtggtttatatataaaattgaaggtacgtagctactgttgtttatttttcataaattcgatatgcttatatccccggccttcgtacgaccaataaacaataaaaagactaccacacatacattt

SEQ ID NO: 74963 - DNA, 2203 bp, Oryza sativa
tatcgaaaatgtttggctaccgcgcgcccgacgaagagaagaaaatatcaggtgcatttcccaaccaccaccacctcgctcttatctccaaccgatgaccaaaccctcctccctcgcatggttgctctcctgacctgccgcgtggtcctcctcctccggtccaccatccaatggctcaaggcggagccactgacggaggcggccccgcgacttcctgtctcgagcgttgcagcagaggcgccggcaggacgcgaaggggtgcttgccgccgccgccgtggcggtcgtggcgtccgagctaggcctgtgactggtgctcccttcccttgcggactccggcgaggtggtcgacgctccagtgggacagatctcagtacgctccggcgcggtaggtgctggcgtagtggaggagcgagggcagaagatgagattactcgaaggtgaattgcgccttgcttcccactgcacgattgatctcgcgatcgtttcttatgctaaccactagagtggacgatcgaatatgtagatctaggttttcattttgaattttttgatgttttagttcatgtaccatgatgttttatgttagatttgaaatgttgttgtaggttttcgatggtgtttcattctttttatcaatgtatttggatatttgtttcatgttttaatacaatcgaaaccgttgtttcacacgttataacaaaatgtttcttagtgtgaatgattgtgtttcaacatattcagcattgaaacatttttatgtaaggtgtttcaattgtctttaattctttgtggatttgttaatatttcaataattgaactttaatgtttcatgtttcaaaacaaattatttcagtccatgattcaaccgcacgtgtttcatcatttaaatttatctgaaacatgagttaaactagtggtgaaacatttttcttacacgtactgaaataacgtccggaattttacaacaaaaatcggacatccaatttgtaggtgtttcgattgattattttatttgattttatattttaaggacccattactaattttctcgtgggccacccaaacggccaaacctcctcatgactagactcggataggggctacatacatgagaaattaggaggacgagaagagagaggtcgctgctaccagatgggaaggcgagctcatcgtgggctaccatggggtttgattactcactacttgatcaagtataagattccgacaggtagtgaattatcagtggtgatgtacataataaagctagagttgctttattaattaatcatgccattacaaaactcgaaaaggattcatgctttgtcgcggtgccggttcaaagttcgttttacgtacctttcgcattctcgtcgtgatagttagcacgacgacgttgatatgtacacgtgattaagaaaaacctaggagtagtacttgactagaaaattaagctgtcttgaagtccacttagattgtaggaaaatgcaatccaaaatttctaaaaatattgaatcttctagtttcagacttgagttccagaagcttttagtagtatcaatctatggttggccatgatgtacatttggtgatgaagtcaagataggagatggatatctctatcagttcttccttgcttcactggccggctagcttatgggataaattccacagatcctaaatcattagttttgatgctaagcttaattaattagtatcactaatccatcgcagattttttggtatggaattattagggcaggtcacgaatggatcggggagaaattaaccttttctatcacccggttgggtttatgaccttaccttgaattctgatagtacactcggcatgtgttttttttttgtctcttttactgacttattcttaatttgcagtcaaccatgtattggtatgttgatcgcctcccattggaaggaaaaagatagtcatatagtacgatagatttcgtaaaaaatattcccccattccctaaatgtttgacgccgttgactttttttaacatgtttgaccattcgtcttattcaaaaacttttgtgaaatatgtaaaaatatatgtatacataaaagtatatttaacaatgaatcgaatgataggaaaataattaataattgcttaaattttttgaattagaccaacggtccaacgtgtttaaaaaagtcaacggcgtctcacatttaggga

SEQ ID NO: 74964 - DNA, 2892 bp, Oryza sativa
aggaaggggggggaaaagaggacttcttttaggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcaaattttaattaattctattattccttttagcgaatgatttttatttcgggatgaatttatcaggacgtgacaaatccaccctccttacaagaatctcgtccccgagattcgaggaggctagcaagaagataggttgggcggtcttttcttcttgtctgacttcttccgtcgcgtcttgacaaacttccagcaaaacttcaccactcggaactgcttggcttgacctcctgttgcggatggaatcttcccttcacctgactggaccagggtgcaccttttggctgactcagactaggttgcggtagtgcagtgatgcttccgttccagaacttctcatgattcatatcttcggagtcaacctcggacaagttatcaacttcaagttctggggttgttacctggttgtcattaattagaatccaatccttttaattggtttttacttggcccccaattcctcgtattagctcccttggtctccgggtgatagctacttctgctatttgatgcaagggtcaaccactctaactataagttatgcttcccaagagagccaatttatcccacttgacatactttgatgtttttcccaatgactttgctgctggacttgttattgtctgaacgtggtcctgccagacctgaagcttcgttgttggaggtgattttaatctgacctctgtagactatcttcgatcatatcacttggttcataactgggaatagctcccacgaacaagcaacgcggattcactttctttatgttcagtttacttcccattattatcttcaggttgtcctcagttagcattcaacgtattcctttacacctttaaccttgatgtgttctttcccattggatcatctcccaagacatggcattacctggtaaccggtgcttgcacttctcactccgtgtagcatctgataccgagttgaagatttcactccttgccttcatagaaacatttttacctaggtcatctcgcttacttaatgacaaggtgactgttgcggggcagttactatcaggggtcgtccttgagcgatgcaaagcatgtttctgtttatcaatcacctttcggcctacttctttcatgctaaagaacatctttgccaatctcttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttctatccacaggttggttattaactcgaggttagtatatagttcctctgacacgagaccctaggtctcctttgtcagtaaacaattatacacatgatcacatatccgcatcttccaaaagaatcctcttagggaacttgtctgtattacacatttctcccttattacacgaatacaaggcactgccttaaacaaaaagggaaggtgcttatcatcggtacattgtatcctcaacatgaatcatctctaaacatagcaagctcactgtttacagacatgattatatttatgaattacatgattgctgcaaactttcgagtacaccatgataagtagcgaactaaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcgatgcagagaatggttgctaagttttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattgggaacttttcccaaaaaaaagggggtttaaaccccaaaaaaaaccccggtccccaaaaggggaaaaagatactggcctctgtcttgtcagctggtggctggggctgaaattgagcattga

SEQ ID NO: 74965 - DNA, 8806 bp, Oryza sativa
  unsure (1)..(8806): unsure at all n locations
aattcgttgcggagcaagcttctgattgcagggagttgcgtggactgacgtgccggcagctatggttctcggttttgggcacttgtcggcgaaatgacccattccttgacaattgaagcaacagatgtcttcccggactcggcattttcttttctcatttcgattcctctgtcctggcactggagttaggctgaaacggtaatcttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcatggggcattcaccgggtggatggtcttcctcacaatgaaagcaggtagtggcacacgagctggcaacatgaccgacttctccacaacgagagcatgccttacgttccatttcatcttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttttgggatgttggcggtgcgctcactcttggggtgagagctctggactggcttcaactgcacttgaaggtgcatttgacttcggttcaaaaatggcattccaagcctgtgtgaaatctttattaaccaattggtcttggtaaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaacattttgcaaatagcattaggggaaggagaaaaaaggaactttcacaaatagttttatttataaaatatgtccttaggttttatccacttggcttatcctacagtcgagatggctctgataccagcttgtcgcgaccgggaaaattgccttttcccgctcgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgttaatttggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacctttgtttaagactagactgagccacaaactaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccacaaaccaataattccatagtgtccaaatgagatgagaattcccaaagtctaaagttataaaaccacctaatgttgcctaattaatcagcgaagcatctacctaaattcatactagtggaaccaggaatagagtacccactagttggggttttgtttattctagggtgaacaaggtactaataacaatagcaataataatgtcataacaaaggtaaataggcatggctaaataaaacagtgataacgcgggaatttaaacaaagcgataatgcaataatttaaatcaaaataattttataaactgggattcaatatgctcaagggtgatgtgacttgccttgctcgctttcccaaacgccggcttcaacttccacgaagagcggatcgtccgaagctgcagcgtctacacgaccaacggaaaagaaaaggcttttactctaataaactccacacaacaagcaggaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaattaaaaatcggattattgcgtcagccgagggggcgggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacttggcagccgcgagggcgcgcccgcgccccgatggtcaccgccggcgaccaccggcgcggcggagcggcgcccgagagagcggagagaagggggaaagcgaacggcggtcttcggctcaccccgggacaacgacgacgacgagaacggcggccggagtgaagggaagcggcggcgcggtttgggaatgacgaatgccgccggttgttcggccggtgcgggcgaaagcggagcggcggacggggttcgngcaacccattcgggcgaaagcttgaatggaaggttggccgcccaatgtccgggaaggaaggacccgggaagctgacgacgggcgggcggcgaacggagctcggcggcgacggcggagagagaggagcacggcgcgggcacgaaaccgacggcgagagcgagcggcgagcggcggaaacggaagagcgaagcacgagggacgattttatagcaacgggagggggagagacgcggccggggagaagaggaaagccgcgcgacggagatactcgggcagccattaaagacgccggcgaacttcgcgggatgaatccggacgaatctgagggagagagagagggaaaagaaggggaatcgggagagggaaacgcggggagtaattcccctctctttaacgcgcgcggggacggcgggatgcggcggaatccgcggcggcggcggcgctagggcacgggcggcggcggcgggcgcggcgcgaggagggagatgacaggtgggccccacccgtcggcgagagtggcgggcgggcccgcctgtcagcggcgcgcgcgcgcgggggagaccgatgggccgcgggggaagagagagagagagggactgggccgagccggcccaagaaggaaggggggggaaaagaggacttcttttagggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagcgaatgatttttatttcgggatgaatttatcaggacgtgacaacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcacccgagagagaggagggaagggggaaagcgaacggcggtcttcggctcaccccgagacggcgaaggcggtggaaacggcggacggagcggaagaagacggcggcgcggctcgggatgacgatgacgacggtgctccggcggtcggcgggcgaagcggagcggcggacggggtcggcaaccactcggcgaagacgatggaggtgacgccgagtcgggaggaggaccggagcgacgacggcggcgaaacggagctcggcggcgatggcggagagagcggagcacggcgcgagcacgaatccgacggcgagagcgagcggcgagcggtggaaacggaagagcggagctcgggcaacgtttaaatagtgccgggggaaggaaagagcggccggagagggaggaatcggtcgcggagatttcggccgccatagatgcgccggcgatgaatgcgggaaggaaatcggacggatccgagggagagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcacgcgcgcggggaggccgatgggccgcgggagaggagagagagagggagagagaggtgggccgagccggcccaagagggaaggggggaaaaagaacttcttttaggattttctttttataaaacctttttaactttgtttatttcttttcaattattatttgtgctctgaaaattccactaaaatttatttaagcattttaggcttttaggaaatatacaaaaatcctctaagcctcatttgacttttttctttgcacattttaattgttggaggctttctcatgaattttaattattctttgcacaatttcgaggatagattttagagtcgttttgggacgcgacacatgccgtgtgggtatggagtatccataatctccacaataccccacctaattgcttcatgtatctataatatatacctcctgctgaattctttattgatttgatttatcctcatgcccgatggtcatacctgaacggccatgctgggctgctcgcaagcgtacatatatgtcatgtcaagccaaatccaaatcatccatccaagggtgtggtaagtggtagcaaagatcaatattctaccttgtactaggtagtatatatctaaagtacgaattgcccccctccccccccggaactatcgcggtcgtccgaattagcccccagaacaacaaaaccaggcattcttcacccccaactatgaataccggacgaattacccctctcgacccaatccgcggtggttttggtctacatggcgtacatgtggcagtctctacatgatcttcccacgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcattaagaaataccaacagcgaggacgtggcctccagcgtagcggctggcacgacgacactcctccttcaggctgatgtcgatacgctgtcctataccctcgagctgagcacacgcccccctcatccaaggcaagtagcccgtcgtactctcctcgggctccgggcggtcaaccttcaactgacagcagatatcagccatggcactgcagcagctcttgagatacgagttcacccagacctcgcgacctcggagggcctccatggcttggtccttcttcacaaccacgagtgatcgctccagttcggtgatttcaaacttcatcctccagtagtcgatacgcctatcccgttcagcgatgacactgtcaagatctgcaaagggtagaagatgtaagagatgctacctcttaaaaaaaactcgcaagtttaaaagagggatttctctaaaacatcacacccggattctcacgtgggagtccgacttcgccagcctcaggcgggcagaaagtcgcatccaatccaccgtccttgacggcatcgctcggggaaggcaactcgaccatctcgacatcaggatctccgccttgctggacgttctcgggatctacataactacgggagacaaaggaatgcgatagatcaacaaatgactcgtaagaggaatctactgcgtccataaaacaacgaaagcgtttttacaaagaccataacacaagacggagaaaaattactcctcaaaaagagggagaacactctccccgagatccgacacgctctccatcacactctcccgcgtggcattagctgcccctttcgccaagatgtccttgaggtcagcgtcgggaaaagcgagcttcactcacgcaggacgtgacacgcccccatgtggattccgttggagatctcctccgcaatatgggtggcgtgccgtgatgggatggtctccatctcgtccacaagctctgacaacgccgacgtcagcgacttctcgtcaggatgcgtcgggatggaagacttcgccccgcacgacaaacgccagttggtgcagccaggtgaaggtcttgcggagggagtcgcggatggaaaagaggttgtcctatgtatcgttcatcctcttctctagaccttggcgctgcatctcgttgccggccacgagttccatcatcttctgaaggtcctcacgggcgacttcgagctccgcctccagttgcgctaccctttcgtctgccgccgtcggacgggcctccgcccgatctatctgggccgccaccacccaagagctgttgtcgaggaggcaatgg

SEQ ID NO: 74966 - DNA, 6523 bp, Oryza sativa
tgactttagcttcagcttctctcaggatatcagtcccgaacacttggctttctccagcttggtcccacaagagtggtgtccggcatttgcgcccatacagcgcttcataaggtgccatttgtatgctggcttgataactgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgaccctagcgaagtagagctccgctagtttattccctccataggtggtcttcacaggaatgaatcgagctaccttggttaatcgatccactattacccatatagaatcatatccaccttgggtttttggaaggccggggatgaaatccatcccaatttcatcccatttccattccggcacttggagaggctggagaagtccagccggtcgctggtgctctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaacatccacgaccaactatgtttaggttcagggcttccatctgttgattaagctcgggtggaatgcctcggacgttgagagtattgcaatggctcttccgacttagagcgtcggcaaccacgttagccttaccaggatgatagtgtattcccacatcataatccttgatgagttctaaccatctcctttgccgaagattcagatccgactgggtgaagatgtatttcaagctcttgtgatcagtatagatttcacagcgattcccaatgagatagtgccgccagatttttagagcatgaaccactgcggctaattccaagtcatgcgtagggtagttgccttcatgaggacgtagctggcgtgaggcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggctccacacaaatttctcttctttcttcaacaactgtgtcatgggtcgggcgatcttggagaagttctcgatgaatctccgatagtatcctgccaaacctaagaaactgcggacttgagtaactgtcttgggttgcttccaatcggtgacggcggtcactgtttcgggatccacagcaactccttttgaagatatcacgtgccctaagaatttgacttcggacaaccagaactcacacttgctaagcttggcatacaattgatgttcccgcaactttcccaacacctgacggagatggtgctgatggtcttcctctgattgggagtatatcagaatgtcatcaatgaaaaccacaacgaacttatccaagtattccatgaacactttgttcatcaagttcatgaagaaggcaggagcattggttaagccgaacgacatcaccgtgaattcatacagcccgtatcgcgtggtgaatgcggtcttcggaatatcttcttcacgaatacgtaattggtgatatccggaacggagatcaatcttggagaatacagtggcacctttgagttgatcgaacagatcatcgatccggggaagagggtacttgtttttgatggtgacttcattgagagctctgtagtcaacgcacatcctcttcgttttgtctttcttctccacaaaaatcacaggagcaccccatggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactacggggatttctgacagttctatctgatgaagttctgaacttctgacagaggttgggggtgcaaagaaaacaaccggttgttctggtcctcggtacagagtgacagtgcgcctcgcgcaatccactaccccttggaattgggccaaccaattcatcccaaggatcacatccaagttcttggtatctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtcgggagttgtcagcacgtcctcggccgtcacgtgattcacacgaccacggatgacgccctggccaccgttgttggggcggggaggcgcttggccttgctgacgccttggcttcgggcatttgtccgcaaagtgcccgggctcgaagcagttgaagcacagacgctgcggacctgaagcgtccctgcggccttgaacgggctgcccagctggcgtaggaggacggggcgcacgagtcccttgttgattctgttgctgctgcggctgtgggacgcgcaccacgaattgaggtcggggcgctgggcggggttgctgctgctgttgctgcgaggaggatccccctgggtagggattggtgtagcgaaccctctggttagcaccctgttgattgcggaaattcgccaagcggcgcttgtgcgattccagctccttgtgcttggcttccaagcggatgctcttgtccaccagtcgttgaaaatcaggatagtccccagagactagacggacggacagctcagggtccattcctgccaagaacttctcttgcttctcctcatcttcccgcacatcctcaggggcgtaccgggccagattgttgaactcgtgcaaatactccatcacggagcggttgccttgcttcaactctcggaattccctcttcttgagagccacgactccggcgggcacatgggttctccggaaagcggcggtgaagcgagcccaagtaatcggttgtccctctggctgcgtagcctggaagtggtcccaccagagagatgcgggtccctgcagctgatgggcggcgaagacgactttctcctcatcgctgcactgcaccgtgtctagctttttccccacggcatgcaaccaatccaacgcatccacggggttgttggagctagaaaaggtaggtgggcggatgcggaggaactcggcgagtttagagtgttggggagggggtggtggagcattctgttgaggtggattctggaggtggtggaggaaagcattcatcatgttggcttgttgggcgaggatttgggtgagaatggcgttggtgtctggtggtggtggtggaggtgggttgccttgggggttggggttgctgccctcgggttggttgccttcaccggtgttaacatttctcctggtcgtcaccatctgaaaaccccacacagaaccagcaaacagagaaggagctaacaattaaaactaaccacccacgactaccattattcttaaatttatcactgctattaagttggttcattaatgttcaagttgcttaggcaaacaaataaagacaggctccgacatagttacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgccgcagctccaggatcttcatgttgttctccaccatgccacgacgcaccatctgatggaagtcaatacgagctgcgtcgtatgcctccaccatgcgtgccagatgcacgacggtggcgtcatcctccgagctagcatctcggaaggtggcgaagtcgcgggctcctccgcgacgagggtggtagcggtagggcgagtgctgcaactcgtccgggtagcgctggtgaagggtgccgatggcgaggagagcggcgttttggcaagcggcggggaaggagtctccgcccgcggtgactgccagcgaagtccgctcgggagagccggagaggatcactacagtgacctcccaaccagcgtgaggctctgcatcctcaccctcctgctccgggagcggcctggcctggtaatccactccatgtggataccccaagaccacgcacatgccccgcagctccaagacgaagccaatcatgtccaaaccacgacgggtgacgctgccggccatctacaaacaaaaacaaaagaaaagcaacattttaaaggccagattttgatgataagtgaagcagcaagacaaagagagaatagcgggttttcacaaataataaaggatttttatttttgaaaatattgctaaggcttgggatctacggctcgtcctagggtcaagggaggctttgataccaacttgtcacgaccggaaatcacccaacaggcgctcccgacgtgcgtgtattattccttgtcccaggaggcaaggtacaccaaaagttgatacaatacagagtttaacaagcggaagcgtatataaaattattacacgggcaacaacggcccagcacactcaaagacaacgaaaaacagcggaagactagggcgacgaccacaggcgcttgacggcaggcacgagctagacaccaaagccttcatcttccaggaactcctcatctgggcttgggaaaattaagaaagactgagtacaaccaccgtactcaacaagacacacccacaaatgcagaataaatgcacgggagtacaagggaattataatataaaggggtagggttgcagtaaacagcatttaaagacatttagttgctcaaagctattttgtaaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattactcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgaaaatatcccaaagtctagagttgtaaaaccgcctaatgttacctaatttaattgcgaagcatttacctaaaatttaactatggtgcc

SEQ ID NO: 74967 - DNA, 705 bp, Oryza sativa
  unsure (1)..(705): unsure at all n locations
aagattttttttgagagccgattccggacagcagcgggcagcatgtgtcgctggccttggtgccgactaccgtgtgcaccagcccgttcagcatgttcacttacgccagctgttgtatttgtcttttacacaagtcatgtacgaggctactaattttcaagctttatatggaactggtattctttgggtttatttgaattcgtttatatatagttgtgcttattattatgttccattttcgcaacagtgtctttaatggcaccaaggaataagaatgtccttcctacataagagcaaggaagagattgggtcaatccacaagaccacaactacctgcagtcccagcttgtgcagtcccgttctgccctttgtagaaaatggagtatatgtcttctttgccttttgcctgaaaatggaaaaatgtaaaggaattcactaagtgtaaacaaagcgccggcaaaacaatactttgggattggataaataccatcaccatcaaactatataaacaatctctaaggttgatttccaaaagtattctacaaactatcgcgtatccacttggaaagacaggcgcctgtacattgaaaattactaattttcgcaaatagaaagaggaggggggggggcatatctacattaaaagcatactaaatttatgcgtgtgcaacagcgatgggatgaaaggcanattcagcatgtatt

SEQ ID NO: 74968 - DNA, 1077 bp, Oryza sativa
  unsure (1)..(1077): unsure at all n locations
tgtgaaagctggtttttttggggccttaaaagccagttttaaccatataattttggacatgagattggatagttttaagccagccttttaaaggcttaaggctttgatgtgattggatgaaatttcatgtaagttgttgatagtttcccagttttccggctcctaggtgtgcatattggacttttcttcttactaggaccttagcaagtacaagccaagcttcttcancggattttataccatggcactttaaagcaagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctggcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnagatgacttcatcacttccataccatttatgtgcagttattataaggctggaaatgaaaaatttgttttttttttctcagtccttacattccttgagcannnnnnnnnnnnnnnnnnnnnnnnnnnnnnnnnnnnnnnnnnnnnngcntagtcattcacaaanncaagc

SEQ ID NO: 74969 - DNA, 502 bp, Oryza sativa
ccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgccc

SEQ ID NO: 74970 - DNA, 684 bp, Oryza sativa
  unsure (1)..(684): unsure at all n locations
ggggcaacttgcctcgggctaattgactcactgtgactgcttcatgacaaaaatacacctatatagtacnngtggtttatttttttttataaaataagctatggtatcccaattcaataagctctccagatagtatggcctcttctgagttctcaccctgccactgtagaaagcttcggtacacaggccttctgcttgcttccttctccaggtacatgcctgttgaaagcaaagcttcaattttgtttctaactttacttttttcttgtgaggatgggcacagggggcacatgagcaaaagttgaggcagtggactactagagacctttccttaatctaatctgtgatgatggattctcgttaagcatatgttctttccactctaagatacggctgatttgatccctcattggatttggaacgcttttcaaaatgcttgttttttcgacttggtgatctaaatagtggcattcctgctgcttgtttgatgcattcttaatcacgtattaacttcctggatttgttgtttctggctgtaatgtataaatgtggtggcccggcttctcataagtagagtggcttttagaacacgttaatgctggaattaacttgccagatgnnnnnnnnnnnnnnnnnnnnnnnnnnnnnnnnnnnnnnnaaggaccgtcatcaatntntccaggc

SEQ ID NO: 74971 - DNA, 687 bp, Oryza sativa
cccgttgagtagagtgacgggaaaagagaaaaacactctaacaaacgagttgcaaaagagaggcaggatccttagatggttgagggaagtataatatcggtaagtcagaatgagtgaacatattttcaaaaaaaaaaaatcgaagtaaaaaagacaacatattccacaaaagggattcaaatattgcatcttaaatcttaatctcatagttcttcgattaaatttctcactaatcttgataatagttcttggtgctcaactgagtgaaatgagaaccatacaaagctaaaccttctgtatttaaactaataaagaactatattaccaccaaagaatattcacaagaaattagagaaataaaagttgcaaaactcatctatgtttgggggcgagtttggtaatcattcaaatagtcttatgtattgagaagaatatttcaataactattaatgtacagatgggctatacctgtgaaatgaatcgacgaactccatgctttgggcatcaatcattacaactgggaattcaagaatttcaaccttaccttccaaatcaaggaccaaaaagtaatccaatttctgagatttcactttatctgcagctgaataattcactggaaggtctgttggcagattgtgattgaatttctcaagatgcaaagtatcattcaactgaagaagtataaat

SEQ ID NO: 74972 - DNA, 3181 bp, Oryza sativa
agcgaagcagaagcctggtgatcgacaaatggaccgattacatccatcaacggccaaatctgcaagggttgaagtcactttggcccttcaaaggaatcagagatacgagatgtcccggttctcgcttacattgatggcggcagccttctcggccgctgacttatcgcaaagcgaggccggcacctcttcggccgtggaaagcgcgctgatcaggacctccctgactcgctgcgccaccgtgtcgtcaggaagatctgaaataaaaaagatgcaaggaagtacggttagatctcgtctatgttttcaacatcaggagcaagaataacgtgcaacgcaaggatgaataccccgtgaagaaatccgagttacgtcctcggttcccgcgtagtcgaatgcggggtgagtgcgggcttgcagcggttgatctgacgactaacgaagtcgtcaacgacttcatagccagtccatcctcgctcgcgaagaccgctcacaatatcgacaaaggcttggagagagggcgtcatcggaggtttggaggtctagtcctcggagcgatctggttgaacctcgggtacgataagaaccgggtcgagttcttttatttcgaggtagaaccatctcgtcctccactagctccgggatgagtggcattgaagtgggatgtatctctccttcatgccatcacgaaggcggaatccacaacatcctgaaacccgattgggttccatccaccagagttcatagaaaaagtggaaaagatcaaggaaaggcactaccccaatgtaggcctcgcaaagatgaacaaatatgctcagaaaagcgatggagttggggtttaggtgtaaaagagaaatcccgtagaagtttaagatcagcaagaggaattcagaaggaggaggtagaaagccacatcggatgaaatcctctaccgctaccatgcgacctaaaatgggagaatgaacagtacctcctgcctccctcgccatggtttgctttggagggatggctccttcggtgtacagcttcttcagtgtggcggcatcggaggaagattgctcgaggtccgccattgggggaggatcgccggaagaagatcactggtgaagggcgcaggagattagggagacgtagagtccggggaagcgggggaacaatgagagttttttggtaaacggactcaaaatggatcccaaaatcccattaaataagcgcactacttgacggttcgcatttcgaggaaaggggagagattgccaccgaaaatttctgaggcccattgaggaccattgttcagacttcaatttaaattcaaaacccgcatagataggctccctaagagcgttatcgataactctatatctctacggttatataaccgagattgatctaacgagtacgacaacgctctattaggagaagtcgcatgcgaggacatgaattcatttaagttgaagtcgggggctactgtcagggttacggataaggcataccttctatccaacaatttatgaaatataccaataaggtataccttcaagtatacggttggttcccatatacactgttagtaatttacctcaaattatggaaaatatctccacgaagttaagggattagagaagtcctacttggaaagggtaaaatctctagtatatcgtgtcggtttacatatctccaagtcttacttgagggtcaaggtatcccacgatataaaagggacccctagggagaggcgaagggcatcgcacctcatcgccaacacacccaccaaagtttacgaagccggagtccacggagccaactcgccgagagatgccgtcgaattcctcgactacgatctcatcggcatcgcgtattcagttactctttttgtaatctgttctcatcatcatcaatcccatataaactggactagagctattacctgataaggagcatgaactagtataatccttgtcttttgtctgttttgatgtcgtactacgtagatccctgttccaacgtaccccaataccctattcttccgatccgcgagtatcactcgtcgacaaaagcttttctgccagattatgcacttgatgaggctccatgggagataaggctacataaatggtacatggaagccagcaagaaaggcctaactaatctaacaattcgatcactggcaaaaactttagcctgtgaaggattcatttggcttgatttcaatgatctgcacgccatccatcgtcgagaaaagatggatgtaaactacgttgttgcatggtgcttgtgagtatgagtgtttatttattgcatgaataagtatgtgatcaattattaacaaattgctattatagtatgcaaaacatggatgctgagaatttagggaaacctatcggatttctggatctaacaaggatctgtcaaactcagcataccgtgagactatcaccaaactccgagcagctcaaggacaagactcctacagagatagcggaatacaagaagagcttgcacaagtagaagatgattattgtcgtacagtatattggacgagctttcttgcacttccaaaataagagtcatcatggttgcgtacaacttcaagtaagtcaagtatatttcattgtacatacctgtgttatttcatatgtgactaactgcatcgccattatgtagcgatcattacatatgtttcattatctacccgaagaccggcatagtgacagtcttggacccccttgattattctcacaagacatataaataatttctacaaatcttacaatagtaagtgattctcatacttgcatgcctactattaatgtattataattaaataacggtccttaatgcgaaacggtaaaaaattccatacagtgcgtataactactacaagttcaggggtggagaacaaacaaaaacaagggagaagcttctagtatatatgtattggccggtacgtaatactaactcacttaatgcatttcaatagttttactcatttcaaaatttaactactttcttctatctcatgaagtgtcacaagcaacctaagggcactatcatctacgggtactacgcaagcaaattcctccgggttaatgggaggtacagggttaacgcagaggatgtaagtctctcaactcaacgtacaagtgtattggagaactacacttctagatcgtactaatgtact

SEQ ID NO: 74973 - DNA, 5160 bp, Oryza sativa
agcaacctaagggcactatcatctacgggtactacgcaagcaaattcctccgggttaatgggaggtacagggttaacgcagaggatgtaagtctctcaactcaacgtacaagtgtattggagaactacacttctagatcgtactaatgtactatcgttctttcagttgcctagaattgaatgtcgaacaaggattcgacgatatgagtattaaaaatgtgcaacgggacctttgccaattcatccaccatgagtgttgtcatgtcttaggcaatttatctaccgcgagtgttgtcatgtcttaggcaagtttttcgacccagacagcatcctggtttcaagcgatgaatataaggttcttcgggagtggaataacgcgatgccatgatgtgtttattagttatagatgatagtgtgtattcgaagtggacaatataaactaatgtacaaatttttgtatgatactttgaatgcaatacatatcagtattgaatgtttattagttactatcattaattatgaattaattaattacaacattattcaaaaaattattaatacaatattgcggctattttcaattcttattgctaatttcccaggcggtcaaatcctatcttcgtgggcgggttttttatatcttcccaagcggtcctcctagctcccttccgcttgggaagatgacgttcccaggcggaccggccacccgcctgggaagataaccgatcttcacacgcgattgcctacaggcggaacaccggcccgcctgggaagcccattttagcccgcctgcaaatattccagtagtgttagctcgattacaaagcacacatacacaaatcaacctgcttatatccatgttactgcatagactttcttgtatttctgcaaaacgcgatgtgttttattacaggtggttatattactatgagtgaatattatcttactgcaaaacatgattttcgtcgtcacttcatgctaaggccattataatagatttgtaaaagtattattgctcaacatatttttatttgataacgacgatggagtatgcattaaaccttcttaaaagaaaacacgcgaaacttattatcatcgttgtaacttcatcgttgtaccttagcataatgtcacgatgggattgtaataatgtgacaacttgattgttaccacatgtttttacatgtttttacagtaacactcttaagaaaagaaaatatgtaacatgctatgttcctgtaaaccttatagtccgtactgcactcctgtagtaatatcgcaatgggattgtagtaacgtataatagacagtactgtagagagtataaatttttttaaaaaagaaaatctttgaagaacaatatctctcacatgatgtactaattctttaaaggtttgcaccatgttgctagaaaaaaaatgtttatcaaaactatattcatcatgactatatttgaactatagtttagcgtcgttactgcaactcgaataatcaaagtttcaatttgaatttgaaattaacttcaactaaaaatcttaaactttgaatgaaaaattgaaaactttcaaccctaaatttcaaactttcaacttatatttaacaccttctcagaatgtttatttattattgtattataaaaaaaagtatgcttgatattcatcattagcgctaagcacgattagtgctaagcacgtcattagcgaacgtgcgcgacaggagagagcgcagaccagcgggaaaaagaaaaaaacgtggcagcttattgggctttgtgtgggtcgtgggccggcagaaatgtagcgcccggcctgcggagccttgccataaaattgtgagttttagggttttgcacttttgctcctcatctcgacgccgccacgggagctgctcccgcttctcctccgtcgctctccgccgccgccgccaccgtcaccctcctcggcctcccgctggtctcctccgtcgtcctcctctgccgccgccgccaccgtcaccctcccttcgcatggcgatgtcgagcgtgaggaaagccttcgtgcgcgccgcaggggtacctagatcttcctctcctccctccctccctccattcttccccctcaatccactggggagagacctaacttaatttctaatacctttttacaggggccgatctcctccttcgctgagaaacggggctcgttcttctccgggccggactgtggaggaaaatggctggaggtctgcataatatctttctctcttttgcataacaaaggtcgatttgcttggagattattcagtgagtaaattgcatcttagaccactttttcttgccattgttgcaacttggactagggaaaaacaaacattttcactttaaaccacctatctttaccggttgtgcaagttaggctagttcttctacctcctgctaaccagctccctcttctcctcagttctctccctccaagggcatttctctctctctctctctctctcttctcgtatcaccgaagccagcgagcggtaaccccatcatgaactgcgccactactcctataggggttgctgctgttggggtgaacacagtactacatcgcccccaattagtacatggtttgacccttatagggggatgatgcaggataagctaacccagccatggtgacagccatctcgtggtgttgcacaaattggacgttgtcgggcatcacaacgatgttttccttgtagatgactgttaagatcgtcatcctgctgtggccctgaagcaatccagtcgatggcagtggacaacggctggaagaataaaatccgtttggagtttgttatgcatgcacgagggatgtggcgagctgcaggttgtggcgactgcgtcaagcgtgcgttgtgggcgtgagttttgtgcggcatgcgcaacgttgagtccaggagttccggatcgtgggatggcacgatttaggcctaggattcttttttctgttttggagtataagtagatttccatttttgtagtttacagataagttcaatgagaaaaccccagaaaatcgccacacaaagctagtgcgtttcgttgtttctctgaaactctccatttcttgttactctctgttcttctcgtttgcttgccggatttaacacagtgctgttcaatactggttcttctccaacaatgacgtgctccagcaacatcacatatgaattcacggcgcggtagttgagctcgatcattacatccacatggcaatgaggaatttcttctgccctttttcttctttttttctgtcaagtgcaaccattgtgccgaagctggtgccggcgttgaagctggtaccggcggagttccagcgcaagcacagcactggtgggtggctgctcaacctgctcacttgtagtggtggttcttcctacccatgagtggagagagaggagaaagagggggagctagaggtagaagaaacagtccaaactgaaacaaccggtaaagataggtggtttaaagtgaaaaaaaattgtttacccctggtccaaattgcaacattggcaaaaaagagtgccccaagatgtaatttactcttattcagttcattttcaaacaaaaagaaaaccccccaatgtgaaggtgttgtttagtttgacaccttatcaaatttgcaagctcttgtagctgagaagaaaataaatgaaaaaaaaatcaaatacaacttgggatttgatgatagcacttgaatacaaatgttttgttaccaacatacctttgatgtttttatttgccctgttctctcccttgtggttcttatcaagccagtttctttgatgccttgtgcgtctcgtgcgaacgtcctttttctttaagcgtgcatcacttagcatttcaatctgctgagcatcctctaggttaggacttcaccagaattttctaggattacttatgtgggaaatccattttttcttcaatttcctttttaaggatgttcagtgcattatcaactagcaaacaacattctggaaaactggccgcttgatgcgccaaagtgagaaatttatgagatagggatttgtagtgaagcatagcttccaactttggattttcgattatgtcgttcctgggtgtcccttatagttacatggcgtgcatcccatgtccatcgcttcaatatgtaatgtgttggcaatatgatctcttctttcaggatgccagggaatggtgcgatcgctggcaatctgttggatgggcaattggctcattgtgtgcaggcgcaggagtggttggtgggattgccgcgaggtacataaggcatgatgtcgaggcatatgttgatgggaagatagcgcaggtcgtatcaaaaaatgatgagttccgtgtggctgcgacaaaaactcattacgactttcaacagaagatcagtgacctctttctggagtatcaaagggagttaaacatgttggctaagagtcacctgcagtttcagagagacatgatgaagctggagcattccatattccttcttcccaatgtaagcaatttttactgttacttctacatctccttttactaaatagtggcaacactttactcgagcacaccacttttagcaatacttgttttcctctccttaagtcacatcaccctttactaggaaatttaactatttgccacttttacgtttgccaattgttcaaataccccttttaggtttgcaattaactatatgccactagagagaagattttctaattttttttgccacttttcgcactgtagacagccacatggccttgccagcgtggaataggcacctgaaatgacaagtatacccttggtagcaattggctgcaatatagagccgaatctgaaacaatatttgggcaaaatgataaacttattactactagctaaatgtataattcatttgactgaaaccatacatatataggactgcaagaacaatgacatttttttgggcaatgtataacatatacaagttgatgacaacacatatatgcacaaggattaatatttgtcagcatacatatccatacatatatctcaacaaactgaacatgcacacaatagcagaagtgccttaattcatcacgtcccatccaaatatcttaattcatagccatacaattcctaggttcattgcaggccacacattatcccaaaagtagg

SEQ ID NO: 74974 - DNA, 2724 bp, Oryza sativa
tccgggagtgacacttacccactagacatgtggaagtacggtagtgctttgcaacagaggcccaaagaccggtccttatgtggccgaggtgctactatcaaaaccatgcaccccgagcccagcctaaaaccattttgagggttttgaatagagggggaggtgtgtgtgtccaattccacaataattcaaccattccatagtgtccaagtgatatgaatattcccaaagtctagagttacaaaaccacctaatgttgtctaattgatcagcgaagcatctacctaaattcatactagtggaaccatgaatagagtactcactagttggggtttgtttattctagggtgaacaagataataataacaataacaataataataaggtcataacaagggtaaataggcatggctaaataaaacagtgataacgcgggaatttaaataaagcgataatgcattaatttaaatcaaaataatttcataaactgggattcaatatgttcaaagatgatgtgacttgccttgctcgctttcccaaacgtcggcttcaacctccacgtagagcggatcttcgaagctgcagcgtctacacgaccaacggaaaggaaaaatgcttttactctaataaactccatataacaagcaggaacaaagtacaaaaatgggttcttgacttcttaaggaaaacttagagacttgaacggtccaattccgagttcaaatggccaagttatggccatttgaagtttatatgctctttaagtgaataattgtgaatttcttcatttaaattttaatttaaaaaagatttattgcgtcagccaaggggagggggggtgcggaccgggtccacgggagtggggcccacgcggcagcctcacggtccacggtggaccgggcgcacccgggctcacaccggccggcgccgtaggccccacgcatcagccgcacccgagggcacgggcggctaacggccgggccccacgcgacggccacacggcgcgcccggaggcggccacgtcggcgcggccggcgggaggcggcgcctgcgcccctatggtcgccggcggcggccataggcacagcggagcggcggccaagagaggggaagggaagggggaaagaggcggtggtccacgtctcaccccgggtcgacggcgacggcaaaggaggcgtccggagcggaggaaggcggtggcgcggctcgggtggacggggactatggcgcttcggcggtcggcgagctcggcgaggtggtggacagggtcagcgacggcacggcgaagcttgaggagacgacgccgaggcgggaggcggtcccggcgagcggagagggccagccggaggtcgtcggtgacggaggagagagaggacgacggcgcgagctcgattctggcggggaaacggtgcggcaagtggcagaaacgggcgagatgtcacgcccggaatttctatccaaaattctaaacgcttacatgtgtgttaaaccctcgtctaggaatgagccgaggcacacaataacaaattgatagtagagtacaaataaacagctatttaatattcgcaaataataatttattacagaggtggatagttcctctcaaagaataacattctacgcagcggaaaaaaaaaacaaactacgcaacagctatggcgactccactccacaagcaacttaacccggaccaagcctagtcctctagattatcaccttcactgaagtactcctcctctgataaatgaatattgcaagaatgagcatatgacatactcaacaagccacacagcaaatatgcaagtgcacaggataacaaaggatggcataatatagctcatttgcataaatagcatttaataaatatttaagagaatagtaaaacagttgattaattaatcagtattaaataaacaccatacaacacacccgtgttgcataggcccaacctcatctgaacaaccaaccccggttgtacaaatcaaacctccataacaggaatataccattccaaaccaggagtcaaattaattagcacaattaccattaatgaataatgtgagactaattacgaaaaacattgctcaactcacccataaccgcgggcacggctattcgaatagttttactctgatctaagatgtaccactgtacccacaagacacaatcccacaatcccacaacatgtcaccatgcgcctagtaccaccacggtacctcggaaaggaactgtgacagtacccctcgcacaatacaactcaccacagtgcaccatacctggatcataatcaccccctctacaaccagaggcatggactccccagcgacccccacggatgtcacgtcccaaaacaaccttaaaatatatccttcaaattatgcctagaataattaaaatctgagtgaaagcctccaaaaaattaaaatgtgcaaagataaaagtcaaataaggcttggaggatttttgtatatttcctaaaagcctaaaatgtgtaaataaattttagtggaattttcagagtacaaataataattattaagaaataaacaaagttgaaaaggttttataaaaagaaaaaccctaaaaacctcctcccctctcatgggccgaatccggcccatctccctccccctctctctcctctccccacggcccattcggcctctccccgcgtgcgcgccactgacgggcgagcccacccgccaccctcgctgacgggtggggccc

SEQ ID NO: 74975 - DNA, 6895 bp, Oryza sativa
gtattcgcttgaacatcaactgcagtagcttgggcatcaatggcaccctttgctctcttccttcctacatttgtttttgtcttcttgtttctcttcctgcaaaacattggttaggttaagcaatacattgtacaatagctaaaagaaagtaaatcatagctgaactaacctcttcctagttccagtcagttcacatcttacactacctttcctatatccaaactgttggcagtctggacattgaacttgccttgtggcctttcctttgcccttttcaagagcagatgggatcctattctttctctgcctacccattcctctcttcttgggcacaggtggcaggagcttgaaacctttgtcaacttttggccactgcttcttgtctgtgatgttagggataacacaggaaatttaactatttgccacttttacgtttgccaattgtcaaataccccttttaggtttgcacttaactatatgccactggagagagaagattaatgtgtattcagtggcagctcataatgtgtattcagtggcagctcataaaattttttgaatccgccactaatcttaggtcacatgcaatgctaatctgttatccttttcgtttcagtttgctccagaagaaaagggacctgtgggtgctgtgggaggtgacaggggacctgtggatgctgtgggaggtgacagggaaccagtgggtgctgtggggggtgacaagggatctgagggacagctgaacctgtaacattcaaaagctgattttggtggaggggacttcaactgatgcaaggatggacctgagtgtgcttcttcaactgaagcaagggatgacctgagtgtgttttttgggctgcttaaaaaattaggcagttatgtgacctagactctattccagctcacgtatgtgctctgtggttgctgatctttggacccaatttaaacaatgggaatgtgggatggtcaaaagttaacttctatttttaacaatcaagctgtatcgaaaaattcgcaggttacaatacaaagagaagtacaaaatctaatttgagaaacctctcagtttagatttaacgagcaggaaatattttgtgcactcgagccctcacgtgtacacaccgtgtacgtcaactaacaaacgcttccaaaatatctagaaaaaaaatatacatatactttcagtagcattaggtgtaaaatctcaacctaaaatttattatattttggaaaaaaaagaggcagttttaaggttataattctatcaaaattttatctttttttttactctctatatagaatgaacttgatgcgattttacacgtatatataatactattggaactacatatgtatttcttttttaagaatttctggtgatattttttagctacggcgtgcacacacgagagattgtgtcataggatacactctaacgagcgacactcatatgtgagaggagtactaatacacgtgcatgccttttttttattaggcatgcatgtcttttttttttctttctataaaattttctcttaaattacatatccaatctacaattcgattacactattaagtttgtaacaagatattacatgatcaaattatgatgaaaatatatttatatttgtaaataaattttattatatttttaagttacttttaccatatatataaattaatttaagatttgattaaattacttcttatacatttataatgctctaagttgattatgcttattattatttttagtcaattatataatttgtggactctaaatttaatttttagatataccatatttttctccctacaacgaatttacctctaatgtgtaacaacttacttccattttgtgctaagttgtttttatgatttatgtaaattacttttatactttattgaatttactttcataaatgcatttacttaaaaattttctctgcactttgcttgtgaatttactctacatagttcttatttcaactcagtcataatgtaattatttctaggaaaaaagtacgaattaccccttgatctatcgtggttgaccgaattatccctctacacttaaataccagatattttacacactcaactattgaaaccgaacaaataatcctcctaactcagtctggtgtggttttggtcctacgtggtaatccagtcagcatttttttattaaaaaatcggtagggcccacctgtcatactctccctcccctctctgtatatctctatccctagcttccttgatccctttgctgaagcgcatggctagatgcatcaagcccgtcgagctcgctagccgggtgtaacgtcccgattttcgttcaggattaaaaatcattacataatgcattttctagaaattaaataaaagttaaagcaatttgatcaagtgaaataatgggagaattaaaattttctttcccttctcgggccggccattctctccctctcgggcaggcctcccctcccttggcccgctcggctccctctccctcaagtctgcaatgcctcccccttggctccttcctctccccaagccaccgacagtcggggcccacatgtcggttcctcccccaacctctagctccccagccgaaactgccattgccgcccatgtcgcccccgattctggcctctcccgctcgcgcccttgcgcccaaaccacgtgggatcagttcccctccaccccctccaccaaatcccccacttttccccaatttttggcgccaaatcgagcccccactccgctcacgttgagctccacgtcgccggctgttgccgccccaaattcgccgctccccggctccccgttgctccctcgcgctataaaaagccaccccgtgctgtgcctcttctgtttccccctcctcccccgaggtcctcgcgccctctcctgtgcgagcccgcgctccgccgctcaccaccgtgcctcagccgccgctcggttgtcgcctcccgccaccgaaatcaccccttcaacgcgtacccgaggcacctccgccattgctgcctccggccgcgtcgcgtcgcctcttcgatcgacgccgacccatgccaccacctccttcggcttcacaggagcgagagctacctcggcaaccactccccgtcaccggaatcccaccggaacttggttcccctcgctcgccgatgagtttcaccatctcttcctcctctggtcggcgtttctcgctgcgccgcaactccctcccctaccctaaccttccctccttgttccccaggtccttccggccgccgtccgccggttcccgctcacggaataccgccggaccgccgttgccgtgccaccccgaggagccaccgccgccttcccgtcaccttctcgccgttgcgtgagcacggtgagcactcccctccctctccctctatctccccttcaccggccgtcctatgccgtgtcgccgccgccggtggccgtccggccaggccgctgccgctgttagccgctgctcggccgggccggtctcggccacacccgtgccttggctaccctgcccatggccgcccgtggaccactcccgtggtctcggtccatggtgccgccccgaccgcggtggaccgtgtccaccgtgtgccctccccttgtgccgctgacgcgtggggcccgtctgtcggcgccggtcctttgcttacgtcagcgcttaacttaccctttgagaaaataaataataattgcgcaataagtcgagtttaattctataaatacattaaaatggctcaaaacttctaaaattcgtatctaattcatacgaacttcaaattgggccattcaacttgcaaaattcatccaaaattgagctctacatgtttgtttacttcttatgtactatttacttggtgtttattagagtttttcctagttttgcatgccagcgagtagattccgccatttcggaagtccgcggtcgcgaggaaaagagttcagaagattgtttgaagaatcaaggaaagtcacacattccccttgagcattttgagcctaatttataaatgttgtatcatttggaaataaaattgcatgtcttgctaattacatgggatccgggtattacctatctgctcacttgtgccatgtttacttgatatccgtcctttgctaaacgtgggtgataattcaactagcttgtgttacttatgttgacctagctagactcatatatgcttagccatgcttaattaccactagctcacaaaatgggataattacatgattagacatctagtatcttgatgagctgcgtgctcgaggcatccggccatgtttcatggtcgtaattattcaactaaaatgcgactgaatggtgggctgtgggtgcatggttttgcttgtcgcacccatggcaataattaaggaccggttcacgggaaaccctggaagacatatagtgcttaccataagcgggagtgggtaactgcttgatctgaagtatagctcgaccctttcctaggcaccagtggcgagggtgggcgtaatggagttgggtcgcccgaggtgtccggttgtccagttgccggattcaccgcggcgcacgaggggactgcccacctccggggttgggggtgggggtgaaactttagcgtggtgtggatggttatgggagggttatgcgaagggtcttgtcacaatcactcgacattgtgacgtgtctgcgcaggcatggtgacttgccggtggattgtgtcttgtgggtacagttgtgcacctctggctagagtaaaactattcgaatagccgtgcccgcggttatgggcgatcgaccagattcaccgtgattagtcccatccttaataattggttaatgaactggtgtagttcaggtggtttggttgggcctgttcaacgtggtgtagcgttgatcggtggagatccaatgttactttgatcactcaacagttttactgttttactcaataaaatgctttacatccgcctctatgcaaatagtgacaaaccgttcttgtatctccttgcacgtctacatcattggtgtggcttgctgagtactgtggttgtactcagccatgctattgttccccctttttagaagtgtagtgcttctgagctgaagacgaagttagagtaccaaggcttagaccccggttgagttttgcctgtggagtagagctgaagccccgctaggatcgccttttttcgctgtcgtcgttctctttcggtgtgaggactaagtgcctcttctgtaagtattttacgctttatttatgtttggaactgtatattacttgtcgttttgtgcaccctggctggtcctggatagggatttaatacacaaaatagtctagaaatttgggttaaatttcttgacgtgacaccgggccacctcctcctcctcggcatagcagcacatcgtgtggaaagtattggtggaaacgatcgtgtggaaagtattggtggaaacgattgcactgatcctgtgtgtcgccttcgtgttgatatatatgacatgaaaaaccatgccgtggcaatgcaaagaattgcgcagctaggcaacaaacctagccgacttacaaggagatggattacaggcgataatggataaggcaacaaactctaacagatcagccattatcgcatgtgataggatcggttaaaccagatccaaactaaccttatcatctaacaccctctctcaatccaaaccgtgcaaggttcaggttgctcttgaaattctccaacagtcgcacagacaaaggcttggtgagcccatctgcaacttgatcattagttgatacaaaatcaatttctaaaagcttttgacttacccgttctctgacgaaatgatagtcaacttctatatattttgttctggcataaaacactggatttgctgacagatacttagcaccaaggttatcacatcatatcttagcagctctaggcctcttgactcctaactcagtaagtaaggttatcacacattatttctgctatagcatttgcaatggctttatattctgactttgtactatacctagacactgtggcttgttttctagcactctaagaaaccagatttgaccccaagaataattcggcctctgaatcaattgtaacgtgcccccagcttcctatctgggaccagtcaaaccggccacgcaatgccggtcagactgccctgtctgcacggtcggaccggccacgcaataccggtcagaccgccgcgaccaccggtcagaccggccgtgcaatgccggtcagaccatctctggtctgtggttttgccaattttgcccaaagatttaaagtcaagcaccggcttttctaatatcaaaaataccccattcttcacattatagccagatgcttgttatatcaaattattggaccaaacttccttctctctagacatatgaaaattttaatatccaactaatatgactagatgaatactaattcaagtggcttttgaaacaataataatcaaggcataaaaacatttagccacttgaagtataatcaataatgaaccaccaaagtcatatgtttcacatgcatagattccataaaactaaaaatgtcagtaatcggcttgagcatgtatgcaaaatattataacaatgccaatattcctaaagataacaactctagatagtattaaaacaaatcattatattggccattgacataagccgaattacaaagaagcaaaatttcatggtgcaataattatgaaatctatatcttgtatggtgatccataaaaacatacatgatttggcttttaataaatatcaaataccaataagccaaattatacttaaataaattatatgcccactttctaattccaccacttaaaactggcatttgcaacatgtttgtataatatctaattaataagc

SEQ ID NO: 74976 - DNA, 1466 bp, Oryza sativa
aaataatgcataagttgaaataaaacattagctttaaacgggttcaacatgctcaaaaggttgtttgggatttgtgtgacttgccttgagcttccacaaaaacctgtgaacattcctcaactgaaacgctctcctcgggaacgtcgaaactaaagcaaataaacaaaaaatcaacaaaacagtaccaaaaacaaggcataaacagtacatgtggatatttttaacatgtagatctcaattttagaaaaatttagcaacttgaaccactcgaatcggagctacgatgaattagttatgattttccgaagttttaatctatttcatctattaaaaaaaactaaaaagaaatggttatgacgtcatgctgacgtcatctatgccggccatggcaaaggcgacgacctcgccggcgctaggaggctcggccgggcctttggtgggtacctacgcgtagagggaaacgatacgatctcaaaggtgctcaccgaagcgacaaacgacgacggacggcgcccggcgacgaggtggtgcggcggcggcggctcggtcgacgacggcggcggcgctacggcgaccggagacgacggagagggggcggccgggattctactccctcacgcgcacctaacggcggcgacggcatgcggcggcgacgacgcaagcggcggcgcgacgcgacccgaggtcggccggcgacggcaagcggctagggcgacgcggcggcgactctacggagcactagagagctcgggaaagggggcaaacgaaagaggacgactagggggtcctatttatagccttggattggagagatcggactcccacctcgagtaatcgagccgggaaaatcttcgggtttgttttggggataaactcgaatatgagtccgattcggttaaaatactcaacgatttactccgaatcttgggggcaaagatagaggagaatgaggggatcaaaacccctcaatcaataggacacggggagaccggattggggcggaatcggtggaggaaggcagcggctcggatgaactcgggcggctcggccggaggttgaagaaggcccgacaggtgggccccacctgtcggcggctggagaaggagggggcgggcggcgtcggctgggccggcttgggccggctcgcccgcgcggagagagaagatgttgggccgaaatcggcccaacgacttaggggaggattttttatactttttaaattaaattaatttgtgaaatgttgtttcatttattaaaaatacttcccttgctcaaataattcccagaaaaatctagaaaatagaggaacaagcaaagtatttataaaattttatctagctcaattttatgttgaaaattttgctagattattagagtttagcttgtaggcttttaaaataatttctaaaaatgatttaaaatatgcattattaatttaggcgatttttagggcgcaacacgaggaa

SEQ ID NO: 74977 - DNA, 1767 bp, Oryza sativa
ctgcagcccccctggccgcgagcactccctctccagcctcctcatcgccctccccgccagcgccgcgcatgccggctgcctcagcctcacctggcagtagcagaatggcacgtcgcatgctgccgtcgtaccgttcgctcccacctgcgacgttggcggcagcggcggcgacgcacccaccggagcagagcgcgctccgccacgccgacgcactcctccgcgtcatcgggaagcaccggcaagtccaccgcaccgcaagccgcagaacatcaacgtcgccgtcgccgtcgacagccagtggctcaatggcgggcaggtcctggcgctggacgagcggtggtacgagatcggcgggtcgttccgcgtcgagtccaagccggcgtcgcgcgtgatgctgtacgtcatccaggtgcgcaagcgcgatgtggtggtgaaggtgaaggcggccgacgcgtggaggtgcggctgcggctgatgtcgaacagcttcccgctctgctctgaacacggcatctgcgtgcgcggccactgcatcttctgtgaggtggacaacgcagtgcagcagtgggtgaaggcgcttcccgccgacgagctcttcgccgccgtgagcagccgcatcaacgtcctgctcacccggtacaaggcaagttccggcactacgatgtcaacaacgagatgctgcacggctccttctaccaagacaagctcggcaaggacgcgcgtgccgccatgttcaacacggcgagcgagcttgacccagacgcactgctctacgcgccgcgccggtcgttgtaaaggatcgtcgggacgaagaggacaagaaattagaggggctgacatccttggcctacatagggcaatctggcttttttcgattgtttctctctccgtttccactaaaaataataaaataatatgtccggtgtctaatagctaattaccactttttgcaatgttctacagccgattcatgtttttgtggtgtctcacggctaattacacgtttttttaagtgtcctgtaaccaattttgccaaaatataataatttgtccaccaattctcttcccactccatctacctaactcttttttatccaatcacaaatttttctcatttaattatatctattttcaaaaaccgagttaagctcgtaaaattttatattctgataccgagttgatggtagtagttcgtttagaatgatggcagagactgcttgcgacatgcgtgccagattggcagggagtagctatatttatggcgtcatattttttatcaaaaaatagtcggcatgtatttacattgtaagtccctaaattacatatataattttagtgtatttacaatgtaagccccaaaattacatatgtaagaactaaaattacatatgtaaatcccaaaattacatactaattacatatgtaagtggtatataagagaggtgtaactactatagttacataggaattacacatgtaactatagtacaattatactgtaattatatctgtaactgcagtgtaattaaaaacagacttgacggtgagctccctatcttcgcttctccttttcttgtccttttgcatgccatctgtgcatggatcttgttttttactccgtaatgattagagatttgagatagtatcagcaatagtagtagttacgatggcattagagtctcgacatgcacgaatctctgaactaattgcccagtgaaaaaattgactgtaaacgggaaagaaatatggcgtcatatgtatagcaatt

SEQ ID NO: 74978 - DNA, 5529 bp, Oryza sativa
actctaggaaatcaccagtctcttaactttttattccttaggtctccacacttgcttatgtactgctcaaggttctaaatttttacatgtttggtccctcatgtcttcggccttcttttctttttgacctatggctcgaagacgttgtagcctcctcttttgagagcgagataagtcggaagtatccacttcggctgtggttgttttccaggagctaagctatgattcttgatatttttggtcgaagtggaagctcctgtgttgccctcaattttctcaatattctctaatgccacccggtcaggccggtctttgggcccgatcagaccagctacaagccatcggtcagaccggccgtaggccggcggtcagactggcctgttggcctggtcagatcgggcgtaggccagcggtcagaccggccataggccggtggttagatcggccagatgtcccagtcagactcccgctattggcagtcatggtgtcggcttcaaccttttctgcttgtatagtttccaccgcatctccagtaggaacatcttgagactcttccttgataaaaacgacctccggagttttggcttcttttctcacccacaccttcttcacctttttaacctttgatccaccagaccgattcttttgtgagaaacggtcttgtcttgagttagatgaatgacttggtactgtcctaggtgatcccttccatccttgatgaaacagcgtagagaattgaggcatccacggcatgtaatacagaaaaggataaccgaatggtggcattggatatggataccatggcgtcacaaccggaggtttgtatggagttaatattgttgatgactttgattgctttggggttgaccaaatctctttctaggaagtgatcttggtcctcttaaatcactttaggccgatcatcaaatcattgatcggccaatcccttattgtatttagccataagcatctcaaaagtgagcttcggctttttagtcttttgggaactagatgactcatcttttgcaacgttacgatctttggccttagaattattgatcataattgtctcaggccgaagatatctaataataacatttttccctttcatggattcggcttgactaggccgaatcaacactttcttcttgtcaaagtcaataggagcaataggaagggaattactaacaattccggtcttaggcataggtgtaaccgaaataatttcacaagtgaccgatgaatcatcaaccggcctttgctccatcaagcttgcatctttaaaatatcatgaaactcatgctccatttgtgaccaagtagaaatcgaactaggagcaagtaaactaaaccatatagatgcaaagtttaacaaagaaagaggaaacaattttaacttaagcaaatcatcactaccggccgtaccacattgatcaataaagtggctgatatgctccattgtagtcatagtattctcacctgtaaatttcgtgaagttgggcacctcaaatccttgcgggtatgggaccgaatctacgtgttcaggatacggcctttgatatgtacgcatagctacttatttagactctatttcactactatcccgcaagacattgtcacaatcttttccaacatcgacatgaccgatttgcgactcggtcttagatgacagtactatttcgctttcgcttctgacacaatccgaaccgtcagttagttcggctatattttcaatggcactactgtctaagctaacaacataatccgaaccatcacttggttcggctattccattattgcctaaactagtaaacaatccgaaccaacacttaattcggctatacttgttattgcactattttccaaactaataacacaatccgaaccaacacttggttcggctatacatgctatttcattatcatcttaactagcatttaagctattgtcatccactcggctttcctgagccagagcttcatgcaacacatgatcaacatcaagaaatatctggccattcaatctctctttaatataatcaagcaattcattatatgcaatgtcggtcaaatccttttcagctgtattcaaactaaaacatcggcttttagcatctctaaacctctcaatataatcagtgacagattcatcgtgtttgtgcctaaccgatgttagaccagacaccctaaactcagtttcaccagtgtaaaaataatcatagaatttttgttctaattgagcccaagtatgaatagaatttactggcaaagaagtaaaccaagtaaaagcagtaccagacaaagagaaagaaaacaaacacaatttgagaacatcattagtactagcttcaccacattgtgcaaggaactggcctatgtgtttccaagtagtcctcccatcttcaccactaaacttagtgaattcaggtactccaaaaaccacgagggtatggtatattatcaaaataatcaggatacgacttttggtaaaccttagcacaatttcttggctcaattccaaatgcttttctaatgatgttactaatttgctcttccatattctcaggccttggttgtggatttggtggcctaagaattggtggttgtggcggcacaatatgattatactggccataatgcgtgttttgtgccaatccatccacttgatgattttggactagctcatagcaactgttggcacaaatagcatgggtatgtggaatcagggtttatgattccgacgaaatccgaccagatttcacgaaatttcgacgtttcgatgaggctcgaaagtagaaaccgattgagatttcgagatgtttcattcaaattcaaatttgaattgataaaaaagagaaaaaaataaataaaatattataaatactatgatattcatagaacctattgggatataaattttcaaaaaaatgatgtattgtgtgtatttactgaaacttacatcaggaaagaaaagaataaataaagaattaaaaaaggaaaacacttacatgggccaaaaccgaccgcaattaaaaaaaggaaacacttactgatcgaaatctcgccaaaaccgatcggttttcgagaacttgtcggcaaactcagggaatttctattcaaattttggtttatgaaatttgttcggaatttaccggttttccaccggattttgtgaaattccgaattgcgctagtgttcgaaacagaagggattgtcggaatcgtaaaccctgtgtggaatagcatgactaacaacattaacatgaggcaaataacaactagaatcagtactattagtcatgggagaaaatcctggaagaggttccggggcatcggtctgaccggctatagatagcccggtctgaccggccaagcacccaatctgaacgggggtcagtgatgcagccagactggccacaggaggcatgatctggccaagataaggcacggtctgaccggcatatggtacggtctgaccgggcgtcatgcacggtccgaccgttggctaggttctttgtataaccgattcctgtggaatcggctgtgtgaacgcccgttgatctatccattgtattataggtacattgtatatatgcaaaagtagaagtagcattatattgttgataactggctattttagagccagttttcttaatagattcatcaaatgtggttttaaaaacatcttctaacatatcatgatttttatcaatataagcattaatagatgcatctatacaacgttcaacatgttttcgaataacaagagatggatcgagcggattggaggttaccttatcagggacaagtttgagaggaggaccaggtttgagaaccacaccttgatgcatgggtcctgatgagcgatctcgccgggatctcctccattatcgcctttattcgcttctccatgacttgacgctgctcctcatcaagatcctccaatgtgatctcatcgatctcgttcctgctcgtcatggttgatgaataaattccttgattaatttcggccatatatcttatagccgaaacatttgacccaatagattaatatacagtcttaatttccttggtatgttactatgtgtatgtagcaaaaatatccacaaatcaagaaatcagtagccttggtcggccgatctcttgtgtattgtgggatgtgtacacctagcaaagatatttgatctcttggtaaacaactgagtaaacctagcaaaaatttggaaactaatctaaagccttacaggacagccgatataattgaatcggctttgattgattttttttattggaaaccgatcttgatttcttttctcgggatatgtgctaatacatgcgacacaggatcggtattgctcgctgtctattgcttgctggccttgatgtatgtgtgtacacagaaagcacaaaactgaagcaccgcatccttgatttgccactgaacctacattgttatagatatatgaggatccggacccatatattatagacagtaagtagcaaataattaattgacacatcttaaaatgacccaaagttaaatgttccccaggcaaaaactcgtcactgctgctcgtctttgaatcggcttcggactggtaacagccaaacgccgaaactttgtggcgaaggcaaggacggcactcggcgtagattgaagcagaaacgatagcagtggccgaagtatagattaattccagccgtatggccgaaaatcgaaacatttgattcgacgaaactatatctgaatatttaaataaaattcggtcgtaatatggccgaataaatcgtttcccagcggagtcatcaaaaatcatgttagcaacttctttggtaagaaaacaatcacgatcgggacatctaaacgccttgcggtaatatggagttgtcaatcaccccaatctagccaaatggtcaaatcaagatggattttgtagaaaaacagctaaaccagctagcggagccgatttagatatcaaaaccagcctctaggccgatttagattgatatgaggataactacccgtcgcgtgggtgaacggaaggtttacgggacaaacctacaaagaaataatcgcactctcgcggtgacggcgaacgatttacgatgaaaatagataaagatggactaaaactaaaataaagtagaaagcatggctaaaaagtaaaagaaatatgaaaaagcgattcaagtaggttgtgtgttgttggatagattacaattgaaccggccttgtcccttatataggggttgatcttaccctctacatgcccttctccacgtccaactcagactagaaaccaatagaaacccgaaacctgccttcccgagcaaggaaacccgagacctgacgaaaacggagtttgactcggactctgccagtcagaccgaccacatgccgcctgtttgaccggccctctggcagagatctgaccggcccacatatggcggtcagaccggccctctctggaggaaaccggcagagccccaaactttaccaatttttcctatttgttaattctagatgctaaa

SEQ ID NO: 74979 - DNA, 5666 bp, Oryza sativa
aaatgagaatggggtgaactttaggtgctattaaagtgaaccgatatcttcgatgctataaatacaaaaacgtgaactttcaatgctatataaccaatttttcataaaaacaacgataactttgcagtgaacctagcttatgccttcaatgacacaatcaactcctagtctctttttgaattgcctttttccggacagactctatacctagtcaaacaaaagggcgattcccgtgctcgccctgcttgatcgagctttcatcaactactggaataatcttgtagctttcatcaactactggaaaaatcttgtccaaaaccccaatgtgaaatcactcaggcctcatttgacagaccgggatcccggcccatatcccgagaaaaagcccgctagaaaattttcctacgaccatatttcctgaccagggtgtgtttagtttacgttaaaaatagaagtttagttgaaattggaatgatgtgatgaaaaacttgaaagtttatgtgtgtagaaatgttttggtgtaatgaaaagttgaaagtttgaaaaaaaagtttggaactaaactcggccttagggtgtgaccgtgtttagtttccccctattcccaactttccatcacatcatatcacataaaatctttcctacacacataaactttcaactttttttccaaactcccaactttcttcaaacttcaaaacttttttcaggaactgtgtttagttcacaccaaaattggaagtttggttaaaattggaacgatgtgacgaaaaagttagaagtttgtgtgtgtaggaaagttttgatgtgatgaaaaagtctgaagtttgaagaaatattttggtactgaacacggcccaagaataagttcatcgaaggttcctcaacttaacaacgagatttttcgaggtcccttaaccacaaaatcaaaaatatatacccctaaacaaactcactgaaaccgttcaaaaagaggtatttttatttggttttgctgacgtggcatcctagtcagaaaaaattacgtgggacccacatattagctgcacaattttttccttctcttttcttctccttatcttcccttttctctcctctcttctccggcagcgggcggagagccaggggagtggatggcgaaggtggagccgggtgtgctactggcgctaccgccgcggcagacggaacaactaaccgaccatcgctgctccgcctgcctgctacgcccgtcgaccgctcgccgccgcgctcgcccgctcccgcccccaccgatgggagcgaggcggccggcctcggcggcgtgagaggggcataggagggccgagagaggggcggaggcgacggcggcggtgctgccgagttcctttccctgtcactggtcgctgaccggtcgagggacaacatcgacgccgtgttcaacccccaatggcgccgtacaattctactgcttgctatataacttaacgattataaagcttgaaggataaattgaagcttcgcttttcttgagctatggtgtttctttgcgttttcttctttgcagcgaggtgaccaggcgctgtacaacgggttcggggccgccggaatgcatggtgacgccgtcatgcagccgccgacattcgggcaggtacgcggccaagaactcctgtgggttcaacttatcccccgattcattctgcttctttaccagcgttggaaacaactgcctgccgccgcgctcgcctacccccaccgctcctgcctgcttcgcctgccgccgccgcgctttcccgctgtcgccccgcccgtctcggtccgtcgaagaagacgacagaagagaagaaaatcttaattttaatcttaactatttaaaagatttggatttttcctttcgtcacatcttcaccccgcgcggtttttagtcggtaaccccttttttcgtccgtaaccctgttttttttttccgcgttttccgtttttcccaccgcagcgtccacaacagcgatttctgctatccgatttgtgatcggatctaatctaatatgacgctacttttcccaccccatcaaaaaaaaacaccgattcctactccagcgcaaatcacgcaaaaaaaaaaatcccataccgattcctactccagtctaacagattaagcccacaagcccaagtttaaaaagaaacaacaccgattctaatccagtttgcgtgcacaggttcagtatcccccacaccgattcctactccaatttaatattacattacattacaggcaatatataagtataaataatagaagcagacaagaaaacatatatcacaaggctcttcctctaaaacatcaagccagctttcaatcaggcaatagaaataatagaagcacacaagaaaatattaatcgcaaggctcttcctctaggacgtcaagcaatctccaatcaatgtcgattccaggttatcaaccaactcaatcctgaatgcaattttaatttcataagataagtcagcttatgaattcgaactaacagtaccatcataaaataaaagaggtcaaccagacatacatgaagtttttatacagaaattaaagaggtcaaccagacatacatgagccttgttttcagaagagaatgtttagctgagcctttcatatgcacaaccaatgctatgtatggttttttttcccgtcgatgcagaacagttagcaagttagcaacagtcaattttttcaagttagcaacagccaattttttcagttgtccagcggcacatagcaacacggaagttccagacgggtccttcaattcagacattcacatgaatgcagaacataaatcatgcacacaacaaaatcatcacaagagcttgcaatcaattaggctactcaaaatgattgttcagattagacatataatgttttggtgttttcatactactattacttgactaactaaaatatacaggatacaagcttaagcttgcagtaagtggaagtgcacaatataagaaccatgacagtaatctgattcctacagagataacatatcaaagacagtaatatatttgatatagtaccagtcataaaccaatcaatctataaccagcaatattgcgcagcgattagaggtggtgtgggaattgaacttaccatatatcttacctattgaccatatattttcttcctgggctcctggtgtactgccatacccaccatcacccccattgctgcccaagtaaccactagcaccaggcatcccattgctacaaaagcctttgggtttagtgaacctagatttgtgacctgcaaaaaaaattttggtgtcagttggaagatacagaattagacagtgtcaaatactgcatgtgtcctgaaactgatgaaaattacagatgtgaatctcatctatgattagttaagatgtatttgtctctatgtgctgaaatgccattgtttcctatttcaacaaaaaatatcacatgaaagcatcggcattcaaccaatatagagtaacaggacaagtttttaatcaatattgttacactactccacctaccttggttgatccactcaaaccaaacaaatcaaataaactagggtctgatctaattattctgacaaaaaatagtgaaaactcaaatcaacttaagaaaactcaccagttcaagcacctctactgcgggggggtcaattgtcactggatccggcggccacagcagcatcctcgttggaaaatccatagaggtccaccttcgtccgacaacttgaaccctcctatccggacgaccgaacagctctgcttgtacaactcgacctccagattcgtccactgcaccatatcctgagacatccaacaaaacaaataccaatcagaccaaatagtgatcatgggggacatcacgagacaagaaaaacccaccggatccggcatccactactcaatcggcctcctcgtctccgaccgctccctccgcctaaagaacgagaccgccccaatccgctcggcaccgaactggaccatcgtggcagctcgatcctacgatgacgactgccacccaacggcgaaggccgatccatcgccagtgagctcgggggaattggatccgtgccggcggactcggtggggggacgaggaaggggagctgaggagagggagaggcgccgtcggtgggtggtcgaggagggggatcggcggagaaggagggcgtcgctgagtggcggaggagaggagagaaaaccgagaggaaagaacgaaaggaaggaagtagcagaaggaggaaggcgatggatccatcgagagcatctgagcacgacgaggagaaacatggagaaagtgacactgccgcctacgggaacccgccgcccatcgagggcgcggccgccgccgccgccgccgctaccgcctccgccgggcaggcgccagcggcgagagcccgttgcctcccctcctgccacatctagcggaggggagggcgcggccgccgccacctcctccgctgggcagccgccggctacgggagcccactgcctcgcctcccaacgccggatccaccgcccaccagcctcgtcgccgccctcgagcctccccaccgttggatccgccgctcaccagcctcaccgccgccagccaacgatggagatgaacatggtggcggctggatcgacgcgaggaagcagcaaccacgacttgggccagtggtggatctggccggcccgtcgccgtcgacggcagaaccgcaggatccaggcgagcaccactgccggccgccttggtgagtagcgagagattaagagagagtgagagatagaacgggagagagaatgatagagttagagagtgagaactgcttggagagtaacgagagagagagagggacacgacactgtgacagacaaaatgggagagagaacgagagagtgagggagttataggataaggatgtcgacagaccacacaaatttatctcctcgctaatctttcttctgtttttaattatgtaattatctaaaatcagaataatataggtctcgttcctttctccaacaagtcttggatgaagattaaaatttccatgacacgctttttaaactgctaaacggtacatttcgtgcgaaaactttttatataaaagttgctctaaaatatcatattaatctattttttaagtttgttataattaaaactcaatcaatcatacgttaatatcacctcattttgcgtaaaaaaacttaatattcaacttcatcttaccgagaaaagaagatgataaaaaaagtatgaaaaaccggaaaataaaaaaacgaaggaaggcaagaaaaaacaattgtttgatataaaaatatagattgtgaaaaaaattgtacaaaatcatcatatgttacgtggccggtctccacgcgagtccacatatgattttagaaactaagacgcatgctggcaacgcgagagtcgacaaagcgagaaagcacacgtgtccactacgaggctataaataaatacccaaaagtattttttatccatcctgattatcatcggtattacgataaaaatgataaaaatacctatttaaaatatatttttttaatcacaacaccgggtacatctataagttcaacttcatcaaccgcgacattaccggtgcatcgcagcattttcctagtaaggccttgttcagttacgcttggattcaatc

SEQ ID NO: 74980 - DNA, 599 bp, Oryza sativa
gacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacaagtgcgcaagtgtggccgtggccggccgtcgacggcgacgcttcatattgaagactactagcaccgtggatgctcgtcgggcgtattgcccctcagcttgtctgctggcaaagtcgtagactaaacagatggagtagtaaacttaatcacgtctactatttattttttctctacttaaatattaattaaaattttaaagtttgatcgaatctataaaaatgaaatgagcatagcttcactagattacttgtgatggaaacagctcatctgagcctaaatcatagaattgacatatatccttggaattaccgcttattata

SEQ ID NO: 74981 - DNA, 590 bp, Oryza sativa
gactctagaggatccccatctccggctggtcggagaggagctgcgcgtggagggggggactatctagttatttgttaccactttggacctgttggtgtaacaactgtggcaagtggatagcgagagaaaaaaataactagctaaaataaaacaggaattgtcgactgtgcaacaacagtatttcaaagccatatcaacataataacacagggagtagtccttagtggaatatcatttgtctaaaggaatgacaaaatagaaacagtacaatggtaacagcagagaaagtaccttctgcttctttagcctctcattctcctcttctagacgaagaactttgttttcaagctcattagtgtaagcctgccagttagaatgcacacagcggcgaaataaatatacatgatccataaaagaaggggaaaatggcattccaatgctactgcaactggtatgttcttacagctttggaaagatataacatatatattgatatattagactaaatactgtatgagtaagagaaatgccaactttatacattcagagatttaaaaaaaagaatccatgaggcctttatgttgaaagca
